United States Patent 10,233,495 (METHODS AND COMPOSITIONS FOR SCREENING AND TREATING DEVELOPMENTAL DISORDERS) - sequence listing, part 187

SEQ ID NO: 1250 - DNA, 122290 bp, Homo sapiens
gcggtcgaagctcacgcggtaagccgctgcacgtgtgctacggcgggcggagggccgaaagtccagtatgtgggtccagggtcactcttctagagcttccgcaacggaaagtgtgaggtcagtagtagtttttgtggtacgtgcagtggtggccgcttcaaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggaggataagttaaaaatctcggtcgttttttctaatggcttaaatttgagatgtggtatttttctcattatagaattggaagcatgaatgaaacatttctgattttctgttgggagggtgtcagttaggtaaggttactcagttttaaatacaaagcaagcactgaagggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgcgtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacattactgtacactactgtatactttataaataccatacacttaggctacactaaatttataaaaatatttttcttcaataaaccttagcttactgtaacttttaataaacttttgactcatttgtagtaacacagcttaaaacaaacattgtagagctgtgcaaaaatattctttacgtccttattctaaagctttcttctctttttaaacttttaatttttttttactttaaaaactttttggttaaaaacgaagacaagatcttcaatatcactgtctttcacttccgcttcttgtcctactagaaggtcttcagggtcagtaatgtgcatggagctgtcatcttctgtaataaaaatgcccttttggaataccttcagaaggacttgaggcggctgtacagttaacttttttaaataagtaggagtacactaaaataagaaaaattatagtaaaaaaaaatatatatatacacacacaccagtgacatagttattttcattaccaagtattatgtactgtacataattgtatgtgctgtgcttttgtgagactggggcacggtaggtttacaccagcatcaccacaaatatgtgagtaatgcattgttctatgatgttacaatggctaggactacactaggcaataggaatttttcagcttcattataatcttacgggactactgtagtgtgtgtggttcattctttgaccacaatgtcactatgtggggcatggctgcatgtaaaaaaaaattgtagaagggtgatgttatagaaaacttggggcaaattcgtgtgtctgcttatgcacatatatttggcaaatttgtttctgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaaaatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgttttgcagctattcaattctgccaacatagtgcaaagcagccatagacataatgtgaatgagtgtgtgtagctgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatgatttcttatgaatagattagcaagagttccacagaagtgatattgtagtcctctcagtatatcatattggggtttcatgatgtgatataccttcttattgatgataaccttgattcacttgggtaaggtggcaacttccaggttttttcgctgtaaagttactcttttcttttgtaattaattaatgttttaggagacttattgtggctgtctaatccagtttctgttcaacttttcacccacgaattttattgtttattgctctagtgcttgcctaatgatgattttctattcccctcattccttccacatttattaattggaattcttctgtaaggaagagctgtctcttctctgccatttatttattcaattatttatattaatataaactcaaggatatttattccgtgggttataatcctatgctatcataatttattttgttgtttaaattattcagccttggccattgggacaaagttcaccaaagaatacagattggtacttgtccttaaacgtctcctattctttttttgagcacttttttttttttttttttcaagacagggtctccgtcaccaaggctagagtgcagtagtgtgctcatggctcattgcagtctcgaacttctgggctcaagcaatcctcccacctcatcttcctgtgtagttggaactataggtgcacactaccatgcccggctaatcttttgtattatttttgtagagacaggatttcaccacattgccaagctagtctcaaactcctgggctcaaaaatgatcctcccacctcggccctccaaagtgatgggattacaggtgtgagccatcgcaacctgcttttttttttttttttttttttttttttagcatttctttactttctggcaccatcaaatgtcccaggatcatcttttatttcccagtttgagctctgcaatcaaatcaatctttaaggaatcctttccatatgatttaattatatttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccaggccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatactgttatggttctacttgtatgaagtacttagagtagtcaaaatcatagagacagaaaaagtgagtgatggttatcagggactgggggaagattgaggatgaggagttattgattaatgggtgtagagtttcagttttacaacatgaaaagagctatggagatggatgatgaatggtggcgaaggttgcagaacagtatgaatgtacttaatgccactgaactgtatacttaacaatggtcaagatagtcaattttatgttatgtatagtttactacagttaaaaataggaaaagtagaattaaaagctacactattctagccaaaaaaacaaaagtgaagaaaacgtatgtactgtctgccatgtacctggcactgtattaagcattaagtaagtatgcagtggtgaacaaactagattccttgcatttgactttgattcacaaaaaatttgtaagatgcatctttatgcagagcaatttggcttttttcttttttactgagttataacttgtatacagtaaggtatatatctcttaagatcctaagtatatagcttggtgagtttttacgtgtgtatgtatccatgtaaccaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatcgatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgttttaatatttttattagccctttggaaggggtcttgtgaagtacctattcacatcttttccccatttttaaattaggttatttgtcttgattgatttgtaggcattctgtatgtttttttcactttaattttcatttttgtttctacctcttaaagtcaatgataaagtcacaactgtaaaatgaatgcatttaaaaaataaaagatatatttcaatgacaaaaagtatgcaatgatcatgaaaatctactgtacactttgccaaggccaaagaatgaaagacaatatgaaaaagccaatcttcaaatatatcctcaacaaaaactccctcctaaatagtaaaattatcatttaagaatatttgtctttacacatctaaacagaagctctaaccaaaaaaaaagtgggggaaagggcagatgataactctccacaagttttccagatataaacatgtggtcaccaggaattcaagattaaacttctaaagcaacatttaactcaaaataaagtgaacatttctgacaggtgacaacagtagtatgaaactgatttttcctttcctaaatagaaatgagatggggcatttcagtaatcatctaagaataactgtagaaatactcccaattctaccaccccacccactggtataaaacagataccttccatgaaagtatctttcacattactgaaatatcctcacttacttgggacaatttcatgcttagatgagtataaacacttgtttttaggtgtgtggaattattggagctgagatttttgaaacaatatctgaatcttagcagagatataataatactttcactatacattgattgggcttccttaaccaaatctgagcaactactgtaataacaatgctggtggtagtccatgatactctcaaattttttccctttaagaaatatataatccatgtaatactagtaaatatgttacattgtacaccttcttaacaaagaatgtctgttttcaggccttactaggaaaacaaacaaacaatggcagttactgcctgtttttatcactgataagctacaataaagctcaaatgatggatggtttacgtgtgtgatattaagtacaaaatgaaagccattataattttaccaaaagaaacacgaaaaatatgggaagaagtgaaatgaacatggcatgggtcccaaagattacgatatgtttcagaacaggattttgaaaacaaacaatttctgtgaatatttcttatactagaaagatccaaagcaaatctaggcaagcttagccctaccttgtcaaagataaatactcagataagttggaagttccgtttgctaaagtgcatctgggatcatatctaccctgctacttagagacagccaggaaggtggccatcactcatgctctttcactctttctgtgtcttatcaagagtcacacgtaacaatttttttttcaaaccaaatgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtacagttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaagaaaaatagattttataaaagggattcttttacattattattgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttccattttttcatcctcctctctgtccagaggctgaggaataagctgattacccacaaatatgtatgtgttagttctctgtttaactctctttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggctgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcgtcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttttatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcctcccagttaggctactcgggggtcagggacccacttgaggatacagtctgtctgttctcagatctcaaagtctatgctgggagaaccactactctcttcaaagctgtcagacagggacgtttaagtctgcagaagtttctgctgccttttgttcagctatgccctgcctccagaggtggagtctacagaggcaggcaggcctccttgagctgtggtgggccccacccagttcaagcttcccggtggctttgtttacctactcaagcctcagcagtggcggacgcccctcccccagcctcgccgccgccttgcagttcatctgagactgctgtgctagcagtgagcgaggctccgtgggcatgggaccctcggagccaggcgtgggatataatctcctcgtgtgctgttggctaaggctattggaaaagtgcagtattagggtgagagtgtcccgaatttcccggtaccatctgtcatggcttccctttgctaggaaagggaattctctgaccccttgcacttcctgggtgaggcgatacctgccctgctccgtgggctgcacccactgtctgacaagccccagtgagatgaacccggtacctcagttggaaatgcagaaatcacccgtcttctgcgtcgctcacactgggagcttcagactggagctgttcctattcggccatcttggaacctctctctcctcttttctttataaatcttgattttacttttatttgctgaaacagtctaatgccaattctcctttctatattaatggagaatgagcatgcagataagtgtctctatatgattccttgacagatttctttcagagactatgtctataaaaattagcccatctgagacccatcattggagccaactcattcctcaatttttaaaattttttttatggggggattacaggtgtgagccactgtgcctgacctatgactgtgtttaatattgttataaattaagacatactccttttcttctattgaatataaaattaattaccttatcaaaaatttaaacaagtgtcagtaattaagtgattaatcagctacttctgattgttcataaatggattatactttgtcagttttccttagtgatctaaatggttctctccctctgccaccatgtagaagggtcataggctatgaatagtggagttgtgggaggagaagattgggcccaggcacaatgagagtgaatatatagttttcactatgtcatgagaacagataagtctatctgggatagatttacatgttttggtggttgtattacactaacagagccacgaacttcagattcttcactttgttgagtactgttatacctaggcgagttagagaaacgccacactctgagacgaattaagagtcctttatttaagctggcggccaaagagacggctaatgctcaaaattctctcggcccggaggaaggggcttgattaactttcataccttggtttaggaaggggaggggaactcaaatgcagtaattctacagaagtaaaaacatgcaagaatcaaaagaagcaaatggttacagagagataaacaatttaaaagacaaatggttacaaaaagcaaggtaccaggtgcagggctctaaatccttcattataattagatataaatgctatgccggacaggaactcaaggctttatgttgttatctctttgaaaaaaatcctgggaacttcatacattgtttgtgccagtaccttatcagttaattgggctcctttgaaatgctgaggatctgcttacacaggtcaactccttgcggaaggaggttgggtaaggagcccttagtgtcttgtaaattaaggggtcaattggagtttgtccggctttcccagctagagagagtcttacttgagaagcaaggctaggtgattaaagagacaaacaggacaaaatttaaagtagcgagttagagtaaaaacaaggttaggcattacagtaccagctctattcttggacacaagtgttcccagccctgcctcacctggtttgcaataaaccattgcatatctgtcgcttaccttataccaaattattaatcatattgtgatgttattacaaagccttaattaaagatgatgcagtcttttgcagggattgaaattggttaggactgttgattgtcagctatttttgctacttacccctgtcttcttaccagggttgagagagagtaccgtactattactgctctctcttgccctttagttgtttaatgttagctgaagaaaccggagttaattatgaattgaatacacttatcctttgtagcttttgaattgttatttatttatttgtttgtctgaatttatgtgttctttattgttttggtgaataggtttggtgtttaggtttcataaaataaatctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctacaaaaaaaaaaaaaaaaaaaaaaaaagctaggtatggtatgtgtgcctgtaaccccagatatttgggaggctgaagcgggaggattgtgtgagcccagaagtttgaggctacagtgagctatgatcatgccactgcactccagcctggacaacagagtaaaaccttatctcaaaaaaagtagttatcagcctgcagtgatttttgtatccttcccaatccaatcatggcttacttcatttttgttactgtaaagaaatacctgagactgggtaatttataaagaaaagaggtttatttggctcatggttctgtaggctgtacaaaaagcataactccaacatagtatagttgagagttagacttaagtggcatgtacttcgcatgtttatgttttaaaaaaattataccaattatgtcttcagacattaaaatagtatgattttaagtgtttgatgcctgtgtcttctaaaaaaagtctttttgctttttatacaactctaacaagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccgtttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtcccaagtgccagtagtgctaaggctactttgaagttcgagaaaatgaaagccagcctgggcaacatggtgagaccttgcctctacaaaaaaaaaaaaaaaaaaaaaaaaaaaatacaaaacttagcccaggcgtggtggtgcgtgcccatgttcccagctaccgtggggactgaggtgggaggatcacttgagcttggagaggttgagtcagcagagagccatgactgctgcactgcactccaggcctggcgacagaatgagaccctgtctcaaaaaaaaaaaaagaaaagaaaatgattgaaagtacataaattttctctttattcttttattaaacatcattcaattgagatataaaataaagtacagtattaaagatattatctaatttagttttatctacttaataggactaatgtccttatacgtaaagtaaaaagtatgaaatctttcttgcttggtaggaaatatgaattccactatagttgagagttagacttacgtggcatgtacttgccatgtttatgttaaaaaaaattgtaccaattatcgcctcagatattataatagtgtgattttaagtgtttgatgcttgtgccttaaaaaatttttttttttgctttttatacccctccctcctcattttggagatgcagaatagcataatgaactctgaagtcagaagtttgaatcttggttctgcagtttactagtttatgtctttggatacatagtggcataaacaaagtacctgcctgataggattgtgagaattaaatgagttatatataaagtacttattgacatataggaagagcttaaatgctaacctttattctgatctgttcaccatgctttaaatgccaagtaattttgctttcttttctctttgtagatttatggtggattattttctgaagatcagtgttggtacagatgcaaagtactgaaaatcatcagcgttgaaaaggcaggaaattaagtgttcagtttttttttgctttaagaaatatttattgtggttcaaaaatttgatgcttatttagcccttcattgcttattcgtagtactgatacctggttcagtgattaaaacacagaagaaattaattgctaaaaaacatgttgttttataatcacctcagattattcaagaatagattatataatatgtaggttatttttggtgactagttatttttacctcagttcttttttttttttttttttttttttgagatggagtctttctgtgtcgcccaggctggagtgcagtggtacgatcttggctcactgcaaactctgcctcctaggttcaagctattctcctgcctcagcctcccaagtagctgggattacaggcgcccaccaacacactggctaatttttgtatttttagtagagacggggtttcaccatgtttgtcaggctggtcgaacttctgacctcaggtgatccgtccgcctcagcctccgaaagtgctgggattacaggagtgagccactgtgcccagcctgcctcagatcttaataattatatttggttcttgagtaacttttaaatgttcattttattaagctttataagtaggagaagaacattttgattgattcttctgaagttaggtatatcttttatttagttgatgtgaatattgttaataataatgattggcttgccactttcttatgcctgggttaaatgtggtgagttttctttgtgttaagcttttttttttttttttttttttttttttgacattgtgaatttgtggaggatttttaagaggatttagggagacagaattctgaatagctgtttggtgacagttgcatattgcaggctgggtgaaagcacctctgtaagatttcctttggtgttttttctacacctcctttctgtacttaaattataatatgtatgtttttactgaaccagggaaagtggttcaggataaaagagaaaaagttaaaaatatgtatgtttcagaaatattttctttggtgtgataagatgctaagatgtgacaatttgattaatattctgaatagcttggtttaaaaaaatttcattttttgctgtcatagaaaatggtttattttagtggaatggaactttctaattgacctttctcccataatttgacaactggagatgatattttacatatgtttttcagttggctttaattttttaaattaaagggcagcatgatgtttgaccttgtaataactatttttcttttttactttttaaacagatgtagagctggaggtaagggtggtgaatctgattagtttacatggtctacctggagtgagtttaattgtgtcaaaggaagtttgataactttgcctttcttttcagattttattctttccaacttgaaattgaattgaatgttgattgattttaacattaggagaaacaggagagggctgtaagcttcataggctgatgtttatttaaaatatcaattgtctaaaaacaaaaagcaccctaatgagaaatggtactgttggaatttaactagtaacaagtaaagaaatcactgtaatttcatggactgtggattttttttttattttgaagatattagaaatctgtttctgaatgtattttgtcattttgaggtaagaatgctattttgatatacaggtcattaacagagagcagcaaattggtggtttctttggaaacatttaatctggggtcagtattcgtatttgtctcttattttttccagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcgtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttgggaaagtatttattaaataaaagtgatctttacctagtcctggccataaataccacaaatttgaaattaatggggttataattaatcagattgtattattttggcagaggctcatactgtttgatgtaataattggcagtggatgttttgcttatgtggattctagtttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcatagtaaaatgcacagatttgtgttgattgaaacacacatgaatcaagggggaaaaagacattaaaaaaagttaattttagaactgaattaataaactgcagctgagaatgtttttgtatgtttcaaagattctttatatatggtactgtatataaacatttatatatatatatatatatatattttttttttttttttttggttgggggttgaagtcttgctctgttgcccaggctggagtgcaatggcatgatctcggctcactgcaacctccgcctcttgggttcaagcgattctcctgcctcagtctcctgatagctggaattacaggcacccgccaccacgcatggctaatttttgtatttttagtagaggtggggtttcaccatgttggccaggctggtcttgaactcctgacttcaagagatccccctgtctctgccttccaaagtgctgggattacaggcatgagccacccggctaaacatttgtatttggatgcttagttcagtaaaaagatcattgattagagttaagctaattggcacacaatgttttctggaaaaaaatgagctattcttgaatagctctgcttagaaagtccgtgtttagttattaattctcagcccaaagctcaactctaatcttctatatgaagtctttgctaatacccacttacccggtcctctgtggtgttttagtcactccgtatataaagcctataaagttgtaattttttcctcccctacaagcttagtgagtttggtagagataagtattcacttttctgtgcctaatttccctgccaggtaggtgttagatgagcattagtttatctaacatttgaataaatagatgaacagcagggattcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggaataaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcataagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagatttctgcataaaaattctatgcaaggagtaatggacctttagaacattcagctttaggtaattgaaacttttgtagacaataggttatttccatttgaattcacgtattgcccaaagacagggtttcttgaaatattaataattccacatataccagcaataattttcaaagacttcctaggggcagaagttgttcttgaattttagatagacttttgataataagagttgaaagcaagggtttttatgtgaaagaggttaactggaaaactacatctaattgattaaaatcctaacatatatttcagttagttatattttgaggttgttagctttgcctgcttgatcccatttgattggtgataacttctggactgtatttgttatttatactgatataattgatataatatattgatataatatattgaattcttggtgaattcaaacctcttgatataatgtgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattctttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctgaggcaggagaatggtgtgaacctgggagatggagcttgcagtgagccgagatagcgccactgcactcccacctgggcgacaaagccagactccattcaaaaaataaaaaaataaaaaaaaaatgtgtcccaatgaaataattttttttgtaatcctatgtatttcatacatttaaaaacattctgagaaaaagtccaaagatttcacctgactgataaaggagccccatggccacaaaaaggttaagaattcctacatcggtctcaattttaccctctatactactgtgtagttgaagagaaaatagttcttaaaaatgttatttagtttcttggaccttgacttccccacaccccctatttcttttaaaaatgtgaccggtttgtattttgtggtttttagtgtgtttttacactcttgtttgtctgattattacgggtatgatgtcctgttcggtttgctttgtttgcataaactatattgttttttgtatttatagagtgggaatgtagctaaaaatacagctccaccttctaagagagatacgtttcatcagatgatgtccctatttcaaggaagttgtgaaccagtaaatttgagctgtacctacccattttgtgttttaagtttatgctttatatattccgaaaaagaatacttacttttaatttcctttatagtacgcacagggtgaaattcaggaaaataacctagagaaatttgggaagagcagttagattgtgtcaaagtaattttagtaattacagttttatggaggagtagataagttcttattaaaattaagtctcaatatgttccaatcccaaatatgttttaggtgtatctttgcttagttctattgatagatattcagtagctcaaagttagcaagcacctaatttctcatatgccagttgtacagttgtagccctcttaagcaaaagtctatttaagagagttttgaatgtagaaggccaggcgaggtggctcacccctgtaatcccagcactttgggaggccgaggtgggcggatcacttgaggttaggagtttgagaccagctcaactgacacggtgaaaccccatctctactaaaaatagaaaaattaggcaggtgtggtggtgtgtgccagtagtcccggttactggggaggctgaggcaggagaatcgcttgaaccggggaggcagaggttgcaatgagccgagattgtgccactgcactccagcctgtgcgacagagtgagattctgtctcaaaaaagaagaaaaacaaagttttgaatatgtatttgtgacacctcacattttataatttcagtttgttgatttttaaagaatttgttcgtattttgtgctttcggtttgtggctttttttgcttctgctcgtcttactttaaaaccagagttcctgactctgcctctaaaactttcaaagttttgtaaaatcgagtaccttttctagatatcagagattcatttttatgcgctattgcttttcaggagaccattatatttagttggggccaaagtaatcaatgtaatctgctgggttaaaaaaaactattctaggatatttacttagtatacatttttagatttataaaggtggctgcctgtacaagtatttagctctacttgattttagcaagtgtgtaattggaatacattcatatacgtggagatgcatatttgcatattatagccaacagcaaagtaatatagagattttagaatgaagaaatatgatgcttggaaaaaatgggtaggaacaaaataagggaagagaaacatgttggtgtagctggtttatgttttcttctttcttagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaatacacttatcaaaaataaaaatctgctcctaaatctgaattattcaggcaaagtcagaatttcagataagatttgaagttcttcctatggctttaggaatattttaaagagtttcaggaaattgcctttacttttttaataaaagtgaggctctttcttcttcttgtgaaaacttgtgatggagtttgattattccgaatactttactttttagataattttaaattatcaacttgaagcagaaatccagatttgatatttatatgtatcaaaacagtcttctatatcatggtccaagccatgatgctgtatcttggatgacatagctgtttgatgggatctcatcagtgctttaggagctaaactgtcaaatgggggtgggaggcggtggacggggggatcacaggggatcacaggacggggggatcacgggggggggatcacaggagggactggaaaaaaactaatacagaaatgctttttactttgttctctgtagttgatagtgctatgaagaagttggaatatttttttttgagaattagaggcattattgaattacgacttcagttataaaatcttgtttgcattaaattattttttaatattatgaactaggtaaatattttagttttcaaaattaactttcagatatattgtggcataaaaggaccaagataacttagatttgttttctgtgtcagccttatacagtttgtttgtcaaaataaatgaatttgtttttatagggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcaggtatgttcagtggcttaaggtgaagagtgtccaactgggaaatctgtgtactcatctgctgctatttatttttctgtcactttcctttccttccccacctcattctctcctttgctaatccctgtatttgtttataggtgaattttttttcatatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccgtaataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtgtgtgtatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatacttacagttttattattaaggatataactcagaaacagccaaataaatggaagatatatataaggcaaggtactggggcaggaggtacagagcttccatgccctttctgagtgtgccaccctcccaggtcatggatgtgtttatcaacccagaagctccccaaatctcattcagagtattttggttttgtttgtttgtttgttttgagacagtcttgcaacatcttgctctgttgcttaggctggagtgcagtggtgtaatttctgctcactgcaacttctgcctcccggactcaagcaatccactcacttcagtctcctgcctagctcggactataggtatgtgccccattcctggctaatttttgtgttttcttttctttttttttttaaactcaaacttgccttatttatatccccaatggcatgatctcggctcactgcaacctctgcttcccaggttcaagcgattctcctgcctcagcctcctgatagctggcattacaggcacccgccgccatgtctggctaatttttgtatttttagtagagacggggtttcaccatgttggccaggctggtttcgaactcctcaggtgatccacccacctctgcctcccaaagtgctgggattacaggcatgagccactgtgcccagcccacattttctttatccagtctatcattgatgggcatttgggttggttccaagtctttgccattgtaaatagtgctgcaataaacatatgtgtgcatatgtctttatagtagaatgatttataatcctttgggtatatacccagtaatggtattgctgggtcaaatggtatttcttgttctagatccttgaggaattgccacactgtcttccgcaatggttgaactaattcatactcccaccaacagtgtagaagtgttcctatttctccacatcgtctccagcatctgttgtttcctgactttttaatgatcgccattataactggagtgagatggtatctcattgtggttttgatttgcatttctctaatgaccagtgatgatgggctttttgtcatagttttttggccgcataaatgtcttcttttgagaagtgcctgttcatattctttgcccactttttgatggtgttgtttttttcttataaatttattttaagttccttgtagattctggatattagccctttgtcagatggacagattgcaaaaattttctcccattctgtaggttgcctgtacactctgatggtagtttcttttgctgtgcagaggctctttagtttaattagatcccatttgtctattttggctcttgttcccattgcttttggtgttttagttatgaagtccttgcccatgcctatgtcctgaatggtattgcctaggtgttcttctagggtttttactgtttggggttttacatttaagtctttaatccatcttgagttaatttttgtataaggtgtaaggaaggggtccagtttcagttttcttcatatggctagccagttttcccaacaccgtttataaaatagggaatcctttccccattgcttgtttttgtcaggtttgtcgaagatcagatggttgtagatgtgtggtgttatttctgaggcctttgttctgttccattgatctttatatctgttttggtaccagtagcatgctgttttggttactgtagccttgtagtatagtttgaagtcagatagcgtgatgtctccaggtttgttcattttgcttaggtttgtcttggctatacgggctctttttggttccatatgaaatttaaagtagttttttctagttctgtgaagaaagtcagtggtagtttgatgggaatagaattgaatctatcaattactttgggcagtgtggccattttcatggtattgattcttcctgtccacgagcatggaattgtattttctgtacagtcagggtttgctgtgttgcttaggctggtctcaaacttctgggctcaagcaatccttcctcttttggctccagagttgctgggactacaggcgagccaccatgccttgctaaattaatgaactttaaacacatttgacatgttttaatccactgaagccattttttttctttttgatgcacacattatcccctttgaagtctttttaaattagcttctgtgtccttttgacatcataacagctgatattcataatggataaatcaccattattaagtttttcattaatctgtgacctaatgatttttgcagccatcgatggttgttgtctgcaagcatgttttcatcaggtgctgtatttcttttttttgtttttattattatactttaagttttagggtacatgtgcacaacgtgcaggtttgttacatacgtatacatgtgccatgttggtgtgctgcacccattaactcgtcatttagcattaggtatatctcctaatgctatccttcaccactccccccaccccacaacagtccctgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacattaactcatcattttttttggccaggtgctgtatttcttagctggaaaatttcaactatttagtcatgctgaagcctagtttgttcagtaaaggcaagataaatactttattcattccctttatatgtacatgttttcagaaaaataagtttattccctaggattgtccagtgttgaccagcaagggttatttgttctccttaagtattattatgaactaatgaattttaaacatatttgagtgttttaattcactgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttaggaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgtctctaaactctcataagggtgccatctgtagtattgtaactagagagggtggggcccctctcaggtgagcagtgtggatatgaagcagtggggagtgtgttctactcaagtgtaagtctcacagcagcctatagcagagctttgggtgttgtcccaggtgtgcataggagagcctggcttttctgccccttcttggctgggcagcagctgcagtcatgtcagcctaaagtcaggccaaagttgggccacagctcagaattaaactctccaagtgacacttttggcctgtgccctgggatactggggcaccaccctggtgaacagcatgggcaaaaagctgtgggaagtgtagtctgattgtgtctcagtttcacagcagcccattgcagggctgtgggtattctatagatatgtgtggggtagcctggtttccctgttggtcctttgctgggcagtgactggggctgtgtcagcccaaactcaggccaagggcaggactcagcccagcattgaactcagaaaatggtgccttgggcatggggctagagagaatgagtcaccacccagccaagcagcatgagcaagaaggtgtatggagtatgatctacttatgtctcagtctcaacagcagcttgtagcagggtgacaagtatcctcctgggggtgcatgggcatgcttgttctccctctccttttttggagcagtacagtggctgcagccatgtctataggtccctggtatctaaactcttaaagtggctccctgctgaggctgctccagacttgggtgcctgtgggattctgtgtggattccttttctggaacaatgtctttgtgtgatctttaggcagctccatatgtgaggtgtgaggccctagtggatcgagggtttctcctatagccaatgttgtaaatgcttgtttcagagctctggggatttttctcttactgtttccctgcgtacagtagcctttcccagctctcagctggtttctggctaggcatgcttcctcaaaccctctcctttcttacttctggggctttctctctcttctctggtgaatccaaatattcattcttagtctgttcaaaatgtgtctacttaactatttctgattcttccctgtggaaaaggcacacactatctagttggccatcttgattattttctctctcactcattgtttatcattgtggtttggtgtgtttctgtagtgggaacatttgattcctttcttgttttacttgtgtgtttgctttactctgtgggttttatacttttttttttttttttttgagacagagtcttgctctgtcgcccaggctggagtgcaatggcacggtcttggctctctgcaacctccacctcccaagttcaagcagttctcctacttcagccccctgagtagctgggattataaggacctgccaccatgcccagttaatttttgtactttttagtagaaacggggtttcaccatgttggccaggctggtcttgaattcctgacctcaggtgatctgcccacttcggcctcccaaagtgctgggattacaggcgtgagccactgcgtccagctgggtttttaactttcatgtgtttttatgatcacagattgtgtattgccctcccttaagcatctcttgtagggatggtctagtgctgatgaattccctcagcttttgcttgcctgggaaagactactacttcttcattcatgaaagacaactttgctggatatagtattcttgactagcagtttcctttcagcgctttgaatatattgtttcattctctcctgtaaggattttactgagaaatttacagttaatctgatgggggtttccttataattgatgacacgcctttttccttctgtttttagaaatatctttgtctttgacttttgacaggttgactgtaatatgctgtggagaagacctttatgaattttatctgtttaggcatctctgaacttcttttatttgaatgtctaaatctcttgctagacttgggaagttttcagctattttattaaatataagaagtttttgatccctttttttctctttttctgtgacattgaaaattcaaatacttgtttgcagtgtggtgtctcatatgtcttgtaggcttttttcattcttttttgttctttttttaaatttttgattgactgggttagttcaaaagtcttgtcttaagttctgaaattctttcttctgtttgatctagtattttttgttgttgtttgttttgttttgaggcagggttttgttttgttgcccaggatagagtgcagtggcacaatcacagctcactgcagcctccaacttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatcttttcctgaagatgtacccatggtgttggttgggtagggccctttggctttaattctgggttcatgcagtagcatagtctttgtatgattcctttggatgtgaatagtcagtggcgtttgtgatttcctcaatggcttagggtgtggttgttagtgggggctgcggagaagttttgctgggtaaaggaatgccatgtttgccagtcctcagaccccaatggtggcaatgccaggccaagtatgcttgtccttggtttccaggacagcacatgctggcactactgttagaaagcccaggttggccagtgcttgggtttccaggagtcttgcttgggtgctagtagcagcagtggtgggccagacaggtgagtgtgttcttgggctcttaggcagtgggcacgatgtgggtgatagtagcaatggcttgacaaccctgtgctttccaagtggtctacactggtgttagtgctggctgtgatgtgctgagtgggtcagtcaggcccacaggtagcatgtgcaagtggatgccagctgtgttggtagtggcaggttgggtaggcctgaccttgggcccttgggaggagtgttgaggtaccaatggtggactgggctgggtgatacccagggccttgggtggtgtgctcagacactggtgagaggggttatggagctgggtagagtggacctgtcctcaggtccaggtggtgagtgcagactctgattgcggtaggcaggtgcaggatgatgcccaggtttccagtggaatgcttgagtgggggtggcagtggttgctttgcagccctgtcactggggagggtgaggttgctttcactggcagcagatgtgtggaggtggctggtgaacatgtactttgctcttacatttgctccagtggaggcagtttgcaagggcagcagctgcaggtgggaaagtttgtcctttgggtgtgtgaaaatgtgcagcagctttgctgcttagggcagcggggtcactgtaaatggctcacactttgacactggtggcagcagcagctagcattgcctcaggttctgggttgggtagccctcccttgggtcatgtgaagatgcatggctacccttctgctggtggggttggggttcctgccagtggcttgcagtttggcctcaggtgtggcagcagctagtgacaatggtggttgtgggatggggtagcctttcctctgggtccgtgaaaatgcatggttgcccttcttgggcgtagagtggctgccagtggcttgtgttttgattctgtggcagcagcagccagtagtggtggtggctgcaagcaggatagcatttcctcagggccatcaagatgtatggctgttcctctgccgtagggaacagggttgctgccagtggctcctacctcttcgcgggtacttgcagccagctgcagtggtggctgtgggcaggagatgtcagctttgctccagggttgtggagttgtaggggatgttgggccctagaccatgatgcagtctacttggggctgggcacacaaaatggcagcatgctgtagttgcttaggattggggggtgggtgtatgggacccaacatgagctccctgtatggagcaatatacttgtgtagtctctgggcagctctctgtgtctcagagcacatgaggatcaaaggtccctttcgtggctagaattgcaggagtttgcagtgagaatatgggccactggggtctctcatttaccccttctatgcattgaggagcctgtccaggctcccagccaagaaggctgcttctcttctttctccttccttcctttatgtgtttcctgtcacttctctgttgaagtcccatttctctcttagatgatctatttgaagtgtgattatctacttgctattttggctcttttctcagagggaggcaaataacagtggcctctagtgagtcatcttgaagcccctgtctgaaataatgtaatctaacaaacacgtttttgtgtgttatatttattgtatactgtatctttacaattaagtaatctagagaagggaaaatattattaagaaaatcataaggaagaagaaatgtatttacgttttattaagtcttaatcctcattgtcttcatgttgagtaggctgaggaggaagagcatgggttggtcttgtctcacaggtgacagagatggaagaggtggagggataaataagttaaataattttaacttaatattatttaattttaaaataagttaaaattatttaacttactaacttatttaaaaataagttaaaattattttaaaataaattaaactttttacttttttttctcaataagttatacaaggtgtaccaggcaggcacaccttgtgtaactttttgagaaaaatctgtttgtaagtggatctgtgcagttcaaacctgtgttgttcaggcatcaactatgtttcttttcatacattgttggattcagttttctaattttttggagggtttttacatatatgttcgtgacatatattggtttgtggctttctttttgtgtaatgttgttttctgatttcagtattagggtgatgctggcctcatggaatgagtttggaagtatttcctctgcttctattcaatgactgagaattggtatagttttttccttaaatgtttggtagaatttaccagtgaacttatataggcctgacattttctgttttggaaggttattaatggttgattcaattttaaaaatagaaataagtctgttcagattatttttttatttttatttttttggagacggagtctcactctgttgcccaggctggagtgcagtggcgcgatgtctgctcactgcaagccccacctcctgggttcacgccattctcctgcctcagcctcccaagcagctgggactacaggcgcccgccaccatgcccggctaatttttgtatttttagtagagacggggtttcactatgttagccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggttatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcgttctacaaattttggtaagttgtatttttatcttgaaagtatttttaaatttgtcatgagatttcttctttgactcatgtgttattagtaatgttggttaatccttacatgttttgagatttttttcaattatctttctgttattgatttttagcttattctactgtggcctgagagcagacattgtacggtttctattcttttaactctgttaaggtgtgttttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcccggactcaagtgatcctcccacctcagcctcctgagtaactgggactacaggtgtgcaccaccatgcctggctaatttttgctttttttttttttttgggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctcaattttttcctccccctttaggtgggataggatggctagagtaggatggaattgggtatttacctcctcccatgtggaaggatagagctggctggagttggatatttccatcccccaggtcagttaggctttgatgaaacctcagcaggttaggctctgcttaactggtttcttttcagggtagatcttattaagaagtacagagtgctctgggatatttcagaatggtttgtttccccccccgccactgctggaaacatgaggggattttactgcgatgatatgtatgatactgtatttactgtgagaacctgatctagctcctggaggtaaaattcacaaaagcatgggggcccccatgactggatgcccctggagctttcaactctcagtcgtgcccacacctagtttccagcagtttgtcagcagtccaggttttcctatctaggcactgcttcctgtagaaatttctgttccagtatgttgtgattctctgtatccctgtctgtctgtttaattttaggagtagcagttttcccagtgaccctacctatctcaccttttcttacagatctgagaaaagttgttgatttccactttgttcagctttttaatatgtgttaggatggcatagtgacttccaggctccttacatgtgaaaccaaaacctgaagtccccatattattgttttaaatcttttgttcttttgtaatatacttttagagataaagatttctttctaagcattgctttatttacaaaccacaaattttgatatgttttgtttattatttagtgaagcatatttacaacatttcctcgtgaatcctagtttgaaccatgagctacttagaagcatgttgcttaatttccacaaatttgaagatttccccaatatacattttatttttttcttggtacatagtatttgtatatgtttactggtgtatgtgtgatattttgtcatatgcctagaatgtgtaatgatcaagtgtaggtatttaggatatcgatcacctcaaggatttatcatttctgtgtgttgggaacatttcaagacctctcttctagctattttgaaatatacaatacatcattaactgtagtcatctgctatcaaacattagaacttatcccttctatctaactgcgtgtttgtacttattaaccaaactttctttattcttctatccctaccacatccttcctagcctctggtatctatcattccactctctacctccatgagatcaactttttttagctcctacatattaacaagaatgtaaaatattttctttctgtgcctggcttatttcacttaatagaatgacatccagttccatccatgttgctgcaaatgacaggatttcattctttttttatggctgaatagtatcccattgtatatactgcattttcttgatccactgatggacacttaggttgattccatgtctttgatgttgtgatagtgctgcagtaaacttaggagtgcatgttaattcctttcttttggataaatactcagtggttcctgcaatatattttgttactgatttctaatttaattttattggtatcagagagcatactctgaatggtttcagtccttttaagttgattgacatttgtttcattacccagcatatggtctgcctggaaatgtttcatgcatttttaaaagttatgtgtatcctatagctgttgggtgaagtgttttataaatattaggctgaattggttgatagtggacttcaagtcttttagaccctgacagattctttctctacttattcaatcaactactgagagagaagtactgaaatctaaatattattgtagttttgtctgttttattcccttttgttctattagattttgtgatttttttaaaaaaagttctattattatgcaaatatacatttagaattgttggatctttttgatgaattgacccatttatctttatgaaatgtctctctttattgcttagaaaatactccctgtgccaaagggagttgttgcttgacattaatacaggcatatttgcatatagtatttttattcgaagttcctagagcagtcaaatctgtagggacccaaagttgaatggtggtttctgggggcttgggggagggggaggggagatagggagtagtgtttgagagatagagttttaattaggaaagatgaaaaagttctggagatggatggtgctgatgattgcacaacaatatgaatgtacctaatgcaacagaactatacattttaaaatggttaaaatgataaattttatgttatgtatattttaccacaatttaaaaaaagacatagcaccaaaaaaagatgatgaatgaataaattccaaaaagctgtgccaggagtgataatgtatagtttgtttagaatcattgaagccttcattctttatttaattgaagcagttaaaaataaatattaatttgaaataaaaatcagcagctagattctattatattttattcaaatttggaatttttttttttttttttgagacagagtctggctttgttgcccaggctggagtgctgtggcacaatctcgcctcgctgcaacctctgcctccctaactcaagccatcctctcaccttagcctcctaagtagctaagctacaggcatgcaccaccacacccatgtattttttcgtagagacggggttttgccacattgtccaggctggtctcaaacttctgagctcaaaccatctgtcctccttggcctcccaaagtgttggaattacaggcatgagccactgtgcccagccaaaaattatttaaattatagcagaaatacagtttcctatttgggtctcacgagaatgtgtttattctttgtttcagcaagagaaggcagctgctgtggatttgactaaccacttagaatacactctgaagacctatatagataccagaatgaaaaatctggcagctaagatggaaatactgaaagaaatgaggtaggtaaaagcatatttttcagaaggatattttaaactaatttttaatcaattggtgctttgtttaaattgtgtgcttgccatttttgctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcaattcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacagattatcataaaataaaaatttgtgaagtatgcaagaatcatacagatgcctttgcaataagcgatgtgacatgaaagcattcagcaagcccactacgtttgttattgtttgtttttgaacctgtggtggtagggggcgcttcttagaattttcgcttgcaaacatttattccttgatttaaccctactgtcacccactcattcaccaaagtttgggtaaataattatctttgttgtttttattgctttttcttaaatgtgtgtataggacacgtatattttagtgtttaatattagaaatgttttgggtctttatttggaagtgctgtttttgtgactaaaaatatgccataggaacttaactcttgtttagatcaattagcctatgatactatgggtttcttatatgtcttttctcttagacattgtaaattatctgtagaccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctccctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtgtatatgtaccacattttctttatccagtctatcgttgatgggcatttgggttggttccaagtctttgccattgtgaacagtgctgcagtaaacatacgtgtgcatgtgtctttatagtagaatgatctatattcctttgggtatatacccagtaatgatattgctgggtcaaatggtatttctggttctagatccttgaggaatcgccatatcgtcttccacaatggttgaactaatttacgttcccaccaacactgtgaaagtgttcctgtttctccacatcctctccagcatctattgtttcctgactttaatgatcgtcattctaactggtatgagatggtatcttcttgtggttttgatttgcatttctctgatgattagtgatgttgagctttttttcatatgtttgttggccacataaatgtcttcttttgagaagtgcctcttcatatcctttgcccactttttgatggggttgtctttttcctgtaaatatgtttaagttctttgtagattctggatattagatctttgtcagatgggtagattgcaaaaattttcttctgttcaggagaacaggttgcctgttcactgtgatgatagtttcttttgctgtgcagaagctctttagtttaattagatcccatttgtcaattttgacttttgttgcatttgcttttgttgtttttgtcaagaagtctttgcccatgcctatgtcctgaacgctattgcctgggttttcttctagggtttttatagttttaggttttacatttaagtctttaatccatctagagttaatttttgtgtaaagtgtaaggaaggggttcagtttcagttttctgcatatgtctagttttcccagcaccatttactgaataggagatgctttcccaattgcttgtttttgtcaggtttgtcgaagatcagatggttttagatgtgtgatgttatttctgaggtttctgttctgctccattggtctatatgtctgttttggtaccagtagcatgctgttttggttactgtagccttgtagtatagtttgaagtcaggtagcatcatgcctccagcattgttccttttgcttaggattatcttggctatatggggtcttctttgaatccatatgaaatttaaaatagttttttctaattctgtgaagaatgtcaatggtagcttgatgggaatagcattggttctataaaattttttggccagtatagccattttcatgatattgagtcttcctatccatgaggatggaatatttttccatttgtttgtgtcctctcttatttccttgagcagtggtttgtagttcttcttgaagaggtccttcacatcccttattagctgtattcctaggtattttattctgtttgtagcaattgtgaatgggagttcattcatgatttggctctttgcttgcctcttgttggtgtgtaggaatgcttgtgatttttgcacatttattttgtatcctgagactttgctgcagttgcctatcagttcaagacgtttttggggtgagacgatggggatttctaaatataaaatcatgtcgtctgcaaacagacaacttgtcttcctctcttcctatttgaataccctttatttctttctcttgcctgattgccctgtcgagaacttccaatactgtggtgaataggagtggtgagagagggaatcgttgtcttgtaccagttttcaaagggaatgcttccagcatttgcccattcaatttgaggctgtgggtttgtcataaataactgttactattttgagatatgttccgtcaatacttagtttactgagagtttttaacatgaaggcatgttgaattttatcgaagccctttctgcatctattgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtagatagaacatacaatcgggttttacaccgagacattccattgcccagggatgagcaggagacagatgccttcctcttatctcaactgcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggagtggtgatgatttttaacaagcatactgccttcaagcatttgtttaacaaagcacatcctgcatagccctaaatccatgaaaccttgagtcgacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggtgatacccctttaacattttttgttgagtctatttgattcttctctctcttcttcttagtctagctagtggtctgttttgttactttttttaaaaaacagaccctagattcattgatttttttttggagtgttttttttgtgtgtgtgtgtctctgtctccttcaattcttctctgatcttatttcttgtcttctgctagcttttgggttcatttgctcttgcctttctagttcttttaattgtgatgttaaggtgttgatatgagatctttctagctttctgatgtgggtatttagtgctataaattcctctcttaacactactttatctgtgtcctggagattctggtacattgtctctttgttctcattggtttcaaagcacttcttgatttctgccttaatttcattatttaccctggagccattcaggagcaagttgttcagtttccatgacattgtgtggttttgagtgagcaatactaaccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaatatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaaatgcaaaagaactgaaatcataacaaacagtctctcagatcacagtgtaatcaaattagaactcaggaaatgttatctttctagaaagacaaggaactggagatattgtaatgatagtttgtgtaaaacctttaacttttacagtatcttcatattaataatttccttcatttattgccttataagaaaggtgtaatagacaactggtgattgtggataaggggtagcaaaatcttttccctttttgcatgaaaactttacctttggttaactccctctctttgttcccttggtaatgtgataaaatatttcaactgtgttactaggcaacattatttatggtaagtataacttatgattgtcaaactgcatctgtactgggagaaactacaaactacaaatacttgatgtggactcttgtaactaaacatgccccttgagggaccctggaagctatacctatggagttgttacaagagatactggcttttgagggacattaggcttgtaaaccagagtggctttcatacatgctaatgtggaacttttctggtctgagtggtgtgttttatgcatgtaagactctgccttactattaattagtgtctgagtcacctattgttgggaggtagttgtttgtgtgtgtgagtaggggtgtgaaaatgaaatattttacataaattctttattagcttaggtacaagtatatttatttcctgttgcagttttctttaatttattgtattgggctgaacagaacttcctgtttttcttgtaaaccattccctacaaccaccataactttccctagcacctgtgagctctatacttgttgtgtttggacttgttccatcttaaatatttgtggtttctgcctctgtggattataccctgtaaatcttactccctagtcatacctaggttgatcagttggcagcctgactgcctctgaatgagaagtatgagcaggataactaggcttttgaaaatgccaggaatgtttagtttggagaagggatttgattttggttattttacgtattagattctaactgatcacttctgattatgggagaaagaagatgacagcagaatgattaattttttaatttctatgaaacacaggcagtgtgtttataaacattttcttacattaacttttaaaatgggcatatttgctcccattttataagtgaggaaacaggcttacaagggtaaggaaattgttcaagattacctagttgtaattttttaaaattaaaaaattactcttttttttgaggtatggtctcactctgtcacccaggctggagtgcagtggcacgatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccattgaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgataacttttattcaagtattttgcatagttctttaacttgattgccatgtggccatatgctttttttttttttttgagacggagtctcgctctgtcgcccaggccggagtgcagtggtgtgatctcggctcactgcaagttctgccttccgggttcgtgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatgtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagattaaaacttttttattttatttcattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatcagaggctagagtactgtagtacatatagctatatgatatggtggaatcttgtcttcagctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctcttttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttggagaagaagatattcagggacatctgggcattgtttctttctgtcctgctggatgaagatgtagttttgatgatgcaccacatggcttaagaaccattggagccctggtttgaaacattttcttaattggaattgcataaatagtataagttcttccagaatgttgaagtaagccttgcatataaaagggcagtaatatagtaagaatttagctttccacaatgcagcttctactttgtcccttaaaggtttatttcttctcactgttagtaaatgtaggttaaggttctgtaattaagatcatctttaaacctcttttcttttaaaagttcaatgctagaagactttttgccttaactggcttgtctccacttctagtattccctcaggtcaccaaaatattctttaaacttctctttattttgctgagaaatagtttatatttttcaagtatccaagaaagatatttctataatgaaggtcaaataaatgaaagttcttgatttctgatttcctcagcattttatttagacttcttttgtggcatacaatacatgtttgattttttgtgactggtcttcttaagttcaaaaagaaattgtattctcggttttcttggtgtacagttttagatatatctaaaacttgcttaggttttggttggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctacctagtagctgggattacaggcacacaccaccatgcctgtctaattttttgtattttagtagagatgggtttcacgatgttgcccagggtgggctcgaactcctgagctcaggcagtctacccaccttggcctccaaagtgctagatttacaggtgtgagccaccgcacctggcttctccctttatttttaaccttttgtattcacgttttgaaataacctcttgataacacactaatggatttaatttttgaaagcacccaacgtatatcttttttgttggtaacttaatttacatatttataattactgttttattaaaacttatttctgtttatcatcgtttctttttctctctttttctaacttacacctcttatacttttttttttttttttgagatggagtctcactctgttacccaggttggagtgcagtggcacagtcttggctcactgcaacttctgcctcctgggttcaagtgattctccttcctcagcctcatgagtggctaggattacaggcaggcctggctaatttttgtgtttttaatagagatggggtttcatcatgttggccaggctagtcttgaactcctggcctcaagtcatccacccgcctcagcctcccaaagtgttgggattacaggcgtgagccactgtgcccggccactcttctaatactttagaacattcttatctgcctttggtgtctttcctctctttctctacctccttccccaaaccaaccagtgaacctaccacaattgtctaggattttagtcacgggttattatagatattgtgtgtgatagctcagttaaatagactttagagttatttttccattcttatttcataagtcgtttatctcttggctttctctgtatattggaatattttctctaagagtgctttcaaagaaatctttgtgtatttgattttgcgagttatttgatatttcaggatatctcatttcaatctcaaatacaaatagttgtttagctgactataaaatagcaagttcaaaggccatgtttcctttacacctttgacaataataatctattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaaagtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatattttaatggctaatctattgtttaaaatctttttatcttatgtaggaggtgggttaaactaaataaataaatacaatctttttatcttgttggtgtctttttggagggatccttgacttaaccatgtagctaatgaattaatcctctagctgtgtcccttctgccatttagccaatccattgcattttgtatgtcaaagattatttcttttatatttaatatcttcagttggttattttttatttataagtacttggcttttgtgtttccaatattctttcttttgttgagaatatttattatgcttatttttgagttcttactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatctgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacattaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcacgatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaatatatccatgtagcaaaattactcttgtacttaataaatttatacaaaaagttagggaaaacagggtaatgtctacttaattaaaaaccataaggatataaagctttctatttgtaactaattcacttaataaactttactgttatggtccaaataaaccaccttctaggtagttttgtgttttcatctctatctgatgattctaagttgtatttatgaaattctcaagaatggggattcagcatactgcttttctaccccttagatcctaacacagtgctcgaatcctgaattagttaataaactttaataaacagaagtatatctctctgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtaataaaagctcctgcccggttgtgtttgtagcataaaccagggaatatatattttaaaaatcacgcgctttgttcaagagctgacatcatctacctactatgtatcagatttaaaattgccaccttaccagtcaaggttctttattagcttttagtcagattgctccttttattagtctcaaaaaaatcatatcggtcttgttcctcctttttctcagcttttcctaaggattgtcctctttcctcttttaaccatttatttattttcttacagtatgctatgtgtatgtaccttttcctttcagtgcataaattttatgagggtaggcacttttttttcctgcattcctagttcttttacattgcccagggtatagcttaatactctgcttcaggtattaaggcacgatgaatgctgattgaattaaatgagatatttcatgtgtttatttttgcaaatgaggtttttgacctatctgtggaaggatcactgatttcagaagacgcaatggataatattgatgaaatcctagagaagactgagtcaagtgtctgcaaagagctggagatagctctggttgtgagtatcgatattctttattattgcctcctttgaagcagtgtggtttcctttcatggttagaaagtattaaccaataatagagtttttcttgctagttagaaagtattaagactgatcttagctttcttctaataggcttgttgaaagagtaacaatgtctagttctaatccagacaccatgcaaagtcttattcttaggtgacatttttgttttaataggacatttcacataaaaaatctgtttaattctaagaaaactgctcttaatttgagtggacaatcttgtctatattttgattcttgaatgcgtcataccaaatgactataagaagagactccttagagtttgtgaaaacttaaaatctgagagagctctgaaagttgacacacaagatggagtggtcatcctctttctttctccattgtgtatattctttgttacagtgtcaaggtaaaaattagtgtagctactccaaagggtgttttgtaattttaattattgctcattgggactcttcccagttattcaggctgctttccaatgtttcagtggttaggcttctcattttacttgttttttcttttttttactttttataattttactcatattggcattaaaaatacattaagaagttttatattgttaaatagtcctgatgtagatagttttgtcagacttgattttagtagtagttgttaacaggtgatttctaaaagtaaagtgttgaaggtctatatattgtttatagttcttatatttagcatattagtatccctgatttccattaatgctcttattctacacagctttgggaataatggtgtaatacgggtaaagtttcccatatgaatggctttgctttttttagagagacagtgtcttgctctgtcgcccaggctggagtgcattgatgtgatcctagctcactgcagccttgaactccttaatctccctgcctcagcctcccttgtagctaggactacaggtgtataccactgtgctcagctaattaaaaatttttttttagggactggtctcactatgttgcctggctgccatatgaacatctttgatatctatctatcttctgactaggaaaacatttgtgtttaagaactgttttgaaatcactgcggaaatctgttaaaggcataattttgaagtttatctattgttattggaggccttagctgttttggatattcctttgtgtataattctatgtgtgtgatttcatttaggatcaaggtgatgcagacaaggagataatttcaaatacatatagtcaagtactgcaaaagattcattcagaggaaaggctcattgccacagtacaagctaagtacaaggacagtattgaggtttgattgtgctttctcttattgatcttataaattgatgatttgaatttttcagtacttaaatttttctattgttgtttaatactcagtgtcagtaaattgttattactagaattcactgtcaactggaaatggtgatttttgatgatataaatatatcaaattttttattgttttaaatattttattatgtccatgagaaccacaatttttaacatcattttctttttgcctgtatgagtctactgtagataatttgctatatacagaaagataagaaataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacatatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttgttgaaaattatagattttcttggtatttcagtctgaactcagtaaatactagttgaatcttaacagagaaataataaatgatcactgttcaataaatacttttcttatgtgtttgaaaatacgtaacttttgtttacttagtttaaaaagcagcttattgaatatttaaataagagtcccagtgtggatcacttgctatccattaagaagacattgaaaagcttaaaagctctactcagatggaaattggttgaaaagagtaatttggaagaggtaaggaaacagttgtttcttactgatctttatgtgcatctcattttacttggtctctgcttcataaaaataatgcataaatacactctttacaataagagagccattacattcacattttgttttatatactttatcttgttttctgtgtatataaataaaattgagattacagtaatagtgtaaaaattttcctatatcattaaatattctttaaaaacattttcctaggctgccttggttcttagtaacatgaacattttagaataattttaaaagctcttttagtttggactgttagaatgtttattgtaataccaacttgctacatgcaggtgacagggtaccccctcgaaggtagcgttttgtcataaagtatttttaagatcatggtatcttttgttaactccctttttatggatagatgtaatatttcttgcaagtattttaagttgcttttatatgataatagaactggagaggattaggatgccctaatctggactaacttcttcctttaggcttgaaactttgtgaataagatagtaaactttgtgttcctttgaggatttgatttatgtacaaggatctgtattatgccttaatccaatttgaattatctgtcttctacttctgagcactgaattgggggtggagcggaggactattctagaactaatatcatagttgaagaactttctagttttattctattctgggctttggggaagttgatttttttagtctgatttttcaacttttggagaaatctgacttttgttatactttaagttctgggatacatgtgcagaatgtgcaggtttgttacataggtatacacgtgccatggtggtttgctgcacccatcaacccgtcacctacattaggtatttctcctaatgctattcctcccctagacccccaccccctgacaggcccagtgtgtgatgttcccctccctgtgtccatattttctcattgttcacctcatcttatgagtgagaacatgcggtgtttggttttctgttcctgtgttagtttgctgagactgatggtttccagtttcatccttgtccctgcaaagaacacgaactcgtccttttttatagctgcataatattccatggtgtatatgtgccacattttctttatccactcaatcattggtgggcatttgggttggttcgaagtctttgctattgtgaacagtactgcagtaaacctacatgtgcatgtgtctttatagtagaatgatttataatcctttgggtatatacccagtaatggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgttggtttgctgcacccattaactagtcatttacattaggtatttctcctaatgctgtctctctccctgccaccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatattcttaatccagtctattattgatgggcaactgggtttgttccaagtctttgctattgtgaatagtgccacactaaacatacgtgtgcatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctccccactgtctgttgtttcctgactttttaatgatcaccattctaactggtatgagatcgtatctcactgtggttttgatttgcatttctctgatgaccagtgatgatgagcattttttcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttaaagtcaggtagcatgatgcctccagctttgttctttttgcttaggattgtcttggctatctgggctcttttttagttccatatgaaatttaaagtagttttaaaaaaattctgtgcagaaattcagtggtggcttgatgggaatagcattgaatttataaattactttgggcagtatggccattttcatgatgttcattcttcctatccatgagcatgaaaattttttccatttgtttgtgtcctctcttatttcgttgagcagtggtttgtagttctccttgaagaggtccttcacataccttgttagctgtattcctagataccttattccctttgtagcaattgtgaatgggagttcactcatgatttggctctctgtttgcctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatttgacttcctgtcttcttatgtgaataccttttatttctttctcttgcttgattgccctgtccagaacttccaatactgtgttaaataggagtggtgagagtgggcatgcttgtcctggtgacagttgtcaaagggatgcttccagattttcccattcagtatgatattggctgtgggtttgtcataaatggctcttaatattttgagatgcattccatcagtacctagttagttgagaatttttagcaagaagtgtgtcaaattttatcaaaggctttttctgcatctgttgagatagtcgtgtggtttttgtcattggttctgtttatgtgatgcattctgtttacttatttgcatattttgaaccagcgttgcatcccagggatgaagctgacttgattttggtggataagctttttgatgtgctgctgaattcagtttgccagtattttattgaggatttttgcatcaatgttcgtcagggatattggcctgaaattttctttttttttgttgtgtctctgccaggtttttgtacgaggatgatgctggcctcataaaatgagttagggaggattccctctttttctgttgtttggaattgtttcagaaagaatggtactagctcttctttgtacctctggtggaattcacctgtgtatctgtctggtcctggactttttttggttggtaggctattaataactgcctcaatttcagaacttattgttggtctattcagggattcgacttcttcctgatttagtcttgggagggtgtatgtgtccaggaatttttccatttcttctagattttctagtcgatttgcatagaggtgtttattgtattctgtgatagtagcttggatttctgtgggatcagtggtgatatcccctttatcattttttattgtgtctatttgattcttctttattagtctggctagtggtctatctattttgttgatcttttcaaaaaaccaactcctggattcattgatttttttttgaagggtttttcatgtctctatctcctccagttctgccctgatcttagttatttcttgtcttctactagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgtcgacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttgtgagtaacccaacctttctctctggcttcccttaacattttttccttcatttcaaccttggtgaatctgacaattatgtgtcttggggttgctgtttttgaggagtaggtttttggtgttctctgtatttcctgaatttgaatgttgacctgtcctgctaggttggggaagttctcctggataatatgcttaagtgtgttttccaacttggttcccttttccctgtcactttcaggtacaccagtcaaacgtaggtttggtcttttcacatagtcgaatatttcttcaaggctttgttctttttcattttttttctttaatcttgtcttcatgctttatttcattaagttgatcttcaatgtctgatatcctttcttctgcttgattgatttggctattgatacttgtgtatgcttcatgaagttctcatactttgtttttcagctccatgaagtcatttatgttcttctctaaacaggttattctagttagcaattcgtctaaccttttttcaaggttcttagcttccttccattgggttagaacatgctcctttagctcggaggagtttgttattacccaccttctgaagcctacttctgtcaattcatcaaactcattctccatccagttttgttccgttgctggcgaggacttgtgatcctttggaggagaaaagatgttctggtttttgaaattttcaccctttttgtgctggttttttctcatcttcttggatttatctacctttggtctttgatgttggtgacctttggatgtgtttttttttgtgtggacgtcctttttgtttatgctgatgctattcctttctgtttgttagttttccttctaacagtcagtcccctctgctgcaggtttgctggagtttgctggaagtccattgcagaccctgtttgcctgggtatcaccagtggagactgcagaacagcaaagattgctacatgtcccttcctctggaagcttcatcccagaggggcacctgccagatgctagccagagctatcctgtatgaggtgtctgtcgtcccctgctgggaggtgtcttccagtcaggaggatgggggtcagggacccacttgaggaggcagtctgtcccttagcagagctcgagcactgtgctgggagatccgctgctctcttcagagctggcaggcagaaacattaaagtctgctgaagctatgcccacagccgccccttcccccaggtgctctgtcccaggaggatgggagttttatctataagcccctgactggggcttctatctttcattcagagatgccctgcccagaaaggaatctagagaggcggtctggctacagaggctttgctgggctgcggtgagctccgtggagtctgaacttcctggtggctttgtttacactgtgaggggaaaactgcctactcaagcctcagtaatgacagaggcccctcccccaaccaagctggagtgacccaggttgacttcagactgccatgctggcagtgagaatttcaagctagtggatcttagcttgctgggccccatgggggtgggatctgctgagcaggaccacttggctccctggcttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcatggcttcccttggctaggagagcgagttccccagccccttgcacttcctgggtgaggtgactccccaccctgcttttgcttgccctctgtaggctgcacccactgtctaactagtcccagtgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatttaaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattcaacagaactgttttagggtgaagatcctgagacccataaggaatttcctactgagcaaattgtgagagaggtgtgcagggtttttatggttgtagctatcttatttaggaataaaatgagaagctggtttgcctgacacagttcccagcttgactttttcctttggcttagtgatttaaagttcacaagatttattttcctttcacaaaagcatacatactttttaaggtggcttatgtattatcattggagacagttcacacatttactcatccttttgttttgtttttaactaaatatcatgtagaagacaattctagggaattcaggtgtattctggttgctattattaacatttcttttgttcgaatggcagttggccatctttatcttagagaaaatctacagcagatgaagagacaagaaaaatctgtataattgattttatgtctttactttttgtaattcctttttctaggtttcagaaaagtcattgttagaataaattgacctaagttaattcagcaagtattagaagggtcttttatgtgctaggtactgaaggatacatagaaaccacacagagtaatttactatagaacttgaattcttaaaagaagacttgttttctctatgttaataaaaaacactttttctttctgattcaagtcagatgatcctgatggctctcaaattgagaaaataaaagaagaaataactcagctgcgcaataatgtctttcaggaaatttatcatgagagagaggaatatgtaagtatttggttctttgaagttttacattaggttttactctagaaattgaatttaaatacccgttttatgaagtggactgtaatcacaaggctagaggtattatatagaaagtttatatatatattgacctggtaagatttttgtaaatttagaaataaatttcacatgacaaaatattctgaccattgtaccagtgtggaaataactgaaaattgtaaagaaggaaaaacatcacttgtaatatttccactcagtgataatagtagtaatcactgttaacttttgactttcttttagtatttttttgtttgtttttagaattgagattatagcacagacacacttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacagcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgctagccctgagggatttgagcacaatgggttttttaagttaaagcagtctgggaaaaaattctagagaggttggttaaggtagagatgttgaggtgggtatggttttctaggtaggcaggattcaaaagctggagatcagcatattaaataggggccatagggagcaggattagtaaacactggtttactaatctgttagtcctgaatctgttagtcctgcgatttatattgccttctacagtgagggcctagatgaggtatttattcattaagattgtcacgaagtccattataatggcttaaatatggtacagagagggatatttgtgtagacatgtgagtttattctaaaaaatatttaagattaaagttccctaacttaaataattactctaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaaaacccagaaaacaattctacaatgcctcttactgaaactgcaccacagtaaaacttagctttgtttaaaatgttgatgatcatattttagtgtgaaaaattattccttttaaaaagtagcagaaatatctagtaaaattagttattgaaagccattttcacttttgaggactccaaacaggggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcctagaactctggtggtctccttacaatgagcttggaacgagatcttcttgatgctgagcccatgaaggaacttagcagcaagcgtcctttggtacgttctgaggttaatgggcagataattctgttaaaggtaagtctaacttcttcttacttgtgggagattcagcagcataaaggatagtggtgctgttacatttcaagaaagaaaaaacctcactgttagttttctaaagtgtataagttgactggcatgataattgtgcttgtagtttggttgccagaactaattttcacttttaaagtttccctcaattgaacaatgagaacacttggacacagggcggggaacatcacccgtgggggcctgtcatggggtggggggcagggggagggatagcattaggagaaatacctaatgtaaatgatgagttaatgggtgcagcaaaccaacatggcacatgtatacatatgtaacaaacctgcacgttgtgcacatgtaccctagaacttaaagtataataataaaaataagtatataaaagtcattaaataaagctttgtctcacaagaaaaaaaaataaagtttccctcatttccctaaatagaatatgtccttaataggatatactttcctttttttttgggtgaacttattatagtcatccaatatctttttaaaattcttgattttcttacatttctccttgaaatctcagctgtgttatcagtacaatcttctactctttaatttcttcttctcattgatctgggaaactgttaatcatgataataagataattaatttggccttagttgctacacattctagaatgtgtagcaggctacaggtagaattgcactttccttttccaaattatagcattcaaagaagatagaaaagtacttataaaattaaaaaataaaattagatttgatttaacttaaaataatgaattatgtttaaattggaatgatgtataattataatgagattttcatcttggaattacgagtgcctctttctttggtacaagggctattctgtggatgttgacacagaagccaaggtgattgagagagcagccacctaccatagagcttggagagaagctgaaggagactcagggttactgccattgatattcctgtttttatgtaaggtaaagttcttatgctaatctcttgcagaaaccattttatcttgcagaaactattttatttaaaataaattttagctccaggttttagagcagcagttcattccccttaacataaaagaaaaattatcccatagaatcaatgtatgctaaaaatatgttgaagaagtttttacttggagtcacattctctgttttgcttcttagtctgatcctatggcttatctgatggtcccatactaccctagggcaaacctgaatgctgttcaagccaacatgcctttaaattcagaagtaagtaaaaagcactatttatttccatggatgtattaaatgagaaaataacacctgatatttattcaggcatactacatgctatgtattttgtaaaattttgactcatggtattctatttgtcacctcaagcctgtgatagaagttatcgtgttatatagatgagaaaaagcgttaaagggattagattaagtgacttgcacagggtccgttagccagaggtagagctgggactcgaaattaagtctttctggttccaaagcccaaacttacaactgctaagctgtgctgtatgtgaactgcctaatatagcacttggtactgtaagtgcttaagtggcagctttaatttttgtcattgtaagtttaggattagtaataacagtaaaggaggccctgattcttcttatggagtaacactgtttcagtctcttatagctactttacatggttggtatttgtaatccaagtcttctttgagatgatagaacaggtgtcctcagaccccaggtcgcagactggtaccagtctgtggcctgttaagaacagggcggcacagcaggaggtgagtggcaggtgagcaagcattactgcctgagctccacttcctgtaagatcagtagaggcattagattctcataggagcataaactctattgtgaactgtgcatgtgagggatctaggttgcgcactccttgtaagaatctaatgcctgtgatctgaggtggaacagtttgatcctgaaaccaaccccctgcatccatggaaaaattgtctttcatgaaaccggtccctggtgcccaaaaggtatgattgtacacacacacacacacacacacacacacacacacacacacaaacacacacaggcacacatggtatcaccattacaaaatcaagccttcatctggtctttctctatgctgtattcttattaatggttcatttcgaggaaactttactcacttctagagcagtcttttaattagagaacagtttcaagattaaaatgatttgcctacttcctcacttcttttatgtgtacttatctataggaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtggtaagatatcatggttttacaaataggttctagactttatttaatattattaagcagtagttcagcacttatatataatataatactttattataggatctttgtcttcagttaaactgtgtcatgtagtataagcaactatttgccctcagctagatgctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctccgtctatagatacaatttacatatacgtactttgctgttttttgattaataatgtgcatttttagaaaccggggaaccttggactttttagtttaaatcctgattcacctctaatggctgttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgataaccagtattgaattccagaacattattaacattcccaaaaagaaaatccatactgattagcagtcactcaaatttcccacttcttctcaagcctggaaactacgaatacactttctgtctctatggatttgcctatttggacatctcatgtaaatggaatgatacaatatgtggccttttatgctaatttcacttagcatagtgttttcagagttcatccacgttattgactgtatcaaaatgtcattcctttttattgccaaattatatttcattgtatggatgcaccacattttgtttatatattcatcagttgctggacatttggttgtttatacttattggttatatgaataatgctgctatgagctttagcatacaatattttttgtgtggacatgttttcatttctcttgggagtggaattactgggttacattgttttactttttgaggagccaaactgttttccaaagtggctacatcattttatattcttcccagtaatgtatagggattttgttttctctacatccttgccaatattttttattatctgagcaattccctttgactagtatatgttataatgcttttatactttggtcatctgcaagtcatagtgtaatgctactggagtatatatagtcttaatggttttgatatggtagctcaaaaagatgagaaaatgaaactgcaactgtaatcaaaagctggattgtacaggatttatacagattgattttctgaaatatttactttattacattagtttaacaaaattaagatatcctaagaaatataactaaattatgaattttgaaagatctcaaccttcaggggttctggttagtttaccttttgagcatactatttgcataattatagatatgactacaataattactctttagtcattcgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatcgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagtttgatgtcacctgagttgaaaatgggaaaacctgcttctccaggttcagacttatatgcttatggctgcctcttattatgggtatgttatttttttgttgaaatagatcatatatatatatatttcagtatataaagtgatgattttatagtgattctccttaaaaataaaaagcagcagacttttagtagaactttaagttttaacaaaaactattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaagcttgtttcatgttgtactgctattttacgtagagaatgcctctttttccaaagtcttgagtgtgacaaaaccttatctttgttgatcacataaataaaaataatctccttgttagaaaaacaagagttaagagggattaagtattaagagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtatgcatgtgcatgaaatagtattccttcagtttgctattaaacatttaaaaatgtgaaaactacccttggcttgcagctgtacaaaaacaagtagtggaatcagtttggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagcgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggaggctgatgcaggaggattgcttaatgccaggagttgaagactagcctaggcaacacaagtgagcaccccctgtctctacaaaaaatagaaattagctgggtgtaatggcgtgtctgtggttctagctccttggtaggctgagacagaaagattgttggagtccaggagtttaaggctacagtaagctatgactgctccactgcactccagcctaggctacagagcaggaccctgtttctaaaaacacaagtgatactgctgtgaagttagatgtccagatgaatggagcagaatagagacaatataaatagactgcacatgtatgataactggcttttgacaaagatgccaaggcagttctctgggtaaaaggagaatcttcaacaaaaatgatacaggccaactcataccatatgtagagaataaattttgattcatttcttataccatgcacaaaaattagctcaaaatgtgtatcagacctaaatgtaaaacgtgagtctaaaacttatagaagaaaacataggatgaaatatttgactttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcatgtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttgtatgtaaatattgaaagaatttatgtgtaatagatgaaaactagaaacaactcaaagtccatcaacagatgaatggaaaaacagtctgctatgtatgtgtctatccattggaatactactcaggaataaaacgattgaactataaatataactcagtaagataggtgagtcttaaaataattctgccaagagaaagaagccagatgataaggtttggctgtgtctccacccaaatctcacattgaattgtaatccccatgtttcaagggtggggtcaggtggagataattgaatcatgggggtagtttcccccatgcagttcttgtggaagtaagtctcacaagatctgatgatttcataaggggcattttcccttttgcttggcacttcttgctgcccccatgtgaagaagaatgtgtttacttccccttctgccatgattgtaagtttcctgaggaatccccagtcatgctgaactgtgagtcaattaaacctctttcctttataaattacccagtcttggggatgtcttttattagtggtgtgagaagggaccagtacagtaaattggtacagagagtggaatgctgctgtaaagatacccgaaaatgtggaagcagctttggaactgcgtcatgggcagaggttggagggctcagaagaggacaggaagatgtgggaaagtttggaacttcctagagacttgttgaatggctttgagcaaaatgctgatagtgatatggccagtgaagtccaggttgaggtggtctcacctggagatgagggacttgttggaactagaataaacgcgactcttgatgttttagcaaagagattggtggcattttgcccctgtcctagagattggtgaaactttgagcttgagagagatgatttagagcatctggtggaagaaatttctaagcagcaaagtgttcaagaggtgacttgggtgcttttaaaagcattgttttgtgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaagcttcgcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggcagaagttttctgcaggggtggagcccttatgaagatactctgctaagacagtgcaaaacggaaatgaggggttggggctcccacacagagccccaactggtgtactgcctagtagagctgtgagaagagggccacagtcctccagaccccagaatggtagatccactgacagatcacactgtgtgcctggagaggcaacagacactcaatgccagcccatgaaagcagccagaagcggggctgtagcctgcaaagccactggggcagagctgcccaaggctgtgggagcccactcttgcatcagtgtgacctggatgtgagacatggagtcaaaggagatcattttggagctttaagatttgactgccctgctggattttgaatttgcatgaggcctgtagcccctttgttttggccaatttctcccatttggaacaggtgtatttacccaatgcctgtaccccattgtatcaaggaagtaactaacttgctgttgattttacaggctcataggcagaaggaacttgccttatttcagatgagactttggactgtggacttttgacttaatgcttaaatgagttaaaactttgggggactgttgagaaggcatgattgtttttgaaatgtgaagacatgagatttggaaggggcctggggtggaatgataatggtttagctgtgtccccacccaaatctcaccttgaattttaataattcctgtgtgtcaagggcaggcccaggtggagatatttgaattacggggtggttcccccatactgttctcatgactttagccctatgcctgcatgtatatttaaagttgtctggtttcattgaaccagcaccctcatggaaataaactagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattcccagactatgccttatattcccatttactcctgttcttctgtttagtctttttggaaaaaactcaattttagataagctatggcctgccatttgtgagtaaaacattctttctcatttctctctctctcttttttttttttgagacggagtcttgctctgtcgcccaggctagggtgcagtggtgtgatctcggctcactgcaacctctgcctcctaggttcaagcgattctcctgtctcagcctcctgagtagctgggattacaggcgcacgctgccatgcctggctaattttttgtgttttagtagagatggggtttcaccatcttgctcaggctggtctcgaactcctgagcacaggcagtccacctgcctcggcctcccaaagtgttaggattacaggcgtgagccaccacgcccagccccatttctcctttttaaaaagttttatttctatgcgtcaataacttttttaaaggcattacattttatttctttaacagagtgtgaccaaacatatttgtttttattttttatttttttattttttggagatggagttttgctctgtcacctgggctggagtgcagtggcactatacagctcattgcagcctcaatctgttgggctcaagtgatcctcctgccttagccccctgagtagctgggactacaggttgtatcaccactcttgactcatttttgaattttttttgtaaagatggggtttcaccatgttgcccagcttggtctcaaactcctgggctcaagcaatttgtccacctttgtctgccaacatggtgggactacaggcatgagccactgtgcccagcccatatttgttaatttaaggacattattatgtctctttataacatggtggtaacatcctcccttggtgagagcacatagaacatgtttggaactaactgctttagaaagttttatctcattacaccctcctaacaagcatgtgagggagtatgttattatccaaagtatagatatgagaattttgtgtgtcagagaggaagtacctgagtgatgccccatttcagaattttagtgtctcgaggctccatgcaagaccaccttctgccttcacatcacatattattaagcctggaaggcagtcttcactgaagccaatgatgaacaactgatgaagggaacccagggctgggaaataagttaccagtaaatgtcatggcattgaccactatgaagtcccttgtatcatattattccccttttaggcatctttaggcttgtctcctatgtgctgtttttttaagaagttctctgcttacaaagtcttgcgtggatgtatttaatacttttgtttggaatacaggtacacttttcacacgtgatacctggttttcatgtgtaatccaaaaataagagacaatgggaaagttatgttccatatgctgtcctttcttgaggaccagctcacgtgacttgtgataagctctcccaccttctctgaaccttagcagtgcctctcaggaatatgctaactaagataaatggagagaaaggaacatgggtagcagccccttaaaatctagaggttttatgattctaacatcataatgaagcagactggggaatagaactcattattgtagaattgaatgtaggaggattaagagatacaggttgggccgggcgcggtggctcacgccagtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccattctttcaaggtaagtctactggtgacaaatttttagtgtcctttatctgagagcatcttgatgtcacctttatttctgaagaatattttcactgggaatagaattctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatgcattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgctttctattttaaaaatttaagtgtgtttgtaattgctctatgcagcatttttatgatggccgttttaaaatccttctcagataatcacaacatctgttctatttggtgtccggtggttgtctttttctcagtcaagttgagattattctggttcttgatataaagtgattttttattgtaccctaaacatttgggttattatgttgtgagactatgaatcctttttaatatatatatatatatatattttttgtaggcagccaccctgtttaggtatagtatgcagttccagatggggttagatatgtagttccccactgggctctgctgacatcaccccagcaaaagtggaatgcccagttgtactgccttacttctccttgctgctgacagatgggagtgtaaattcagcactttattgagttcttttgacaccgggagaccaggaggagcaaagtgttagctataactgtttcaccaccaccttattccaccttcttgtgccttgttgctacctggtgagagtggaagttttactccccagtgggtcctgccaacaccgtggggagtgggcaatgaaaaactgaatgctgactcgtactacttcacactgctttgtttcactttttttggctgctgggtgggagtggaagtaagccctgttctgagtcccactgacagtatcccagactgtagagtgacagctagtgctgtttctcactgctgtcttctgcctctgttgatgggtggaagtagaagttcagttccctgtttggcttcatggataccatgctagtggaggaagcaaagggatgacttcccatgacttgttgctgctgggtagggctgaaagtccagctcctcactcagcactactaatactacggatgggatagggggcagtttttcgtttggtgtgtgactggaatagggtatattacctattacagttttctgttctgctaggccaccctcttcccagtcctgtggctacaggaagcaggcttttcttggagcttttgtgtgtgtgtgtgtgtgtgtgtgtgtgcctgtgtctgttggcatttctgggtggcagacttctcaaggaccccatcagagatataggggggcaaaaagaaagcccagggaactcaccattatattgttcctcaagtggcaaggtcctagctacttcaccttcttctttccatcttttagggttttcctgtgttgtattatagctagagttgtttgttttttttaagaggaaaggttgatgtgaaatgtgactactccttggctggaaccccttgcatgctcttgtaccttgggagctgaatgctgttgcactgcattactttaattgagcccttggtgctttcttttggttctttgacctcctcacagccacctcattctcacattcctctcaacaattattttaaaccttttcatcaattctccacttaaatcctatcctcattcttctcagatgatcttacttcttattttactgaaaaacttgagatcatgttatgtgcttttcatcaaatttgagcacttacaaattacagtcatccctcagtatacacagggaattggtttcgggacccccacatatgccaaaatctgcgcaaagtcccactgtgagtattgtggaacctgctaatacgaaaagtggaccttttatatatgcaggctttatgtcttattaatagtgtatttttccatccatgtttggttgaaaaaaatctgcatgttagtgggccaacacagttcaaatctacattgttcaagggactacattatctgtttacccagtcttctatctttgcctcctatttcagagaattaaagtgctccttccccagtgcaagtaattcagtaccgtaacatacaatatggggttgtaaccttggagcggtaggctacatgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttttgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaatttggagtaagtttcttgtaaataacatatagttgcattgttttttatttactcttgctgatctctgtcttttaattggggtttttaggccatttacatttagggtaattattgatattttagggcttaaatctaccattgtattactggttttgtttgtttcttgtttctttttctttttttcccttcctgtgcattacttgaaaaaattttctaccattgtattactggttttgtttgtttcttgtttctttttctttttttcccttcctgtgcattacttgaaaaaattttaagagtccatctttttatatatatatatatataatatatataatagatataaaatatataaattatatatataaaaatatataatatatataaaatagatattatatataaaatagatatatataaaatagatatatataaaatagatatatataaaatagatatatataatatataatatataaatatatattatatataaatatataaatatgtatatatatttgtatataaatatgtataaatatatatttgtatataaatatgtataaatatatattatatataaatatgtataatatatatttatatataaatatacataaaatatatgtatatatgtgtgtgtgtatatacacacacacacacacacacacctacatgatgtcttattttttttaaacaacacctgtactccagataaatatggtcaaaataaatgaaaaactcaagatgacattattcccatttgtctaaaggccgggtgttgtgtagatgataagcacctgccatttatgatgacaggtgatagatccaaagtaattgccagatttgttaatttttttccatttctaaatcatccataaagaaaatcacatatagggtcacatcatccttacagtagtttagcagagcaactgtgccatctagattgatgttttcaccagtaaaggactggtagtttttgaaattagcaagtatgtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgtttgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgaggttcctttattctccccacttttaaatatcattgtcttgagtatcagatggtggtgtaattttggtttggatcatcatatatgattagaaaactcatgatgagaaggatagtctgtggtattagtcatatttctgtttttttccattgttatttcttccttcctgatgctccaagactcctttaaaaaattattttctttttgtttgaagtacttcctttagccactctttaagattgtgtctagtgacaaattcctttcgttttcccttatttgagaacatcttgatttcactttcattactgatggatagttttactggacatagaatttgtggtggttgagagttattttcttttaaaagttgaaaaatgtgctacttccttcggtctccataatttcatatgataaacgtttatcatacaaggtagtatttcttataggtagtgttttatttctctgtggttgctttcaagattttttctttgtctttagttttcccaaacatcttttttcattcctttcctttttttttttttttttaagatttttttctatttggggtttgcacatcttctttaatcttcttcaaaatttgggaacttttcaaccattattttcttaaacttttttttattaaatttctctagatttagggagaacaagtgcagttttgttacacaggtatattgtttaatggtgaagtctgggcttttagtgtaattttgaacagtgtacattgtactcattaagtaatttctcataccccacccctttcccaccctcccaccttttcgaatcttcagtgacttttattcgacattctgtgtccatatgcacattttatttagctcctacttataagtgagaaaatgcagtattgggctttctgattttgagttgtttcacttaagataatggcttccgattccatccatgttgctgcaaaagatatgattttattcttttttattgctgaatattctgttgtatgcatgtgtgtgtacatatgtatgtatgtgtatatgtgtactcacacacatacatacacaccaccgtttctttactcactcatctgtagtcactattttaaaatactcctttagccccattatttttttccttttcttctgagactctgaaagttggatcttttgttattgtctcacaggtccttgaggctctctgttcttttttttttttttttttttgtctgttttctctctgatcaggctgagcagattgtattgatctgttctgaagttcactgattttgtcttctgtcatttctgtcatttcaatttatcccatccagttttaagatttcggttattgtactttgtagttctgtaactttcatgtgattctttttaataacttttttctttgctgaaatttctttttatttaccttagagaaattataattgtttgttgaagcattttatgaccattgcttgaaagttcttgtcagataattatgtgattcattgtggtgttgattgcagtttctcgttgaagttgtggttttcctggtactttgtatgacaagtgatttttaattttatcttggacattttggatactattttaatagattctgggtcctactgaaaattttattttagcaggcagtcaccttgtttaggtttaaacagaggtcctggactactttttgaactgtggttttaacgacaatctaattttcagaaacttttcagttatattttgatctgcttgagttgttgcgtgctgctgggcctccagtggtccctgctgatggtgtttgagggaatgaaaggaacttttcaaggctgaactgcctggtgcttctaagtatgggaatggagaccctggtctatgggatgaagcttcttgagctgggtgctagttgtggcaggatctctcctttcctatgaccgatgcagaatacctccagaaccatcccttgttatggtgggatccccctacttatgggtgtcagagtgtatttactggaccagctgcttgtggtgtggttttcctttgttggtgcctgtggcctcgttggtgtctcaggtggtgctgctgctgaggatggtgaatgcttcccctggctgcttattgacagggaggtttccagttgaaccttcttgctgtttcttctggcctcacatggtggtgttgatggcaatcctattaaattcaagagaagaatgaatctacctgggctgctttctgttgcaggcttaggagttgggaaacatcagatctggctcacttatttttttttttttttcagttgggagggttataagacaacctgttactatgttgttcctctagtcctggggtcttcaactagtttttcttccttttttaaacctttcagtgttttcctttggttatattttatggtattttcaggttttataattgtacttaatggagaggaacaggaagagaccaaaagcccttttgctcattttttaattgcaatgggtggaacttatttggatctggatttaaataaactaaaaaagtaaactaatttgatatgagattactcaaattttgaaagctaggtattttgtataaaagtatttttcctataatgatatgattgtgtaaaaataaaagactgtctcttagagatatgtactaagatatttataggtgaaattatgaaatacataggatttgcctcaaagataatatatatgcgtttgttcatagggtaagagtggtcattggctgatggttgttagggctaggggatgaatatgtgggactcagaatacctttgtgtatgtaaaaaattctccatgtttttaaattaaatttaattaatttattttttgcatccccctgatttctgaagtttttttttaagtttagcttatatttcttgaacaaagtttagatattatggtagaaagaaacttgcctgatttattttctttgtacctaatttttgagtattggtgaggctaacataatataggctaccaagttctaacacgttttcttataaggtgaggaaatattaaagtgtttatagtgtgtacatcccctctgatcggtactttaggagccccaggaaccatttggttgcttgtaattagaatgaaagtgcttttaccctgtaagagagttaatgtgctttctttaagtaagctcttttctagtcaccaggatctgaagttccagagttgactcttctatagattggcgtattaatacattggacatttattcattcttactttctttcacagctttctgttcaaaatcaggagtttgagataaataaagatggaatccccaaagtggatcagtttcatctggtatgtgacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtattaaaatatctcatgtacttcataagtatgcccataaagatttaaaaataatgaagcccctaaaaaaagtacttggggggaagctgatttttagttctgcaaagaaagggggaattcagtatgactagatataaagaggataaatatggcagtaaatgagtctataagagtataatgatcagactctggaagttcttagctattttgagttaagattacaatgaaagagtacatataattttgttaaactcagtagttccttatttgaccacacaaatattgtataataccttctaatgtcccacgaaatcattttaaaaaaacataccttagaaatgatattaaggagctttgccacacttcttgggtagcagtaaaaagcatttcagacaacttttgtgagattataaaactttgtgttacacttcctgattatctctgtggaaggggataacaaagaaggttgactatggtttacagttttgaaaaggctatgataaaaatttattgctattagatagaaaaataccagaaattctgtattagaggttacaacttcaccaaaagtgcacatccagaacccttgctttcaggtttgatagaaaaattaccttgtaccaagttatcctgaaatttagtttaaacttaaaacttatattacagtttcgtgagtcaggaatctggacacagcttatttgggatttctgcttcagttaatttaaggttgcagttaagatgttggctgggctacagtcatcttaaagctcgattggagatgaatatgcctctaacctcacatgtttgttcataggattctgtttctttcagtttattagaatgaggacctcagttgttctctagttgttggccagaggttgccctcaatcctttgccctgtttccatcatggcagcgtgtttcattgaaatgtatacgcagagaaggcagtagactctgttcactaagacagaagtcacagtttttcatagcaaaatcatataagtgatatcccatagtttttgatagtattctctctaaagcaattctctaggtccaagaggaaagaattatgtaaagttatgaataacagaaggttggggtcttggggcaatcttagaagtctgcttactctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctcaaaaaaaaaaaaataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaattataaaaatcttggcttgtatagtatttgcttctgtgatctgagtcagttattagtgctgggaatggaattacctttacctacattttgtgttcacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttttatttctctaagttcagtagtgtcccctttttcatttcagattctggcagtttcagtcttctctcttttttttcttcgttagtccaaataagtttaaatacctagcttttggttttattaatttttctgtattgtttttctgttgtctattttcttactttctaatctttattatttctatccttctgcttgctttagatttagtttacaacatatattacacagttatcacaccttataaaattaacaaattgtaatattatatttaaatttccctaattgtcttaaatatatttttaaatggttgcttttttgaaattagcatatcaacaagatctacctgtattgggttaatatatctcttaatctctgttgagctataaagttcccccacaactctttttctccatgccatgtattatgtgaaaaaaatgatttcattttccatactttggagttggctgattgcatccttatggtattatttcatagttctcttttccccagttgaaaaaagtggtagatacagaggttaattaaatttacattcagtttttacaggcagtatattttatattattgtgtcatatgagggggatcatttggtgtttgattgtcacagtaagattgatcagtgtgttcaggcagaaaattttgtatgtacaggggtatatttttagtttttctatcccattggtttgtttattcatatcccagtgcctcactcatttaactaaaatagactttatagtagctttttaatacttatagggctagttccttcttcactgcttttttgttttgttaaaaaaaaaaacaacaaaaagcaacaaaaaaataaagtccgaagtcccaggttggagtgcagtggcacgatctcagctcactgcagcctctgcctcccaggttcaagtgattctcgtgcctcagcctcccgagtagctggtactacagtcacatgccaccacacctggctaatttttgtatttttagtagagatggggttttgccattttggccaggttggtcttgaactcttgacctcaagtgatccacctgcctcagcctcccaaagttctgggattacaggtgtgagccactgctggccctcattgctatttttaaaatcagctttcatggctattcttggttgtcattcttctaagacatctttataattaacttgtttggtctcaaggaaaaaaattatatttttattggattaatataaactttttaagtcaacttagggaaaattgtcccatttgttatgagagtcatttttgttgaagaccataataagacttttgttcctgatctacttttgtggttttcaggagcatgtgttattttttctcatttggattttgtaatatttaattgtttgcacctagggaaggtaactatctttaaatgttcttaaaaacatattctgtagagtacagacattggcattcattcatttatcaaatatttactgaatgtctgctatattcagatactgttttttgctactttctggagatgaagtgacaaactaaaatttcaaatcttaaggatcttagagtgtaatgcagacactagcagtaaacagatgatttctttcctttttttttttttttgagacagtcttgcttggttgccaaggctgaagtgcaggggcacgatctcagccactgcaacctctgcctcccaggttcaagcgattctcctgcctcagcagcttgagtagctgggattactggcatgcgccaccatgcccagctaatttttgtatttttggttgagacagagttttgccatgttggccaggctgatcttaaactcctggcctcaatgatccacttgccttggcctcccaaagtgcctgcctgaccagcagttaaacagattatttttattcagtctgatatgtgctttggttggagtaatcataagaggcaaataaaaggtatactaaggtgtcaaataatggaatagcaacattacaggatcatttacatgttctaatacaaataatgtcctttgaaatggagggatataataaattctagctcccataatgatggtgataatgatagcagcagtagaggtgatcctagagagtgatcacttaaaaaccaaaaccagaaatagttgactagatgaagaaatttacccttccagacagagaagcttcagtgtgacattttaatagtgtcaaattctgaccagtaccttgttaaaagagggagaaggaagtaataaaatttatttgttcgtatttcacttgtttttgagagatttcagctatgatttttttccttttacactttttccccataattcaattccattgtttcagtattggaggcattccatttcaccaaaaagtacagtcgtccctctgtatacacaggggattggtacagataaaatctacgcatacccaagtcctacagttggcccagtggaacctatgcatatgaaaaatcagccctttgtatctgtgggtgttgagtcctgagaatactgtgtttttgatctgtttggttgcagatgtggaaactgcagatagggagtgctgactgtacttacttatttcatattgatacataatatttgtacatatttatggggtatatgtgatattttgtaacttgtatggaatgtgttaatgacagtcggtatttagggtatccattatcttatttattatttctatgttttgggaacatatcaagtcctctcttctggctattttgaaatatttaatacattgttaactggagtcatcctactctgctatcaatcactagtacttatttcttctgtcaacctggttgtttgtacccattaaacaactctcttcacccccttccacctcacccacattctcttagtctctggtatctgtcattcaactctacctctatgagatcaactgttatagctccgacatatgagtgagaacatttgatatttgtctttctgtgcctggcttatttcactttacagaatgactgttccatccttgttgctgaaaatgacagaatttaattccttttttatggttgaacagtattccacattttctttatatttctttaatagtgttccacattgtctttttccatttgtccattgatggacgcttaggttggagtccttacctttgtaattgtgaatagtgctgcagtaaacatgggggtgcaggtttcatatactgatttcctttttattttgatgaatatcaaatattttgacacttaggttgagtccttacctttgtaattgtgaatagtgctgcaataaacatggggatgcaggtttcatatactgatttcctttttattttgataactatcaagtagtgggattactggattgtatgatagttccatttttagttttttggaaaatatttgtactattttccatagtggctatactaatttacatttccactaacaatgtataacagtttcctgttctccacatctttgtggagatttttcaaaatagtatttggctattttttgtcattttttaaaatagtggcattctagctgatgtaaaatgatacttcattgtggttttgatttgcatttctctgatgattagtgatgttgagcatttttcatatacttattggtcatttgtatgccttcttttgagaaatgtctatttatgtcctttgcccactttttaatggaattgttttccctgtcgagtttcttgtatattctggatattagtcctgtgttggatgaatagtttgcaaatttttccttcaattcaacaaattgtctcttacactctgttgattatttcctttgctgtgcagaagcattttagttaagtatagtcccatttgtctctttttgtttttgttgcctgtgcttttgaggtcttagccataaaaatctttgcctaggccaatgtcatgaagtgtttcccttatgttttcttctagtatttttatagtcttgggttttacatttaagtctttaatcaatcttgaattgatttttatatatggtgagaggtgagggtctactcttactcttttgcgtatggctatccagttttcccagcaccatttattgaagtgggtgtcttttccccagtatatgttcttggtgcctttgtgggaaattggttggctgtttatttctggggtttcaattctattctataggtgcatatatctatttctatactaataaaacgctgtgttggttactatagccttgtaagatattttgaagtcagtgtgatgcctccacctttgttctttttgctgataactgttttgactatttgtgctcttttttagttctacatgaaatttaggatttttttctatttatgtgaaaaattacattgctattttgatagggattgctttgaatctgtagatttctttgggtagtatgggcattttaacaatactaatcttctgatccaggagcatggagtgtctttccatttgttagtgtccttttcagtttctttcatcagtgttttgtagctttctttgtagatatcttccacctctctgtttaaatttcttcctaggtaatatatttattttgtagctgttgtaaatgggattactttcttgatgtctttcttagctagttcattattggtttatagaaatgctactgatttttacatgttgattctatatcctgcgatttactatattaatcagatctaaaagctttttggtggagtctttaggtttttctagatagaagattatgtcatctgcaaagagggacagtttgactttttctttttctttttttattattattatactttaagttttaggatacatgtgcacaacgtgcaggtttgttacatatgtacacatgtgccatgttggtgtgctgcacccattaactcgtcatttagcattaggtgtatctcctaatgctgtccctcccaccaccccacaacagtccccggtatgtgatgttccccttcctgtgtccatgtgttctcattgttcagttcccacctgtgagtgagaatatgtggtgttcggttttttgtccttgcgatagtttgctgagaatgatggtttccagcttcatccatgtccctacaaaggacatgaactcatccttttttatggctgcatagtattccatggtgtatatgtgccacattttcttaatccagcctatcattgttggacatttgggttggtttcaagtctttgctattgtgaatagtgccgcaataaacgtatgtgtgcatgtgtctttatagcagcatgatttataatcatttgggtatatacccagtaatgggatggctgggtcaaatggtatttctagttctagatccctgaggaattgccacaccgacttccacaatggttgaactagtttacagtcccaccaacagtgtaaaagtgttcctgtttctccacatcatctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcatccactttttgatggggttgtttgtttttttcttgtaaatttgtttgagttcattgtagattctggatattagccctttgtcagatgagtaggttgcaaaaattttctcccattttgtaggttgcttgttcactctgatggtggtttcttttgctgtgcagaagctctttagtttaattagatcccatttgtcaattttgacttttgttgccattgcttttggtgttttagacatgaagtccttgtccatgcctatgtcctgaatggtattgcctagttattcttctagggtttttatagttttaggtctaacatgtaagtctttaatccatcttgaattaatttttgtataaggtgtaaggaagggatccagtttcagctttctatatacggctagccagtggtcccagcaccatttattaaatagggaatcctttccccattgcttgtttttgtcaggtttgtcaaagatcaggtagttgtaggtgtgtggtattatttctgaggcctctgttctgttccattggtctatgtctctgttttggtaccagtatcatgctattttggttactgtagccttgtagtatagtttgaagtcaggtagcgtgatgcctccagctttgttcttttggcttaggattgacttggcaatgcgggctctttgttggttccatatgaactttaaagtagttttttccaattctgtgaagaaagtcattggtagctcgatggggatggcattgaatctataaattaccttgggcagtatggccattttctcgatattgattcttcctacccatgagcatggaatgttcttccatttctttgtatcctcttttacttcattgagcagtggtttgtagttctccttggagaggtccttcacatcccttgtaagttggattcttaggtattttattctctttgaagcaattgtgaatgggagttcactgatgatttgactctctgtttgtttgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaattggacttcctcttttcctaattgaatgccctttcttccttctcctgcctgattgccctggccagaacttccaacactatgttgaataggagtggtgagagagggcatccctgtcttgtgccagttttcaaagggaatgcttccagtttttgtacattcagtatgatattggctgtgggtttgtcatagatacctcttattattttaagatacatcccatcaatacctaatttattgagagtctttagcatgaagcgttgttgaattttgtcaaaggccttttctgcatctattgagataatcatgtggtttttgtctttggttctgtttatatgctggattacgtttattgattttcatatgttgaaccagccttgcatcccagggatgaagcccacttgatcatggtgggtaagctttttgatgtgttgctggattcggtttgccagtattttattgaggatttttgcatcaatgttcatcaagaatattggtctaaaattgtcttttttggttgtgtctctgcccggctttggtatcaggatgatgctggcctcataaaatgagttagggaggattccctctttttctattgattggaatagtttcagaaggaatggtaccagctcctccttttacctctggtagaatttagctgtgaatccatctggtcctggactttttttggttggtaagctgttaattattgcctcaatttcagagcctgttattggtctattcagagattcaacttcttcctggcttagtcttgggagtgtgtatgtgtcgaggaattcaaccatttcttctagattttctagtttatttgcgtagaggtgtttatagtattctctgatggtagtttgtatttctgtgggatcactggtgatatcccctttgtcattttttattgcatctatttgattcttctctcttttcttctttattagtcttgctagcagtttatcaattttgttgatcttttcaaaaaaccagctcctggattcattgattttttgaagggttttttgtgtctatatgtacttcagttctgctctaatcttagttatttcttgccttctgctagcttttgaaggtgtttgctcttgctcctctagttcttttaattgtgatgttagggtgtcaattttagatctttcctgctttctcttatgggcatttagtgctatacatttccctctacacactgctttgaatgtgtcccagagattctggtatgttgtgtctttgttctcgttggtttcaaagaacatctttatttctgccttcatttcgttatgtgctcagtagtcattcaggagcaggttgttcagtttccatgtagttgagtggttttgagtgagtttcttaatcctgagttctagttcattgcactgtggtctgagagacagtttgttataatttatgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcagagctgagttcaattcctggatatccttgttaactttctgtcttgttggtctgcctaatgttgacagtggggtgttaaagtctcccattattattgtgtgggagcctaagtctctttgtaggtcactcaggacttgctttatgaatctgggtcctcctgtattgggtgcatatatatttaggatagttagttcttcttgttgaattgatccctttaacattatgtaatggccttctttgtctcttttgatctttgttggtttaaagtctgttttatctgagactaggattgcaacccctgcctttttttgttttccatttgcttggcagatcttcctccatccctttattttgagcctatgtgtgtctctgcacgtgagatgggtttcctgaatacagcacactgatgggtcttgactctttatccagtttgccagtctgtgccttttaattgaagcatttagcccatttacatttaagattaatattgttatgtgtgaatttgatcctgtcattatgatgttagctggttattttgcttgttagttgatgcagtttcttcctagccttgatggtctttacaatttggcatgtttttgcagtggctggtacctgttgttccatgtttagtgcttccttcacgagctcttttagggcaggtctggtggtgacaaaatctctcagcatttgcttgtctgtaaagtattttatttctccttcatttatgaagcttagtttggctggatatgaaattctgggttgaaaattcttttctttaagaatgttgaatattggcccccactctcttctggcttgtagagtttctgctgagagattcactgttagtctgatgggcttccctttgtgggttacccgacctttctaaactctggctgccgttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatgctgaagagtgttttccaacttggttccattctcttcgtcactttgaggtacaccaattagacgtagatttggtcttttcacgtagtcccatatttcttggaggctttgttcatttctttttattcttttttctctaaacttctcttcacacttcatttcattcatttcatcttccgtcactgataccctttcttccagttgatcgcgtcggttactgagtcttgtgcattcgtcatgtatttctcgtgccatggttttcagctccatgaggtcctttaaggacttctctgcattggttattctagttatccatttgtcttatttttttcaaagtttttaacttctttgccattggttcgaacttcctcctttagcttggagtagtttgatcttctgaagccttcctctctcaactcgtcaaagtcattctctgtccagctttgttcagttgctggtgaggagctgcgttcctttgtcggaggagaggctctgatttttagagtttccggtttttctgctctgttttttccccatctttgtggttttatctacctttggtctttgatgatggtgacgtacagatgggtttttggtgtggatgtcctttctgtttgttagttttccttctaacagtcaggaccctctgctgcaggtctgttgtagtttactggaggtccactccagaccctgtttgtctaggtatcagcagtggtggctgcagaacagtggatactggtgaaccacaaatgctgctgcctgatcgttcctctgggagttttgtctcagaggagtacccggctgtgtgaggtgtcagtccacccgtactggggggtgcctcccagttaggctactcgggagtcagggacccacttgaggaggcagtctgcctgttctcagatctccagctgtgtgctgggagaaccactactctcttcaaagctgtcagacagggacacttaagtctgcagaggttattgctgtcttttgtttgtctgtgccctgcccccagaggtggagcctacagaggcagggaggcctctttgagctgtggtgggctccacccagtttgagcttcccagccactttgtttacctactcaagcctgagcaatggcaggcacccctcccccagcctcgctgccgccttgcagtttgatctgagattgctgtgctagcaatgagcgaggctccttgggcgtaggaccttccgagccatgtgccggatataatctcctggtgtgccgtttgttaagcccattggaaaagcgcagtattagggtgggagtgacccgattttccaggtgccatctgtcgcccctttctttgactaggaaagggaattccctgaccccttgcgcttcccgggtgaggcgatgcctcgccctgcttcagctcacgcatggtgcgctgcacccactgtcctgcacccactgtccggcactccccagtgagatgaacccgttacctcagttggaaatgcagaaatcacccgtcttctgcgtcgctcacgctgggagctgtagactggagctgttcctattcggccatcttggctccaccccctgacttgttctttttcaatttggattccttttatttttcttgcctgattgttctgactaggacttccaggactgtgttgaagagaagtggtgaaagtggagatccttgtcttgttccagttctttagaggaatgtttttctttttctttctttttttttgtttttctttttttttgagatggagtttcgttcgtgttgcccagctggagtgcagtggcgtgatctcagcgcgctgcaacctccacctcctgggttcaagcagttctcttgcctcagccttgccaagtagctgggattacaggcgcccgccatgatgcccagcaaattttttttttttttgtattttttagtagagacgaggtttcactgtgttggtcaggctgatcttgaactcctgacctcacgtgatgtgcccacctcggcctcccaaagtgatgggattacaggcgtgagccactgtgtctcactagaggattgcttttcttttccccatttagtaatgatgttagctgtggctttgttacagataggctttattttgttgaggtgtgttacttatatacctagtttgttgagagcttttatcataaagggatgttttaatctatgaaatactttttctgtgtctattgagatcgtttgccatatggtttttgctctttgttcagttgatgtgatggatcatgtcgctgatttgggtgtgttgaaccatcctagcatccctgggataaatgctaattaatcatggtgtattatgtttttgatgtgctgttggattcggattggtagtattttgttgaaaaattttgcatctgtgttcatcagggatactggtctatagttttttgttgttgttgtgtccttgtctggttttggtatcaaggtaatggtgggctgggccttgtagaacaagttagggagaattctcgcctcttgaacctttgcagtagtttgaggataattgatgttagttctttgaaagttcagtagaattcagcagtgaagctctgtggtcctggacttttctatgttgggagactttctcttactgaccaaatcccgttacttgttactggtctgttcatgttttctatttcttactgattcaaacctggtaggttgtatgtgtccaggaatttatatatttcctctaggttttccagttgttcatgtatagttattcataatagtctttatgttttgtatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaaattttttttgtggatcctttgtattttttttagtgtatttcacttagttctgctcccatcgttattcttcgttttctactaatatgtatcaggttgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttccattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatatatctgggtgctctgttgttggatccatgtatatgtttagaattgttacattctcttgctgaattgatccctttattattatataatgaccttctttgtcactttttgctctttttgacttaaagtctgtcttacctgatacaagtatagttacacctgcttgcttttggtttccttttgtatggaacatcttttcccatctttttgcagcatacaattgggtcatttaaaaaaaagaaaaactcctttcaaccagtctatatcttttaggtggaaagtttaactggtttacattcaaggctgtcattgatacatgcatgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacggcctcccaaagtgctgggattacaggcataagccactgtgcccagccagatgatctatttgcagtgtgattatcggctcattattttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgca

SEQ ID NO: 1251 - DNA, 122290 bp, Homo sapiens; identical to SEQ ID NO: 1250

SEQ ID NO: 1252 - DNA, 122131 bp, Homo sapiens
aaggactattttcgtcgctgcttgcgttttaagtctccaatcctgggacgaggcccatttcagggttttctgtcaccttctagccgcccgccaccccagaggggtgccagatgccccagtttttgagtgcatgcaggcaggcgaaagtggctcgaaaagacctccggcctgaatgatctccatgaagacgcggtcacgcagcctccacactctcttccccttctcgaaaattctgtgccatttaagtttcaaaatcccttataaaataagtgtcagagagctacgtgtacccgtttcttccaaattttcatcacgaagtggagatttggacgtactattttgtgatctctgtttgcagaaagtgggtacggcatcagtgccttcataatcagggcaagtcattttaaaataagatttaaaaactactctagaagtagcttcttggagtgtgtggagagatttccaaagtaattttaacttttactgaatttaagccttaatgctttccgtgggaatatatagtctccctaaaagttattacagcttttcagtcagttgaatttaaaaactgctttttgaccagtagaaaagaacccttgctttggagacattttcatgccacttacgaaaaatttttttaaaaaattaagttgtgacaaagtaatccatttttaaaattttatttttctgtgatgaggagttaatgttttccttttcataatgagagagcatttgaaactttagtatagtggtgttcctagacaacttttaaagctcttaaaaaattgcggtggcttaggcctgtaatcccggcactttgagaggccgaggtgggcaaatcacaaggtcaggagttcaagaccagcctggccaacatggtgaaaccccgtctctactaaaaatacaaaaattagctggacgtggtgtcacgcgccggtaatctcagctacttgggagggtgaggcaggagaattgcttgaacccggggggtggaggttgcagtgagctaagatctccagcctgagcgacagagcaagacttcgtttggggggaaaaaaaaaaaaacccataaaaaatctgtgttttaattttccttcaacacttatgaatggaaagtgcagtattttagtatattacagataaaattacatagtgtacatttattttggaatatttttgcatttgataaagtataatattatgtaattaaaattatttttgaagtaataggcaaaattttaggtatttttgcagtctttaatcccacggaatcttcaaaaatagtaaccaccgtgccttttacataaaatagactaccagtttaaagcatttgttctattacttgtaatgtttctctttgtttacattgtggaagtcctttttatgggaggatattttctaaaaaaagaatatgtacattgtttcaaagtattgatttatgtaagtgatcaaaatgtatatgagttcagtataagtttgtaaaagtttggctagagataattttaaggatagagattatatatgataaaattgcatctactacaaaatactcaaaagaattagttagtgaaggaaatattgagctcatttttaatatagagtttgaattttgataactgcatttaggacaaaacatttgtaagaattgaacatgatgtagtttagtcttcattcattattaatggtggattattgtaatctaatttaaggtattgttctagtttttcaggaattgttcaaatggatgaagatacacattacgataaaggtactgacactaaaaattattttggggtgtaagagctagatgatactgattaatttctaattttccttgtattgtgatttgattttagtggaagatgtggttggaagtcacatagaagatgcagtaacattttgggcccaggtaaatagcaaactggttgatatcccccctcacctcccccaatccagttcctccccaacaaaaacaaaaataaaacccaggaataaatacatttgtcattctcattgcctaatatttattgaattatttatcaccaggcattattaggagacaaatgttgacagctgtgatgttacttgactcattatgagtcaagtgttatgcccataatacaccaagtttgaaaaaagaaaattggcaagattgtgatttcagaattccactcaattctaggctgcttttgctggattctgagagcctgttgtatttgtgaagttatagccccatctaggggtcttttataagattgtttcttgaaggaggataagttaaaaatctcggtcgttttttctaatggcttaaatttgagatgtggtatttttctcattatagaattggaagcatgaatgaaacatttctgattttctgttgggagggtgtcagttaggtaaggttactcagttttaaatacaaagcaagcactgaagggctgtgttccacaatttaagaaggtaaattcctctgatgcacagaacgacctgctaatttttggttttgtaaactatacatgatacggaagggaaagaaattacgtttctctatactccctacagcatgggaactccttttggtggggggtgaggtgaactcgtaatgtgggaaataaggagaatatatgagaagaaagttctagaagaatatgattaacccagagttcttaaatatatagtcatgcatcacttaatgactgggatacatacagagaaatgcatcattaggcaactgcgtcgctgtatgaacatcatagaatgtacttagagaaacctggatgatatagcctaccacatacctaggccatgtggtgtacctgtacctcatgttactgtactgaatgctgcagacaattgtaacacaatattaagtctttatgtatctaaacatgaaggtacagtaaaaacatattataaaagattaaaaagtggtacacctgtatagggcactcaccatgaatggagcttgcaggattagaaattgctttgggtgagtcattgagtgagtagtgaggaatgtgaagtcctgggacattactgtacactactgtatactttataaataccatacacttaggctacactaaatttataaaaatatttttcttcaataaaccttagcttactgtaacttttaataaacttttgactcatttgtagtaacacagcttaaaacaaacattgtagagctgtgcaaaaatattctttacgtccttattctaaagctttcttctctttttaaacttttaatttttttttactttaaaaactttttggttaaaaacgaagacaagatcttcaatatcactgtctttcacttccgcttcttgtcctactagaaggtcttcagggtcagtaatgtgcatggagctgtcatcttctgtaataaaaatgcccttttggaataccttcagaaggacttgaggcggctgtacagttaacttttttaaataagtaggagtacactaaaataagaaaaattatagtaaaaaaaaatatatatatacacacacaccagtgacatagttattttcattaccaagtattatgtactgtacataattgtatgtgctgtgcttttgtgagactggggcacggtaggtttacaccagcatcaccacaaatatgtgagtaatgcattgttctatgatgttacaatggctaggactacactaggcaataggaatttttcagcttcattataatcttacgggactactgtagtgtgtgtggttcattctttgaccacaatgtcactatgtggggcatggctgcatgtaaaaaaaaattgtagaagggtgatgttatagaaaacttggggcaaattcgtgtgtctgcttatgcacatatatttggcaaatttgtttctgcttatgcatattctctaaaggttgctcacacgttctggttccatgcccattgtctctgtattagtgacaactgcatcactctcaacagtgtcccagggtggatgataaattatatttaagcttattatacagaaacatcatttatcagtgtaaaaagattttctagactagtgctgtctagtagaaatatatgagccatgtaagtaattttaaaacatttttggcagccacattgaagaaactaaaaatagcaggtgacattttaataagtacattttatttaactcaatatatccaaaatattgtttcaaaatataattagcataaaaatgtgaacaggatagtttatatttcctttttaatattgtctttgaaatccagtgtgtatattagacttacagcatatctccttagactagccatatttcaagtgggtattggctattgtattcactagtgcagctctagactttgatttcagtttactttatttgtgaatatgttgattgaatttggagcaaattcaagagtcagcagttttttttttgtaaaggatcagatgatgagtattttaccatttttaggccatacagtttgttttgcagctattcaattctgccaacatagtgcaaagcagccatagacataatgtgaatgagtgtgtgtagctgtgatgcagtaaactttatttactaaaacaggcggctgtaatttgccaacctctgagttaaaccatgaagttgaggctcttgtagaagaacgtttaaaacaggaaacatgcgcatgaaaagattaaacattaaaactactaatggtatataaatgaatgtagtggttatttcaataagcaaattggcaaatttggttggggttatggtgggatataggcatagagaagactagagatttggaaatacgcgtaggcagattaggatgaaaatctgctcacgtgtattctccatttttttttgccctgtgggcttctgccttataaaccacttataagcaaacacttcagattggatgagtggcagctgaaggaatctgacgtatttgactccacctgtttctttgaaagaacaagcttctggtcaggcatggtggctcatgcctgtaatcccaacactttgggagacctatgtgagaggatcgcctgagcccaggagtttgagaccagccttggcaacagtaagaccttgtcgctacaaaaaaaaaaaaaaaaattagccaggcatggtggtgcatgcttgtgttcccagctatgtgggaggctgagggtgggaagattgcctgggcccaggagattgagactgcagtgagctgagattgcaccaaacaaacaaacaaacaaagagctcctatttgttttagtctgtatagtgaaaaaatatagttatatggaatattttgattccaggggtttgttcacaaaggctgcttctcttgtttctcagggtcagtttaaattcagttcctgttctatgctgagactttgatattcatcatgatgttctttgaactgctctttcagagttttttttcagtcatcacggataatcatgttctttctagcattattgaatattttgttggtatatttctttagaacatatatatatatttaacattttattttgaagaaactttgacttacaggaatgttgcaaaattagtacagaggctagaatgtggctctgtatactcttcacccagcttcctttaatgctaatgtgttatataaccacagtacagtgatcaaagccagggaattaacattagtacaatgctattaactaaactacagcccttatttaaattttagcagttttttgtctttttgtgttccaggatccaatacagaatcccaaattgtatttagttgtgtatccttggtttcctttaacctctgaatgttcctcagtttttccttgtatttcaagacttttgacacttctgatgaatattagttattttgtagagtatcttttaatttgggtttgtttgatgatttcttatgaatagattagcaagagttccacagaagtgatattgtagtcctctcagtatatcatattggggtttcatgatgtgatataccttcttattgatgataaccttgattcacttgggtaaggtggcaacttccaggttttttcgctgtaaagttactcttttcttttgtaattaattaatgttttaggagacttattgtggctgtctaatccagtttctgttcaacttttcacccacgaattttattgtttattgctctagtgcttgcctaatgatgattttctattcccctcattccttccacatttattaattggaattcttctgtaaggaagagctgtctcttctctgccatttatttattcaattatttatattaatataaactcaaggatatttattccgtgggttataatcctatgctatcataatttattttgttgtttaaattattcagccttggccattgggacaaagttcaccaaagaatacagattggtacttgtccttaaacgtctcctattctttttttgagcacttttttttttttttttttcaagacagggtctccgtcaccaaggctagagtgcagtagtgtgctcatggctcattgcagtctcgaacttctgggctcaagcaatcctcccacctcatcttcctgtgtagttggaactataggtgcacactaccatgcccggctaatcttttgtattatttttgtagagacaggatttcaccacattgccaagctagtctcaaactcctgggctcaaaaatgatcctcccacctcggccctccaaagtgatgggattacaggtgtgagccatcgcaacctgcttttttttttttttttttttttttttttagcatttctttactttctggcaccatcaaatgtcccaggatcatcttttatttcccagtttgagctctgcaatcaaatcaatctttaaggaatcctttccatatgatttaattatatttggtatcttgtttgaattctacctaatttgaacacattgggaagtaaactttttctatggcctagtctcatttcttataaataactcatttaaattatgaaaaaatacaggcataagaagttgatttaatttctaatggcctaaaatcttttaagtttatcatgcttagaaccctcaagcgtgtaacactgtaaaataatattttactgtatcttatactatatctaatctttctagagtatcaatagaaataaggatatcatgaagattggttgctcactgtctgaagtttgcccccaggccagttcagttttggggaatcttgacccaaacaaggtgagccatattcttgaatataattatttcattcctcctgtcagctttcctgtgtcttagatatttagtttttggagttcctggtatatttgaaaagaagaggctgatttttggaatttgtataaactactgttatggtatatttattaattcaaaaatacttatggactgaatattactcagtcttgaaatttgacgtaagctacaacatggatgaatcttcaggacattagctaaataagccagtcacaagaggacaaatactgttatggttctacttgtatgaagtacttagagtagtcaaaatcatagagacagaaaaagtgagtgatggttatcagggactgggggaagattgaggatgaggagttattgattaatgggtgtagagtttcagttttacaacatgaaaagagctatggagatggatgatgaatggtggcgaaggttgcagaacagtatgaatgtacttaatgccactgaactgtatacttaacaatggtcaagatagtcaattttatgttatgtatagtttactacagttaaaaataggaaaagtagaattaaaagctacactattctagccaaaaaaacaaaagtgaagaaaacgtatgtactgtctgccatgtacctggcactgtattaagcattaagtaagtatgcagtggtgaacaaactagattccttgcatttgactttgattcacaaaaaatttgtaagatgcatctttatgcagagcaatttggcttttttcttttttactgagttataacttgtatacagtaaggtatatatctcttaagatcctaagtatatagcttggtgagtttttacgtgtgtatgtatccatgtaaccaccatccagatcaacatatggttctatcatttcagaaaattccttcgggccccttctcagtcaattcttagtcagtagtttctccatcagaggtataaccctcattttgatactatcaccatagattcgtatgtctgttcttaaatcatggagtatgtagtttattgtatgtatctggcttcttttgttcaacataatttctgagattcatttatattgttgtgtgtattagtgtattggtagtctgttcttttttaagctatttaacattcattgtataaatataacacaatttatcgatctgttctcctttgatgggcatttggattttttgcagtttttaactactctgaatgaaactgccgtgaaatccttatataagtcttctgctggatgtattgactcatttcttttgcacatatatctagagtagaattgctaaattgtagggtagacatgtttctgccaaagtagatactgccaaacagctttgcaaaagtgttgaaccaatttacattcttatcagcaatttatgagagttatagttcctcgatatcctcaccagccccctgctttgctagtgtactgaggttgtgttttaatatttttattagccctttggaaggggtcttgtgaagtacctattcacatcttttccccatttttaaattaggttatttgtcttgattgatttgtaggcattctgtatgtttttttcactttaattttcatttttgtttctacctcttaaagtcaatgataaagtcacaactgtaaaatgaatgcatttaaaaaataaaagatatatttcaatgacaaaaagtatgcaatgatcatgaaaatctactgtacactttgccaaggccaaagaatgaaagacaatatgaaaaagccaatcttcaaatatatcctcaacaaaaactccctcctaaatagtaaaattatcatttaagaatatttgtctttacacatctaaacagaagctctaaccaaaaaaaaagtgggggaaagggcagatgataactctccacaagttttccagatataaacatgtggtcaccaggaattcaagattaaacttctaaagcaacatttaactcaaaataaagtgaacatttctgacaggtgacaacagtagtatgaaactgatttttcctttcctaaatagaaatgagatggggcatttcagtaatcatctaagaataactgtagaaatactcccaattctaccaccccacccactggtataaaacagataccttccatgaaagtatctttcacattactgaaatatcctcacttacttgggacaatttcatgcttagatgagtataaacacttgtttttaggtgtgtggaattattggagctgagatttttgaaacaatatctgaatcttagcagagatataataatactttcactatacattgattgggcttccttaaccaaatctgagcaactactgtaataacaatgctggtggtagtccatgatactctcaaattttttccctttaagaaatatataatccatgtaatactagtaaatatgttacattgtacaccttcttaacaaagaatgtctgttttcaggccttactaggaaaacaaacaaacaatggcagttactgcctgtttttatcactgataagctacaataaagctcaaatgatggatggtttacgtgtgtgatattaagtacaaaatgaaagccattataattttaccaaaagaaacacgaaaaatatgggaagaagtgaaatgaacatggcatgggtcccaaagattacgatatgtttcagaacaggattttgaaaacaaacaatttctgtgaatatttcttatactagaaagatccaaagcaaatctaggcaagcttagccctaccttgtcaaagataaatactcagataagttggaagttccgtttgctaaagtgcatctgggatcatatctaccctgctacttagagacagccaggaaggtggccatcactcatgctctttcactctttctgtgtcttatcaagagtcacacgtaacaatttttttttcaaaccaaatgctttatatagtgaactacaggaaaaacaattctaaatacacttttaaaatgctagagagttaagataacctcattaaagaaaaaatactgaaaatgtaaagggtccatacaaactaagagctgtattaagtgtatactttctattttaataattcacttggctgtgctcttaaaatgagagaagcagatattttacccatgtcttctggcaagagattcaaaagcagaagtagcaggactgtaaaatttcataaaatttgtgggattttttaaagctaaattattcaatatcttgtacagttttgtacccatatattaccccggaatatatgtacagcatcccagcaacagtgactgcaacaaaagtaaggtaaataggtctacaaagcatttgatttccttattagagaaagtttttatagaggaaatgcaaacaactgcaattcagatcacattatataagcttgatgattatttaaaccttatataaaattaaatctaacccttaccactacaaatctgtaaggaatcagaaaaggatttatagtacacaagtcttgattactgtttcattccactttgatatcactctgagctaaaacagcattcttccaagatttaaagaaaaatagattttataaaagggattcttttacattattattgttactgacagaaacaagttttgcttttttccactataattcgctctgatgaaagaaataattctctctcttaactcctaacaaacgctacattttcaagactaagggaattactggtggcattctttctccttgatctaaactatttgtctctaaaatatgtcaagtaagcttttaaagattcaggaaggggcagcgttgtgatttttttctcagtaaattttgaggtggctcctctggcttcattgcttcactgtgatctttttcttcctcttctttgttatcttccattttttcatcctcctctctgtccagaggctgaggaataagctgattacccacaaatatgtatgtgttagttctctgtttaactctctttttttttttccttttgggtggagccctttgcggaatccccttggcctgcatctcatcatttatgaaatttctaagtgtgcgtcgaatgtaaatacaagccaagccctgtggattcctgacagcacagggagggagtcccacagaatctggtttaccattatcattcttacttggctgcacaagtggagcaaatgacacaataaggatatttttcctttcccaagtgttttgtccagttctgcgttaactgatcctctacaggcatgatcctctacattcatttgatcttcaatcagtgataccctttcttccacttgatcaaatcagctactgaagcttgtgcatgcgtcacgtagttctcgtgccatggttctcagctccatcaggtcattaaggacttctctacactgtttattctagttagccattcgtctaatttttttcaaggtttttagcttctttgcagtgggtttgaacatcctcctttagcttggagaagtttgttattaccaatcgtctgaagccttcttctctcaactcatcaaagtcattctccatccagctttgttccgttgctggcgaggagctgcgttcttttggagaagaggcgctctgatttttagaattttcggcttttctgctttggtctctccccatctttgtggttttatctactttttgtctttgatgatggtgacgtacagatggggttttggtgtggatgtcctttctgtttgttagttttccttctaacagtcaggaccttcacgtcctcagctgcaggtctgttggagtttgctggaggtccactccagaccctgtttgcctgggtatcaccagcggaggctgcagaacagcaaatattgcggaatggcagatgttgctgcctgatcgttcttctggaagcttcgtctcagaggggcacccggctgtatgaggtgtcagtctgcccctactggggggtgcctcccagttaggctactcgggggtcagggacccacttgaggatacagtctgtctgttctcagatctcaaagtctatgctgggagaaccactactctcttcaaagctgtcagacagggacgtttaagtctgcagaagtttctgctgccttttgttcagctatgccctgcctccagaggtggagtctacagaggcaggcaggcctccttgagctgtggtgggccccacccagttcaagcttcccggtggctttgtttacctactcaagcctcagcagtggcggacgcccctcccccagcctcgccgccgccttgcagttcatctgagactgctgtgctagcagtgagcgaggctccgtgggcatgggaccctcggagccaggcgtgggatataatctcctcgtgtgctgttggctaaggctattggaaaagtgcagtattagggtgagagtgtcccgaatttcccggtaccatctgtcatggcttccctttgctaggaaagggaattctctgaccccttgcacttcctgggtgaggcgatacctgccctgctccgtgggctgcacccactgtctgacaagccccagtgagatgaacccggtacctcagttggaaatgcagaaatcacccgtcttctgcgtcgctcacactgggagcttcagactggagctgttcctattcggccatcttggaacctctctctcctcttttctttataaatcttgattttacttttatttgctgaaacagtctaatgccaattctcctttctatattaatggagaatgagcatgcagataagtgtctctatatgattccttgacagatttctttcagagactatgtctataaaaattagcccatctgagacccatcattggagccaactcattcctcaatttttaaaattttttttatggggggattacaggtgtgagccactgtgcctgacctatgactgtgtttaatattgttataaattaagacatactccttttcttctattgaatataaaattaattaccttatcaaaaatttaaacaagtgtcagtaattaagtgattaatcagctacttctgattgttcataaatggattatactttgtcagttttccttagtgatctaaatggttctctccctctgccaccatgtagaagggtcataggctatgaatagtggagttgtgggaggagaagattgggcccaggcacaatgagagtgaatatatagttttcactatgtcatgagaacagataagtctatctgggatagatttacatgttttggtggttgtattacactaacagagccacgaacttcagattcttcactttgttgagtactgttatacctaggcgagttagagaaacgccacactctgagacgaattaagagtcctttatttaagctggcggccaaagagacggctaatgctcaaaattctctcggcccggaggaaggggcttgattaactttcataccttggtttaggaaggggaggggaactcaaatgcagtaattctacagaagtaaaaacatgcaagaatcaaaagaagcaaatggttacagagagataaacaatttaaaagacaaatggttacaaaaagcaaggtaccaggtgcagggctctaaatccttcattataattagatataaatgctatgccggacaggaactcaaggctttatgttgttatctctttgaaaaaaatcctgggaacttcatacattgtttgtgccagtaccttatcagttaattgggctcctttgaaatgctgaggatctgcttacacaggtcaactccttgcggaaggaggttgggtaaggagcccttagtgtcttgtaaattaaggggtcaattggagtttgtccggctttcccagctagagagagtcttacttgagaagcaaggctaggtgattaaagagacaaacaggacaaaatttaaagtagcgagttagagtaaaaacaaggttaggcattacagtaccagctctattcttggacacaagtgttcccagccctgcctcacctggtttgcaataaaccattgcatatctgtcgcttaccttataccaaattattaatcatattgtgatgttattacaaagccttaattaaagatgatgcagtcttttgcagggattgaaattggttaggactgttgattgtcagctatttttgctacttacccctgtcttcttaccagggttgagagagagtaccgtactattactgctctctcttgccctttagttgtttaatgttagctgaagaaaccggagttaattatgaattgaatacacttatcctttgtagcttttgaattgttatttatttatttgtttgtctgaatttatgtgttctttattgttttggtgaataggtttggtgtttaggtttcataaaataaatctgtggatttgtcctagttcagagtgatacattgaaattaattttataatccataacttaaagcagtattcttcagccatttttctcattattccctcctaaggagcatttttagacctgttttctccctaatggcctaatgggccttctccccttcagatattttaatactacagatatacagtatataataactatgttatcagtagggttgaactttggagggctacagaccattgtagtgtttaagatttccaactctccataaggaccacttttattccccttagggatattgccccagttgagaatgtatgatttaaagctgttaaggccaggcatgggggctcatgcccgtaatcccagcactttgggaggccgaggcaggaggattggttgaggccaggagttcaaaaccagtcttgggcaacatagtgagaccctgtttctacaaaaaaaaaaaaaaaaaaaaaaaaagctaggtatggtatgtgtgcctgtaaccccagatatttgggaggctgaagcgggaggattgtgtgagcccagaagtttgaggctacagtgagctatgatcatgccactgcactccagcctggacaacagagtaaaaccttatctcaaaaaaagtagttatcagcctgcagtgatttttgtatccttcccaatccaatcatggcttacttcatttttgttactgtaaagaaatacctgagactgggtaatttataaagaaaagaggtttatttggctcatggttctgtaggctgtacaaaaagcataactccaacatagtatagttgagagttagacttaagtggcatgtacttcgcatgtttatgttttaaaaaaattataccaattatgtcttcagacattaaaatagtatgattttaagtgtttgatgcctgtgtcttctaaaaaaagtctttttgctttttatacaactctaacaagggactcagggtgcttccacaaatattagaaggtgaagaggagccagtgtctgtagattacatggtgagagaggaagcaaagggaggaagaggtgccaggctcttttcaacaaccagttctcttaggaactatgagtgaaaactcattcacttccacgagaatggcaccaagccgtttttagggatctgcctctactatccaatcacctcctaccaggcccccctccaacattgggaatcagattttaacatgagatttggtggatgatatccaaatgatatccatctaaatcatagacaccttcaggagacatttgacagtgtttggagacgtttttgcttgtcacaactggaagtggtgctactggcatctagtgtctagaggccagaagggatgttggtaaatatcttacaatgcacaggacagaggacagccccactctgccactcaacacagactcatctggtcccaagtgccagtagtgctaaggctactttgaagttcgagaaaatgaaagccagcctgggcaacatggtgagaccttgcctctacaaaaaaaaaaaaaaaaaaaaaaaaaaaatacaaaacttagcccaggcgtggtggtgcgtgcccatgttcccagctaccgtggggactgaggtgggaggatcacttgagcttggagaggttgagtcagcagagagccatgactgctgcactgcactccaggcctggcgacagaatgagaccctgtctcaaaaaaaaaaaaagaaaagaaaatgattgaaagtacataaattttctctttattcttttattaaacatcattcaattgagatataaaataaagtacagtattaaagatattatctaatttagttttatctacttaataggactaatgtccttatacgtaaagtaaaaagtatgaaatctttcttgcttggtaggaaatatgaattccactatagttgagagttagacttacgtggcatgtacttgccatgtttatgttaaaaaaaattgtaccaattatcgcctcagatattataatagtgtgattttaagtgtttgatgcttgtgccttaaaaaatttttttttttgctttttatacccctccctcctcattttggagatgcagaatagcataatgaactctgaagtcagaagtttgaatcttggttctgcagtttactagtttatgtctttggatacatagtggcataaacaaagtacctgcctgataggattgtgagaattaaatgagttatatataaagtacttattgacatataggaagagcttaaatgctaacctttattctgatctgttcaccatgctttaaatgccaagtaattttgctttcttttctctttgtagatttatggtggattattttctgaagatcagtgttggtacagatgcaaagtactgaaaatcatcagcgttgaaaaggcaggaaattaagtgttcagtttttttttgctttaagaaatatttattgtggttcaaaaatttgatgcttatttagcccttcattgcttattcgtagtactgatacctggttcagtgattaaaacacagaagaaattaattgctaaaaaacatgttgttttataatcacctcagattattcaagaatagattatataatatgtaggttatttttggtgactagttatttttacctcagttcttttttttttttttttttttttttgagatggagtctttctgtgtcgcccaggctggagtgcagtggtacgatcttggctcactgcaaactctgcctcctaggttcaagctattctcctgcctcagcctcccaagtagctgggattacaggcgcccaccaacacactggctaatttttgtatttttagtagagacggggtttcaccatgtttgtcaggctggtcgaacttctgacctcaggtgatccgtccgcctcagcctccgaaagtgctgggattacaggagtgagccactgtgcccagcctgcctcagatcttaataattatatttggttcttgagtaacttttaaatgttcattttattaagctttataagtaggagaagaacattttgattgattcttctgaagttaggtatatcttttatttagttgatgtgaatattgttaataataatgattggcttgccactttcttatgcctgggttaaatgtggtgagttttctttgtgttaagcttttttttttttttttttttttttttttgacattgtgaatttgtggaggatttttaagaggatttagggagacagaattctgaatagctgtttggtgacagttgcatattgcaggctgggtgaaagcacctctgtaagatttcctttggtgttttttctacacctcctttctgtacttaaattataatatgtatgtttttactgaaccagggaaagtggttcaggataaaagagaaaaagttaaaaatatgtatgtttcagaaatattttctttggtgtgataagatgctaagatgtgacaatttgattaatattctgaatagcttggtttaaaaaaatttcattttttgctgtcatagaaaatggtttattttagtggaatggaactttctaattgacctttctcccataatttgacaactggagatgatattttacatatgtttttcagttggctttaattttttaaattaaagggcagcatgatgtttgaccttgtaataactatttttcttttttactttttaaacagatgtagagctggaggtaagggtggtgaatctgattagtttacatggtctacctggagtgagtttaattgtgtcaaaggaagtttgataactttgcctttcttttcagattttattctttccaacttgaaattgaattgaatgttgattgattttaacattaggagaaacaggagagggctgtaagcttcataggctgatgtttatttaaaatatcaattgtctaaaaacaaaaagcaccctaatgagaaatggtactgttggaatttaactagtaacaagtaaagaaatcactgtaatttcatggactgtggattttttttttattttgaagatattagaaatctgtttctgaatgtattttgtcattttgaggtaagaatgctattttgatatacaggtcattaacagagagcagcaaattggtggtttctttggaaacatttaatctggggtcagtattcgtatttgtctcttattttttccagtgtctggtgaggtacattgactatggaaatactgaaattctaaatcgatctgatatagttgaaattcctttggagctgcagttttctagtgttgccaaaaagtataaactttggggactacacattccttctgatcaagaagttacccagtttgatcaggcaagtcacgtattttaaatatttttgctaatgaaagtaaaactatgtgcttgaaacaaaatgtaggtatagttaaatcttactttaatataaaagtctgtataaattagtgaaaaataggaattataattagaaagcaattatatatttatgctcatctttgctaggtaaacattgaacagataagaatgacatacacatatataatatatgtaaatagtttccttctgatgtaaatgtttaaaaggatagtctctttttgtttttttttttttttttgagacagagtctgactctgttgcccaggctggagtgcagtagcgtgatctcggctcactgcaacctctgcctcccaggttcaagcaattcttctgcctcagcctcccgaatagctggattacaggcctgtgccaccatgtccagctaatttttgtatttttggtagagttggggttttaccatgttggccaggctggtctcgaactcctgaccccaggtgatccacccaccttggccttccaaagtgctgggattacaagcatgagccactgcgcccagccaaggatagtctcttatatgatggagaaaataatgaatacagttatttctataattgttttgggaaagtatttattaaataaaagtgatctttacctagtcctggccataaataccacaaatttgaaattaatggggttataattaatcagattgtattattttggcagaggctcatactgtttgatgtaataattggcagtggatgttttgcttatgtggattctagtttatattactttccattgaattttgggttggtaacctaattctggaagacgttcgataatttcaggggtagtcttacaggaattctacctcttttaaaatctgttatacaaagatgattcttttggtaaatggtaatgctggtgagagatattacattggaaagtaatcagatttgtaattcttatttataatagcagctcaagtagctcatgtggaaaacagtttaatcattgtaagcattataaagaaattaattaaaattgcctctatttttctttgagaatcttgtaggtgtgttgggtatagttttgtctgctatgtagttacttataaaaaacatttctgtacatgaaactcaggctttcataaacatgaaatatagatattataaaattacaccccaagtttctggtttaaaatctaaagtttgttactttcttctttaatataaatgctttgaccaaggttggggaggcttgttttggatttcttgcatgcataaaactctaaaatcttgtttacggaccttagaatattatctgctctcactttgttttacatatagggaaattgtagtctagaataattaaatgacttcaagtcgtgaagctaactagggaagagctaggcctagaactcaagtctgttgttcttttcatagtaaaatgcacagatttgtgttgattgaaacacacatgaatcaagggggaaaaagacattaaaaaaagttaattttagaactgaattaataaactgcagctgagaatgtttttgtatgtttcaaagattctttatatatggtactgtatataaacatttatatatatatatatatatatattttttttttttttttttggttgggggttgaagtcttgctctgttgcccaggctggagtgcaatggcatgatctcggctcactgcaacctccgcctcttgggttcaagcgattctcctgcctcagtctcctgatagctggaattacaggcacccgccaccacgcatggctaatttttgtatttttagtagaggtggggtttcaccatgttggccaggctggtcttgaactcctgacttcaagagatccccctgtctctgccttccaaagtgctgggattacaggcatgagccacccggctaaacatttgtatttggatgcttagttcagtaaaaagatcattgattagagttaagctaattggcacacaatgttttctggaaaaaaatgagctattcttgaatagctctgcttagaaagtccgtgtttagttattaattctcagcccaaagctcaactctaatcttctatatgaagtctttgctaatacccacttacccggtcctctgtggtgttttagtcactccgtatataaagcctataaagttgtaattttttcctcccctacaagcttagtgagtttggtagagataagtattcacttttctgtgcctaatttccctgccaggtaggtgttagatgagcattagtttatctaacatttgaataaatagatgaacagcagggattcagtaacaacacaaatacctccttccttccccttttccagaaggtgtcctgggcactgaaattccttcacatttttttaactaacactttcacgctatgctgcagcacagtcagaattgatgctcagaatggtagtttgctgaagatcgagagaatattacattactagtcctacatgcctgactttaaaaattatatgtagggtaagggaatgagagctagagcttggaatttgtgtttaacaatttaaaggccttttagcttgttttctaatatatacaggcagaattcagaggaataaagtagaaagcaagtgatcctttcttgtttctgaatgaagcttaccagtttggaaaacagaatgaaatatatttctaaaaagtgacattcatcttttttaatgattgaaagccttatgttctaaaccagtgaccagatttattttaaaaagttaagttttgtccagtgcggtggctcatgcctgtaagcccagcactttcggaggctgaagtgggtggatggcttgagtccaggagtttgagaccagcttgggcaacatgggaaaaccctgtctgtataaaaaatacaaaaaaattagctgggcatggtggcgcatgcctgtagtccccgctactcaggaggctgaggtgggaggattgcttgagcttgaggggtcaaggctgtgagaccctgtctgaaaaaaaaaagataaaagttaagttttataccttttaaatgcctaaatatattttttaagtgcaggtatatatctccagctcataagggttagtggaaaatatatttcttatgataaaaattaaatgtttatatgtattatatataaagagaaaacatacatatttttggtatagtattaaaacacccatgtatcatatactctgtcattctttttgttagttggaactgaggaagactcagattttatttcaagttcagggttctgtgtttatgattatatatgattcagggagaatctgtttgaaccacttcatactaattgtgattggtgactgtaactaaaatgaatttgaattcagagagaaatctaaaattagatttctgcataaaaattctatgcaaggagtaatggacctttagaacattcagctttaggtaattgaaacttttgtagacaataggttatttccatttgaattcacgtattgcccaaagacagggtttcttgaaatattaataattccacatataccagcaataattttcaaagacttcctaggggcagaagttgttcttgaattttagatagacttttgataataagagttgaaagcaagggtttttatgtgaaagaggttaactggaaaactacatctaattgattaaaatcctaacatatatttcagttagttatattttgaggttgttagctttgcctgcttgatcccatttgattggtgataacttctggactgtatttgttatttatactgatataattgatataatatattgatataatatattgaattcttggtgaattcaaacctcttgatataatgtgtgtatttctgaattttatgccttggaaaatttataaaacctgtgtttttgttaacctaaagtattataggaattttatgccttgaaaaatttataaaacctgtgtgtttgttaacctaaagtattttcgtgttttgtggatttaaaaaattattttttcagctaggcacagggtgtgtgcctgtaatcacagctacttaggaggctgaagtgggaggattgcttgggcccaggagttcaagaccagcttgagcaaacatagcaagaccccatctaaaaaattctttttttttttttttttgggtagtgatagttggtgattcttgagcatatgtagtttgagtctccttctctgccccttcagatgcatccttgtaggcccaggtatcctcaacctgttgttaaaataaatgtgtcagctgggtgcggtgtctcacgcctgtaatcccagctctttgggagactgaggtgggcggatcacgaggtcaggagatcgagaccatcctggctaacatggtgaaaccccatctctactacaaaatacaaaaaattagctggtcatggtggtgggtgcctgtagtcccagctacttgggaggctgaggcaggagaatggtgtgaacctgggagatggagcttgcagtgagccgagatagcgccactgcactcccacctgggcgacaaagccagactccattcaaaaaataaaaaaataaaaaaaaaatgtgtcccaatgaaataattttttttgtaatcctatgtatttcatacatttaaaaacattctgagaaaaagtccaaagatttcacctgactgataaaggagccccatggccacaaaaaggttaagaattcctacatcggtctcaattttaccctctatactactgtgtagttgaagagaaaatagttcttaaaaatgttatttagtttcttggaccttgacttccccacaccccctatttcttttaaaaatgtgaccggtttgtattttgtggtttttagtgtgtttttacactcttgtttgtctgattattacgggtatgatgtcctgttcggtttgctttgtttgcataaactatattgttttttgtatttatagagtgggaatgtagctaaaaatacagctccaccttctaagagagatacgtttcatcagatgatgtccctatttcaaggaagttgtgaaccagtaaatttgagctgtacctacccattttgtgttttaagtttatgctttatatattccgaaaaagaatacttacttttaatttcctttatagtacgcacagggtgaaattcaggaaaataacctagagaaatttgggaagagcagttagattgtgtcaaagtaattttagtaattacagttttatggaggagtagataagttcttattaaaattaagtctcaatatgttccaatcccaaatatgttttaggtgtatctttgcttagttctattgatagatattcagtagctcaaagttagcaagcacctaatttctcatatgccagttgtacagttgtagccctcttaagcaaaagtctatttaagagagttttgaatgtagaaggccaggcgaggtggctcacccctgtaatcccagcactttgggaggccgaggtgggcggatcacttgaggttaggagtttgagaccagctcaactgacacggtgaaaccccatctctactaaaaatagaaaaattaggcaggtgtggtggtgtgtgccagtagtcccggttactggggaggctgaggcaggagaatcgcttgaaccggggaggcagaggttgcaatgagccgagattgtgccactgcactccagcctgtgcgacagagtgagattctgtctcaaaaaagaagaaaaacaaagttttgaatatgtatttgtgacacctcacattttataatttcagtttgttgatttttaaagaatttgttcgtattttgtgctttcggtttgtggctttttttgcttctgctcgtcttactttaaaaccagagttcctgactctgcctctaaaactttcaaagttttgtaaaatcgagtaccttttctagatatcagagattcatttttatgcgctattgcttttcaggagaccattatatttagttggggccaaagtaatcaatgtaatctgctgggttaaaaaaaactattctaggatatttacttagtatacatttttagatttataaaggtggctgcctgtacaagtatttagctctacttgattttagcaagtgtgtaattggaatacattcatatacgtggagatgcatatttgcatattatagccaacagcaaagtaatatagagattttagaatgaagaaatatgatgcttggaaaaaatgggtaggaacaaaataagggaagagaaacatgttggtgtagctggtttatgttttcttctttcttagggcacaacctttttggggagcttgatttttgaaaaggaaataaaaatgagaattaaagcaacctctgaagatggaacagttattgctcaggctgagtatggcagtgtggatataggggaagaggtgcttaagaaaggatttgcagagaaatgcagacttgcttccagaactgacatctgtgaggaaaaaaaattggatcctggtcaacttgttctcaggaacctcaaaagccccattcctttgtgggggcatagatcaaaccagtcaaccttcagcaggcccaaggggcacttaagtgagaaaatgactcttgacttgaaggatgaaaatgatgcaggcaatcttataacatttccaaagtaagaatttagtcttcactaatttctaattgatggtagaggtccctgtcatagtagaatagaagttaaggcttatgcttttggaatcctttactgtgtcagtgattttaagggctgatgctgatatttctgtttttctcaaatgtattcctctctgctttagcagggatattttcattaaaagctattttgaaagaaaaataactcctgaattattttaaagtttacataccaacttttcatgccaactatttggaatacacttatcaaaaataaaaatctgctcctaaatctgaattattcaggcaaagtcagaatttcagataagatttgaagttcttcctatggctttaggaatattttaaagagtttcaggaaattgcctttacttttttaataaaagtgaggctctttcttcttcttgtgaaaacttgtgatggagtttgattattccgaatactttactttttagataattttaaattatcaacttgaagcagaaatccagatttgatatttatatgtatcaaaacagtcttctatatcatggtccaagccatgatgctgtatcttggatgacatagctgtttgatgggatctcatcagtgctttaggagctaaactgtcaaatgggggtgggaggcggtggacggggggatcacaggggatcacaggacggggggatcacgggggggggatcacaggagggactggaaaaaaactaatacagaaatgctttttactttgttctctgtagttgatagtgctatgaagaagttggaatatttttttttgagaattagaggcattattgaattacgacttcagttataaaatcttgtttgcattaaattattttttaatattatgaactaggtaaatattttagttttcaaaattaactttcagatatattgtggcataaaaggaccaagataacttagatttgttttctgtgtcagccttatacagtttgtttgtcaaaataaatgaatttgtttttatagggaaagtttggctgttggtgactttaatttagggtctaacgtcagcctggaaaaaattaagcaggaccagaaactgattgaagaaaatgaaaaacttaaaacagagaaggacgctcttcttgaaagttataaggcgttagaattgaaagtagagcagattgcccaggagctgcaggtatgttcagtggcttaaggtgaagagtgtccaactgggaaatctgtgtactcatctgctgctatttatttttctgtcactttcctttccttccccacctcattctctcctttgctaatccctgtatttgtttataggtgaattttttttcatatactccagactaatcatctttggatttcattggatgtttgcaaatttaataatttctcatttacatttccctttatgttctaaaaacttttcaactaaggcaattttcaaacattctaaaaggagagagacttgaataattaattctcatgtgcccatcacccagtttatacaattataacacatggccaatctttttaaaaatttacacttcctggattattttagaagaagtcccattcatattatttcatagtcttcagtatgtatgactaatagaaaaggactttaaaaaaccgtaataataatactattcatacttaaaagtaaacaataattccttaatattatttatatccaggcagtattcaaatttgccatattgtgtcatgaatgccacatgattgtaggcatgttgattgtagttttctccaatcaggatcccagttaggcacatacattgcattttggttgatatttctcttaaattgctttaatgtgtttccttgtgttgcttaactggattcttgatctccacgtgtgtcttcttttatggtaatcacgtctccagatttgctcagattttagttcagaaattttcccccccagggatacagtgtggttgataagtgtgtgtgtgtgtgtgtgtgtgtgtgtgtgtgtatgtgtgtttaacaccaaatctgttgttcctgcactagttcctccaattctctgacaccaactgggtgtctaataattcagctccattctgacactacattacctgtacttagcatataccctacaagttaaggactcagttccataaagctgcctctactttagatgccagccacaaatggggtccccaggctacttgcatatctacccccccactataaattcggggtttcccatgaccctccctcaggttagataattcactagaactactcacagaactcacggaagtgctatacttacagttttattattaaggatataactcagaaacagccaaataaatggaagatatatataaggcaaggtactggggcaggaggtacagagcttccatgccctttctgagtgtgccaccctcccaggtcatggatgtgtttatcaacccagaagctccccaaatctcattcagagtattttggttttgtttgtttgtttgttttgagacagtcttgcaacatcttgctctgttgcttaggctggagtgcagtggtgtaatttctgctcactgcaacttctgcctcccggactcaagcaatccactcacttcagtctcctgcctagctcggactataggtatgtgccccattcctggctaatttttgtgttttcttttctttttttttttaaactcaaacttgccttatttatatccccaatggcatgatctcggctcactgcaacctctgcttcccaggttcaagcgattctcctgcctcagcctcctgatagctggcattacaggcacccgccgccatgtctggctaatttttgtatttttagtagagacggggtttcaccatgttggccaggctggtttcgaactcctcaggtgatccacccacctctgcctcccaaagtgctgggattacaggcatgagccactgtgcccagcccacattttctttatccagtctatcattgatgggcatttgggttggttccaagtctttgccattgtaaatagtgctgcaataaacatatgtgtgcatatgtctttatagtagaatgatttataatcctttgggtatatacccagtaatggtattgctgggtcaaatggtatttcttgttctagatccttgaggaattgccacactgtcttccgcaatggttgaactaattcatactcccaccaacagtgtagaagtgttcctatttctccacatcgtctccagcatctgttgtttcctgactttttaatgatcgccattataactggagtgagatggtatctcattgtggttttgatttgcatttctctaatgaccagtgatgatgggctttttgtcatagttttttggccgcataaatgtcttcttttgagaagtgcctgttcatattctttgcccactttttgatggtgttgtttttttcttataaatttattttaagttccttgtagattctggatattagccctttgtcagatggacagattgcaaaaattttctcccattctgtaggttgcctgtacactctgatggtagtttcttttgctgtgcagaggctctttagtttaattagatcccatttgtctattttggctcttgttcccattgcttttggtgttttagttatgaagtccttgcccatgcctatgtcctgaatggtattgcctaggtgttcttctagggtttttactgtttggggttttacatttaagtctttaatccatcttgagttaatttttgtataaggtgtaaggaaggggtccagtttcagttttcttcatatggctagccagttttcccaacaccgtttataaaatagggaatcctttccccattgcttgtttttgtcaggtttgtcgaagatcagatggttgtagatgtgtggtgttatttctgaggcctttgttctgttccattgatctttatatctgttttggtaccagtagcatgctgttttggttactgtagccttgtagtatagtttgaagtcagatagcgtgatgtctccaggtttgttcattttgcttaggtttgtcttggctatacgggctctttttggttccatatgaaatttaaagtagttttttctagttctgtgaagaaagtcagtggtagtttgatgggaatagaattgaatctatcaattactttgggcagtgtggccattttcatggtattgattcttcctgtccacgagcatggaattgtattttctgtacagtcagggtttgctgtgttgcttaggctggtctcaaacttctgggctcaagcaatccttcctcttttggctccagagttgctgggactacaggcgagccaccatgccttgctaaattaatgaactttaaacacatttgacatgttttaatccactgaagccattttttttctttttgatgcacacattatcccctttgaagtctttttaaattagcttctgtgtccttttgacatcataacagctgatattcataatggataaatcaccattattaagtttttcattaatctgtgacctaatgatttttgcagccatcgatggttgttgtctgcaagcatgttttcatcaggtgctgtatttcttttttttgtttttattattatactttaagttttagggtacatgtgcacaacgtgcaggtttgttacatacgtatacatgtgccatgttggtgtgctgcacccattaactcgtcatttagcattaggtatatctcctaatgctatccttcaccactccccccaccccacaacagtccctgatgtgtgatgttccccttcctgtgtccatgtgttctcattgttcaattcccacctatgagtgagaacatgcggtgtttggttttttgtccttgcgatagtttgctgagaatgatggtttccagcttcatccatgtccctacaaaggacattaactcatcattttttttggccaggtgctgtatttcttagctggaaaatttcaactatttagtcatgctgaagcctagtttgttcagtaaaggcaagataaatactttattcattccctttatatgtacatgttttcagaaaaataagtttattccctaggattgtccagtgttgaccagcaagggttatttgttctccttaagtattattatgaactaatgaattttaaacatatttgagtgttttaattcactgcagccattattctttttgatgcccatcttatactctttggaagtctctttaagttgttgctctgtccttttgatgtgattccagtagtctgatagcttccttgttttctggtgtcacaagatgttccatactcatctgcatttcctaccctaatcctggaaaagttatttctccaagctatagttctttttagtggcaagaggtatttagataccagactttgggtgctagggatatatatagctattgctttagtctttgcttctaggttatagaatgtctaattgatagggttaggaaatattattttctaatgctatattgagatatcatttacatatagtaaaaatgcacaaatactgtgtagaacttgataaattttgacgtatgtatactctcatgtaacctgaatcaccctcatcaagattggctgatgaaactatcattaatcagatatttcacctagtatcaagctctaccaataatttcagggacacaggtaacaaagagactcctttgttccagagcaggtgccccagtctctgaccagagactagaatgtctgctgtggctactgctgccaggcatcaaacaatgtctctaaactctcataagggtgccatctgtagtattgtaactagagagggtggggcccctctcaggtgagcagtgtggatatgaagcagtggggagtgtgttctactcaagtgtaagtctcacagcagcctatagcagagctttgggtgttgtcccaggtgtgcataggagagcctggcttttctgccccttcttggctgggcagcagctgcagtcatgtcagcctaaagtcaggccaaagttgggccacagctcagaattaaactctccaagtgacacttttggcctgtgccctgggatactggggcaccaccctggtgaacagcatgggcaaaaagctgtgggaagtgtagtctgattgtgtctcagtttcacagcagcccattgcagggctgtgggtattctatagatatgtgtggggtagcctggtttccctgttggtcctttgctgggcagtgactggggctgtgtcagcccaaactcaggccaagggcaggactcagcccagcattgaactcagaaaatggtgccttgggcatggggctagagagaatgagtcaccacccagccaagcagcatgagcaagaaggtgtatggagtatgatctacttatgtctcagtctcaacagcagcttgtagcagggtgacaagtatcctcctgggggtgcatgggcatgcttgttctccctctccttttttggagcagtacagtggctgcagccatgtctataggtccctggtatctaaactcttaaagtggctccctgctgaggctgctccagacttgggtgcctgtgggattctgtgtggattccttttctggaacaatgtctttgtgtgatctttaggcagctccatatgtgaggtgtgaggccctagtggatcgagggtttctcctatagccaatgttgtaaatgcttgtttcagagctctggggatttttctcttactgtttccctgcgtacagtagcctttcccagctctcagctggtttctggctaggcatgcttcctcaaaccctctcctttcttacttctggggctttctctctcttctctggtgaatccaaatattcattcttagtctgttcaaaatgtgtctacttaactatttctgattcttccctgtggaaaaggcacacactatctagttggccatcttgattattttctctctcactcattgtttatcattgtggtttggtgtgtttctgtagtgggaacatttgattcctttcttgttttacttgtgtgtttgctttactctgtgggttttatacttttttttttttttttttgagacagagtcttgctctgtcgcccaggctggagtgcaatggcacggtcttggctctctgcaacctccacctcccaagttcaagcagttctcctacttcagccccctgagtagctgggattataaggacctgccaccatgcccagttaatttttgtactttttagtagaaacggggtttcaccatgttggccaggctggtcttgaattcctgacctcaggtgatctgcccacttcggcctcccaaagtgctgggattacaggcgtgagccactgcgtccagctgggtttttaactttcatgtgtttttatgatcacagattgtgtattgccctcccttaagcatctcttgtagggatggtctagtgctgatgaattccctcagcttttgcttgcctgggaaagactactacttcttcattcatgaaagacaactttgctggatatagtattcttgactagcagtttcctttcagcgctttgaatatattgtttcattctctcctgtaaggattttactgagaaatttacagttaatctgatgggggtttccttataattgatgacacgcctttttccttctgtttttagaaatatctttgtctttgacttttgacaggttgactgtaatatgctgtggagaagacctttatgaattttatctgtttaggcatctctgaacttcttttatttgaatgtctaaatctcttgctagacttgggaagttttcagctattttattaaatataagaagtttttgatccctttttttctctttttctgtgacattgaaaattcaaatacttgtttgcagtgtggtgtctcatatgtcttgtaggcttttttcattcttttttgttctttttttaaatttttgattgactgggttagttcaaaagtcttgtcttaagttctgaaattctttcttctgtttgatctagtattttttgttgttgtttgttttgttttgaggcagggttttgttttgttgcccaggatagagtgcagtggcacaatcacagctcactgcagcctccaacttctgtgctcaatcagtgctcctgcctcagcttcctgagtagctgggactacaggtgcatgccaccatgctgagctaatattttaaatttttattagagatgaggtcttgttatgttgaccaggctcttctcaacccctgagctcaagtgatcctcctgcctcagcctcccaaagtgctgggattataggcgtgagccatcatgccaggcctagatctagtatattgttgaagctttggaatgtattttgtatttcattcggtgaatcctttagttctaggatttctttttttttttttaatgatacctatttggtaaatttctcatttataacctgaattgtttttctgatttctttatattatttttcagaattatcttttatctcactgaacttatttaaaatcagtattttggatttttcatctggaatttcagaatttctttttgattatgatctgttggtggagaattactaacttcctttggagttatattttcttgtcttctcatgtttcttttgttacattgatatttgtgcattgggtgtaacagttgcttcttccaattttttggaaataattttgtaggggaggatcttttcctgaagatgtacccatggtgttggttgggtagggccctttggctttaattctgggttcatgcagtagcatagtctttgtatgattcctttggatgtgaatagtcagtggcgtttgtgatttcctcaatggcttagggtgtggttgttagtgggggctgcggagaagttttgctgggtaaaggaatgccatgtttgccagtcctcagaccccaatggtggcaatgccaggccaagtatgcttgtccttggtttccaggacagcacatgctggcactactgttagaaagcccaggttggccagtgcttgggtttccaggagtcttgcttgggtgctagtagcagcagtggtgggccagacaggtgagtgtgttcttgggctcttaggcagtgggcacgatgtgggtgatagtagcaatggcttgacaaccctgtgctttccaagtggtctacactggtgttagtgctggctgtgatgtgctgagtgggtcagtcaggcccacaggtagcatgtgcaagtggatgccagctgtgttggtagtggcaggttgggtaggcctgaccttgggcccttgggaggagtgttgaggtaccaatggtggactgggctgggtgatacccagggccttgggtggtgtgctcagacactggtgagaggggttatggagctgggtagagtggacctgtcctcaggtccaggtggtgagtgcagactctgattgcggtaggcaggtgcaggatgatgcccaggtttccagtggaatgcttgagtgggggtggcagtggttgctttgcagccctgtcactggggagggtgaggttgctttcactggcagcagatgtgtggaggtggctggtgaacatgtactttgctcttacatttgctccagtggaggcagtttgcaagggcagcagctgcaggtgggaaagtttgtcctttgggtgtgtgaaaatgtgcagcagctttgctgcttagggcagcggggtcactgtaaatggctcacactttgacactggtggcagcagcagctagcattgcctcaggttctgggttgggtagccctcccttgggtcatgtgaagatgcatggctacccttctgctggtggggttggggttcctgccagtggcttgcagtttggcctcaggtgtggcagcagctagtgacaatggtggttgtgggatggggtagcctttcctctgggtccgtgaaaatgcatggttgcccttcttgggcgtagagtggctgccagtggcttgtgttttgattctgtggcagcagcagccagtagtggtggtggctgcaagcaggatagcatttcctcagggccatcaagatgtatggctgttcctctgccgtagggaacagggttgctgccagtggctcctacctcttcgcgggtacttgcagccagctgcagtggtggctgtgggcaggagatgtcagctttgctccagggttgtggagttgtaggggatgttgggccctagaccatgatgcagtctacttggggctgggcacacaaaatggcagcatgctgtagttgcttaggattggggggtgggtgtatgggacccaacatgagctccctgtatggagcaatatacttgtgtagtctctgggcagctctctgtgtctcagagcacatgaggatcaaaggtccctttcgtggctagaattgcaggagtttgcagtgagaatatgggccactggggtctctcatttaccccttctatgcattgaggagcctgtccaggctcccagccaagaaggctgcttctcttctttctccttccttcctttatgtgtttcctgtcacttctctgttgaagtcccatttctctcttagatgatctatttgaagtgtgattatctacttgctattttggctcttttctcagagggaggcaaataacagtggcctctagtgagtcatcttgaagcccctgtctgaaataatgtaatctaacaaacacgtttttgtgtgttatatttattgtatactgtatctttacaattaagtaatctagagaagggaaaatattattaagaaaatcataaggaagaagaaatgtatttacgttttattaagtcttaatcctcattgtcttcatgttgagtaggctgaggaggaagagcatgggttggtcttgtctcacaggtgacagagatggaagaggtggagggataaataagttaaataattttaacttaatattatttaattttaaaataagttaaaattatttaacttactaacttatttaaaaataagttaaaattattttaaaataaattaaactttttacttttttttctcaataagttatacaaggtgtaccaggcaggcacaccttgtgtaactttttgagaaaaatctgtttgtaagtggatctgtgcagttcaaacctgtgttgttcaggcatcaactatgtttcttttcatacattgttggattcagttttctaattttttggagggtttttacatatatgttcgtgacatatattggtttgtggctttctttttgtgtaatgttgttttctgatttcagtattagggtgatgctggcctcatggaatgagtttggaagtatttcctctgcttctattcaatgactgagaattggtatagttttttccttaaatgtttggtagaatttaccagtgaacttatataggcctgacattttctgttttggaaggttattaatggttgattcaattttaaaaatagaaataagtctgttcagattatttttttatttttatttttttggagacggagtctcactctgttgcccaggctggagtgcagtggcgcgatgtctgctcactgcaagccccacctcctgggttcacgccattctcctgcctcagcctcccaagcagctgggactacaggcgcccgccaccatgcccggctaatttttgtatttttagtagagacggggtttcactatgttagccaggatggtctcaatctcctgacctcgtgatccacccgcctcggcctcccaaagtgctgggattacaggtgtgagccaccatgcccggcctgttcagattatttttgtgtgagctttggcagattacgtctttcaaagaattagttcatttaatctaggttatcaaatttgtgggacttgagttgttcataatatttttaagttttaatttccattggatctgtactgatgccctctctttcatttctgatactggcaatttgtgtcctctgtctttttttcctttattagcctggttatagtgttaccaattttattcatcttttcaaagtatcaacttttggttttgctggtttttctctcctgatttcctgttttcaaattgattgatttatactttcctatttttgcatattaagatttaatttgctaaaggagatttaatttcctaagaagcaaacttagattattaatattagtttcttttcacttctaatatatacgcatttcaatgctgtaaatttttgtcaatgcactgcctgtgctgcgttctacaaattttggtaagttgtatttttatcttgaaagtatttttaaatttgtcatgagatttcttctttgactcatgtgttattagtaatgttggttaatccttacatgttttgagatttttttcaattatctttctgttattgatttttagcttattctactgtggcctgagagcagacattgtacggtttctattcttttaactctgttaaggtgtgttttatggcccagaatgtggtggcgtattttggtgaatcttccatgtgatcttgacaggaatgtatattctgctgttattggatgaagcatagttcacccttgaacatgagtttgaactacatgggtccacttatatgtggatattttaaataaaagttacatcagttatgcctgcctctccagcctccccttccacttcttccctctctgccatcggtgagataggaataccaacctctcctcttcctccctgtcctcagcctgctcaatgtgaagatgagggaggatgaagaccttaatgatgatccacttccatttaatgaatagtaaatatatcttctctttatgcttttcctaataacattttcttttttttggcttactttactgtgagaatacagtatataatacatataacatacagaatacttgctaactgatggcttgtcttatcaataaagcttctggtcaacagtaggctattagtaattagctttctgtggaatctaaagttatacataaattttcaagactgttgggggttggcacccctaacacttgctttgttcaagagtcagctgtagtctgtagatgttaattatcaactgtacactatagatgttaattatatccaatttattggtgttgagttcaaatgtatctttactgatttttccatgctagatctgtccacctctgatagagggatgttgaagtcatttttgatttccgttacagtgttttgatatctaacatttctttttggttcattcttaggatttccatctctttgcttacattgcccgtctgttgttactacatgctatctactttctccattatgatgcgtagcatattaatcataattgttttaaattcattgtctgataattccaacatcccgtctacatctggttctgaatgttttctttcttcaaactgtagtttttgccctagagtatgccttgtaattttttcttttcttttcttttcttgttttttttttttttttgagacagggtcttgccctgttgtctagtctggaatgcagtggcgtgatcttggctcactgcaacctccacctcccggactcaagtgatcctcccacctcagcctcctgagtaactgggactacaggtgtgcaccaccatgcctggctaatttttgctttttttttttttttgggggtagagaccattttgtcttgttgcccaggctggtcttgaactcctgggctcaagcagttgacccacttcagcctcccaaagtgctggaattataggcattagccactgtgcctagctgtaattttttcttgataactgtatatgatatatcaggtaaaaaagcaattggtttaaatatgtctttaataatgtaattgtaagatgtacgcgggagtgatgtgttgtatagtcctgtgattaggtctcagtctttttgtgagtctatgtctctggcccatgaattcacaagcatttctcaattttttcctccccctttaggtgggataggatggctagagtaggatggaattgggtatttacctcctcccatgtggaaggatagagctggctggagttggatatttccatcccccaggtcagttaggctttgatgaaacctcagcaggttaggctctgcttaactggtttcttttcagggtagatcttattaagaagtacagagtgctctgggatatttcagaatggtttgtttccccccccgccactgctggaaacatgaggggattttactgcgatgatatgtatgatactgtatttactgtgagaacctgatctagctcctggaggtaaaattcacaaaagcatgggggcccccatgactggatgcccctggagctttcaactctcagtcgtgcccacacctagtttccagcagtttgtcagcagtccaggttttcctatctaggcactgcttcctgtagaaatttctgttccagtatgttgtgattctctgtatccctgtctgtctgtttaattttaggagtagcagttttcccagtgaccctacctatctcaccttttcttacagatctgagaaaagttgttgatttccactttgttcagctttttaatatgtgttaggatggcatagtgacttccaggctccttacatgtgaaaccaaaacctgaagtccccatattattgttttaaatcttttgttcttttgtaatatacttttagagataaagatttctttctaagcattgctttatttacaaaccacaaattttgatatgttttgtttattatttagtgaagcatatttacaacatttcctcgtgaatcctagtttgaaccatgagctacttagaagcatgttgcttaatttccacaaatttgaagatttccccaatatacattttatttttttcttggtacatagtatttgtatatgtttactggtgtatgtgtgatattttgtcatatgcctagaatgtgtaatgatcaagtgtaggtatttaggatatcgatcacctcaaggatttatcatttctgtgtgttgggaacatttcaagacctctcttctagctattttgaaatatacaatacatcattaactgtagtcatctgctatcaaacattagaacttatcccttctatctaactgcgtgtttgtacttattaaccaaactttctttattcttctatccctaccacatccttcctagcctctggtatctatcattccactctctacctccatgagatcaactttttttagctcctacatattaacaagaatgtaaaatattttctttctgtgcctggcttatttcacttaatagaatgacatccagttccatccatgttgctgcaaatgacaggatttcattctttttttatggctgaatagtatcccattgtatatactgcattttcttgatccactgatggacacttaggttgattccatgtctttgatgttgtgatagtgctgcagtaaacttaggagtgcatgttaattcctttcttttggataaatactcagtggttcctgcaatatattttgttactgatttctaatttaattttattggtatcagagagcatactctgaatggtttcagtccttttaagttgattgacatttgtttcattacccagcatatggtctgcctggaaatgtttcatgcatttttaaaagttatgtgtatcctatagctgttgggtgaagtgttttataaatattaggctgaattggttgatagtggacttcaagtcttttagaccctgacagattctttctctacttattcaatcaactactgagagagaagtactgaaatctaaatattattgtagttttgtctgttttattcccttttgttctattagattttgtgatttttttaaaaaaagttctattattatgcaaatatacatttagaattgttggatctttttgatgaattgacccatttatctttatgaaatgtctctctttattgcttagaaaatactccctgtgccaaagggagttgttgcttgacattaatacaggcatatttgcatatagtatttttattcgaagttcctagagcagtcaaatctgtagggacccaaagttgaatggtggtttctgggggcttgggggagggggaggggagatagggagtagtgtttgagagatagagttttaattaggaaagatgaaaaagttctggagatggatggtgctgatgattgcacaacaatatgaatgtacctaatgcaacagaactatacattttaaaatggttaaaatgataaattttatgttatgtatattttaccacaatttaaaaaaagacatagcaccaaaaaaagatgatgaatgaataaattccaaaaagctgtgccaggagtgataatgtatagtttgtttagaatcattgaagccttcattctttatttaattgaagcagttaaaaataaatattaatttgaaataaaaatcagcagctagattctattatattttattcaaatttggaatttttttttttttttttgagacagagtctggctttgttgcccaggctggagtgctgtggcacaatctcgcctcgctgcaacctctgcctccctaactcaagccatcctctcaccttagcctcctaagtagctaagctacaggcatgcaccaccacacccatgtattttttcgtagagacggggttttgccacattgtccaggctggtctcaaacttctgagctcaaaccatctgtcctccttggcctcccaaagtgttggaattacaggcatgagccactgtgcccagccaaaaattatttaaattatagcagaaatacagtttcctatttgggtctcacgagaatgtgtttattctttgtttcagcaagagaaggcagctgctgtggatttgactaaccacttagaatacactctgaagacctatatagataccagaatgaaaaatctggcagctaagatggaaatactgaaagaaatgaggtaggtaaaagcatatttttcagaaggatattttaaactaatttttaatcaattggtgctttgtttaaattgtgtgcttgccatttttgctttaaaatttaacctttgtatttttatgacttcaaagagagaaagatagttatttctgagatgaattttatactgtttttgtcaggtttctactgtcactgcttggagctagagtgttctaaggttataactgagactgaaattgaaaaaacagcaacatagcttttaagtgatagtttgatgggaaactaccatatccagttattttgcttggggttattttcaggagtacagcatgtccttgaataacgtgttttcattcaacattatttcattataacattgaagaagaaaatcaattcctagctggagccccactgtctgtgtggagtttgcacattctctccatatttgggtggttttcttggaatactgtggtttcctctcacatcccacttaggtgaattggtgtgtctgtattgtcccagtatgagtgagtgtgtggatgagggtgagtgtgccctgcaatgcaagggtgtcatgtccaggattggttcctaccttaatgctctgagctgctgagatagatgtggccacctgcaacccctggattggaataagcgggttggaaaatgaatgagtgaatgagtatatacagattatcataaaataaaaatttgtgaagtatgcaagaatcatacagatgcctttgcaataagcgatgtgacatgaaagcattcagcaagcccactacgtttgttattgtttgtttttgaacctgtggtggtagggggcgcttcttagaattttcgcttgcaaacatttattccttgatttaaccctactgtcacccactcattcaccaaagtttgggtaaataattatctttgttgtttttattgctttttcttaaatgtgtgtataggacacgtatattttagtgtttaatattagaaatgttttgggtctttatttggaagtgctgtttttgtgactaaaaatatgccataggaacttaactcttgtttagatcaattagcctatgatactatgggtttcttatatgtcttttctcttagacattgtaaattatctgtagaccaaaaattgaaggttcatttgataccatttcaaattctgcagactttcgaagttgccttttttatagtttaaaaaatttttaattttttcatattttttatgtcatgaaattagtatatccacagttgttttttaattaaaagtttatattaaattatgcatgtctgcataaaaatatgtggactgaaaaaaataagttatacatgattttatataaagttttaaaaggtaccccttcaaagccagtgctgtaaacactaacttttagaccattactattaaagtgtaactttttctcacaccagctttctaatttattgatcttcttctttttgatgtttttaaaaataggcatgtcgacatcagtgtccgtttcggaaaagacctttcagatgctatacaagtgttggatgaagggtgctttactactccagcttctttgaatggattagagataatatgggcagaatacagtctggctcaggagaatattaaaacttgtgaatatgtggtgagttgggaatttttctctattgtggtttttatctgttgaacataaggaagtgtttttttaatttcttctaaaaaaaataacaggatacatgtgcagaatgtgcagatttgttacataggtatacatgcgccgtggtagtttgctgcacctgtcctctaaattccctccctcacccccccatttcctaacgagccctggtgtgtattgtttccctccctgtgtccatgtgttctcaatgttcaactcccacttacgagtgagaacatgtagtgtttggttttctattcttgtgttagtttgccgaagatgatggcttccagcttcatccatgtcgttgcaaaggacataaactcgttcctttttatggctgcatagtattccatggtgtatatgtaccacattttctttatccagtctatcgttgatgggcatttgggttggttccaagtctttgccattgtgaacagtgctgcagtaaacatacgtgtgcatgtgtctttatagtagaatgatctatattcctttgggtatatacccagtaatgatattgctgggtcaaatggtatttctggttctagatccttgaggaatcgccatatcgtcttccacaatggttgaactaatttacgttcccaccaacactgtgaaagtgttcctgtttctccacatcctctccagcatctattgtttcctgactttaatgatcgtcattctaactggtatgagatggtatcttcttgtggttttgatttgcatttctctgatgattagtgatgttgagctttttttcatatgtttgttggccacataaatgtcttcttttgagaagtgcctcttcatatcctttgcccactttttgatggggttgtctttttcctgtaaatatgtttaagttctttgtagattctggatattagatctttgtcagatgggtagattgcaaaaattttcttctgttcaggagaacaggttgcctgttcactgtgatgatagtttcttttgctgtgcagaagctctttagtttaattagatcccatttgtcaattttgacttttgttgcatttgcttttgttgtttttgtcaagaagtctttgcccatgcctatgtcctgaacgctattgcctgggttttcttctagggtttttatagttttaggttttacatttaagtctttaatccatctagagttaatttttgtgtaaagtgtaaggaaggggttcagtttcagttttctgcatatgtctagttttcccagcaccatttactgaataggagatgctttcccaattgcttgtttttgtcaggtttgtcgaagatcagatggttttagatgtgtgatgttatttctgaggtttctgttctgctccattggtctatatgtctgttttggtaccagtagcatgctgttttggttactgtagccttgtagtatagtttgaagtcaggtagcatcatgcctccagcattgttccttttgcttaggattatcttggctatatggggtcttctttgaatccatatgaaatttaaaatagttttttctaattctgtgaagaatgtcaatggtagcttgatgggaatagcattggttctataaaattttttggccagtatagccattttcatgatattgagtcttcctatccatgaggatggaatatttttccatttgtttgtgtcctctcttatttccttgagcagtggtttgtagttcttcttgaagaggtccttcacatcccttattagctgtattcctaggtattttattctgtttgtagcaattgtgaatgggagttcattcatgatttggctctttgcttgcctcttgttggtgtgtaggaatgcttgtgatttttgcacatttattttgtatcctgagactttgctgcagttgcctatcagttcaagacgtttttggggtgagacgatggggatttctaaatataaaatcatgtcgtctgcaaacagacaacttgtcttcctctcttcctatttgaataccctttatttctttctcttgcctgattgccctgtcgagaacttccaatactgtggtgaataggagtggtgagagagggaatcgttgtcttgtaccagttttcaaagggaatgcttccagcatttgcccattcaatttgaggctgtgggtttgtcataaataactgttactattttgagatatgttccgtcaatacttagtttactgagagtttttaacatgaaggcatgttgaattttatcgaagccctttctgcatctattgagatagtcacgtggtttttgtcattggttctgtttatgtgatggattacgtttattgatttgcgtatgttgaaccagccttgcgtcccagggatgaagtggacttgatcgtggtgggtaagttttttgatgtgctgcgggattcggtttgtcagtattttattgaggattttcgcatcgatgttcatcagggatattggcctgaagttttctttttttgttgtgtcttttcccggtttgggtatcaggataatgctggcttcataaaatgagttagggaggagtccgtccttttcagttgttgggaatagtttcaaaaggaatggtatcagctgttctttgtatttctggtagaattcggctgtgaatctgtctggtcctgggctttttttggtcggtaggctgttaattactacctcaatttcagagtttttgttattggtctattcagggattcagcttcttccagaaggggtggccagcccctgcacacctgtgggcgtttctcgtcaggtggaacgagagacttgagaaaagaaagagacacagagacaaagtatagagaaagaaaagtgggcccaagggaccggcgctcagcatgtggaggacccgcgcccgccggcaaaggtctctgagttccctcagtatttattgatcattatctctaccatctcggagagggggatgtggcaggacaatagggtaatagtggggagagagtcagcaggaaaacatgtgaacaaatgtctctgtgtcataaacaaggttagaaaatgtgctgtgctttgatgtgcacatacataaacatatctggtgcattaaagagtagtattgccgtcagcatgtctcacctccagccttaaggtggttttctcctgtctcagtagatagaacatacaatcgggttttacaccgagacattccattgcccagggatgagcaggagacagatgccttcctcttatctcaactgcaaagaggccttcctcttttactaatcctcctcagcacagaccctttatgggtgtcgggctgggggacggtcaggtctttcccttcccacgaagccgtatttcagactgtcacatggggagaaaccttggacaagacctggctttcctaggcagaggtccctgcggccttctgcagtgttttgtgtccgtgggtacttgagattagggagtggtgatgatttttaacaagcatactgccttcaagcatttgtttaacaaagcacatcctgcatagccctaaatccatgaaaccttgagtcgacacagcacatgtcgtagggagcacagggttgggggtagggttgcagattaacagcatctcaaggcagaataatttttcttaatacagaacaaaatggagtctcttacgtctacttctttctgcattgacacagtaacagtctgatctgcctttcttttccccacactacctggtttagtcttggtagggtgtaggcatccaagagtttattcatttcttctagattttctagtttatttgtgtagaggtgtttatagtattctgtgatggtagttggtatttttgtggggtcagtggtgatacccctttaacattttttgttgagtctatttgattcttctctctcttcttcttagtctagctagtggtctgttttgttactttttttaaaaaacagaccctagattcattgatttttttttggagtgttttttttgtgtgtgtgtgtctctgtctccttcaattcttctctgatcttatttcttgtcttctgctagcttttgggttcatttgctcttgcctttctagttcttttaattgtgatgttaaggtgttgatatgagatctttctagctttctgatgtgggtatttagtgctataaattcctctcttaacactactttatctgtgtcctggagattctggtacattgtctctttgttctcattggtttcaaagcacttcttgatttctgccttaatttcattatttaccctggagccattcaggagcaagttgttcagtttccatgacattgtgtggttttgagtgagcaatactaaccttaaatgtaaatgggccaaatgccccaattaaaagacacagactggcaaattagctaagtggtcaagactcatctgtgtgctgtattcaggagacccatcttccgcacaaaaacacatacaggctcaaaagaaagggatggagggaaatttaccaaacaaatagaaagcaaaagaaagcagaggttgcagtcctagtctctgataaaacagactttaaatcaacaaagataaaaaaagacaaaggcattacgtaatggtaaaggaaacagttcaacaagaagaggtgactattctgaatatatatgcacccaaggagcacccagattcataaaacaagttcttagagacctacaaagagacttagattcccacacaataataatgggagactttaacaccccactgtcagtattagatcaacgagacagaaaattaacaaggatattcaggacttgaacttagctctctatcaagtggacctgatagacgtctgcagaactctctaccccaaatcaactgaatatacattcttctcagtgccacatggcacttattctaaaattgaccacataattggaagtaaaacactcttcagcaaatgcaaaagaactgaaatcataacaaacagtctctcagatcacagtgtaatcaaattagaactcaggaaatgttatctttctagaaagacaaggaactggagatattgtaatgatagtttgtgtaaaacctttaacttttacagtatcttcatattaataatttccttcatttattgccttataagaaaggtgtaatagacaactggtgattgtggataaggggtagcaaaatcttttccctttttgcatgaaaactttacctttggttaactccctctctttgttcccttggtaatgtgataaaatatttcaactgtgttactaggcaacattatttatggtaagtataacttatgattgtcaaactgcatctgtactgggagaaactacaaactacaaatacttgatgtggactcttgtaactaaacatgccccttgagggaccctggaagctatacctatggagttgttacaagagatactggcttttgagggacattaggcttgtaaaccagagtggctttcatacatgctaatgtggaacttttctggtctgagtggtgtgttttatgcatgtaagactctgccttactattaattagtgtctgagtcacctattgttgggaggtagttgtttgtgtgtgtgagtaggggtgtgaaaatgaaatattttacataaattctttattagcttaggtacaagtatatttatttcctgttgcagttttctttaatttattgtattgggctgaacagaacttcctgtttttcttgtaaaccattccctacaaccaccataactttccctagcacctgtgagctctatacttgttgtgtttggacttgttccatcttaaatatttgtggtttctgcctctgtggattataccctgtaaatcttactccctagtcatacctaggttgatcagttggcagcctgactgcctctgaatgagaagtatgagcaggataactaggcttttgaaaatgccaggaatgtttagtttggagaagggatttgattttggttattttacgtattagattctaactgatcacttctgattatgggagaaagaagatgacagcagaatgattaattttttaatttctatgaaacacaggcagtgtgtttataaacattttcttacattaacttttaaaatgggcatatttgctcccattttataagtgaggaaacaggcttacaagggtaaggaaattgttcaagattacctagttgtaattttttaaaattaaaaaattactcttttttttgaggtatggtctcactctgtcacccaggctggagtgcagtggcacgatcacagctcactgcagcctcaacctccagggcacaagagattctccacttcagcttcccaagtagctaggactacaggcggtgtactaccaaccatgcctggctaatttttttgtactttttatagtgacggggttttaccatgttgtccagacaggttttgaactccttggctcaagtaatcctcctgccttggcctcccaaagtcctgggattgcaagtgttagctaccatgcccgtaccctagttctaaatgttaatatggaacttgaacccagacatgtctgacagcaaagcctattgtttttccattgaaaccacactattgatattaaaatacttcttaatgtattttcatgtaagatgaaaagatgtaaaaaaacctgccttatttgtttttgtggtttgagcatagtgaaagtattcaggatggagctttagcacttactatcctatgagtacagatgtgactttttttgaaagcagaattttttttttctactactgcttgtgtttccggacttaaagtttacttgatagatggaagtgtagattattggctaaatatataatcataatagccactcaaatgaaatcgtcattttatttcccttattgtacttattttggtttagaattgataacttttattcaagtattttgcatagttctttaacttgattgccatgtggccatatgctttttttttttttttgagacggagtctcgctctgtcgcccaggccggagtgcagtggtgtgatctcggctcactgcaagttctgccttccgggttcgtgccattctgctgcctcagcctcccgagttgctgggactacaggcgcctgccactctgcccagctaattttttgtatttttagtagagatggggtttcaccatggtctcgatctcctgacctcatgatccgcctgcctcggcctcccaaagtgctgggattacaggcgtgggccaccgtgcccagatgttttttttttttaatgatgaaaacagtaggctttacttgaggtcttttcttttttatttatagttttaaaataatctggttgagcttatgcaagaaaaaatatcctaaaattcaggcttttatagttttatagttttataatgtattttatagttttatttatagttttaaaataatctggttgagcttatgcaagaaaaaatatcctaaaattcaggcttttatagttttatagttttataatacattttatagttttatttatagttttaaaataatctggttgagcttatgcaagaaaaaatatcctaaaattcaggcttttaagtgtatgtgccagacactgttataggtaatagagattaaaacttttttattttatttcattttattattattttacttttagggtacatgtgcacaatgtgcaggttagttacatatgtatacatgtgccatgctgctgtgctgcacccattaactcgtcatttagcattaggtatatctcctaatgctatccctcccccctccctccaccccgagataaaaatttttaaaagacatatcctttctttctttcttgggtacaggatggatatattaatatatagttttaatacagtatggtaagtgctataataaagaaaatgcatagagttcttggatatctttcacatatgtatttccaaacacagcctgttggacaaattggagggtttatcctggtgtttaagtgtatcttgaaggatgagtagctgaaggagttgagaatgggatgggaatagaaaagaggccatatgtaattagtaggaacttatataattttctgtaagaaaaacaaaaatttcattgttgcagaaataatgggaaaaataaaaattagatcagagttgttgaacttaaatgttttatttttaattaagagaaaggaagtttttttgtcattttgttgatctaaggagagaaatgtcctaagtgctataatgtttggagaatataaagttaattttggagatcactttttttcatataggtcatatgcggaaaagacctgatgtattaatgatggttattctttttttcttcctccagagtgaagggaatattttgattgcccaaagaaatgaaatgcagcagaagctgtacatgtcagtagaagattttattctggaagttgatgagtcatctcttaataaacgcttaaaaacattgcaggttggaattaaaaatatattaaatatacgttaaattgtaagtttatttaagaagtgaaattagcatttaccttaagactttagattgttctgtgatggttgcaaaagtttttcctgtttcctgaattctgatttctttttaatgggattaaaagtttatattaatatattttgtggctatgtttatatgcatatctatcttgcaaacaaggtaaaatggctagggactccagtattcactggggaaattaatggagacaggagcagtagcaggtatgtgggtccctatcgtccattgcattctagcagaaaatgtagtaggaccacatgttacagggagaagggatcaactctgatccataaattatagggtttttaggctccatgaccagggaagtttctccctgatgtgatcagaggctagagtactgtagtacatatagctatatgatatggtggaatcttgtcttcagctctgtcttgccagctcaggaatgactttaattcggggtgaatgaacatgacagtgttaagtaatttcacctaataatagtgtttctctctacttattcagatctttttttgtcctttaatattgtttaaaatttttctctataagtcctcatgcttttttcttcatttaacttttatttatttatgcttttgattgcttttatgaatattatcttgtcatttcctagttttgattgaatagaggaatactgttcatttttatgtactggtgtttctctgataactctgctgatctctcttttagttctcatttgtctgttgatactctgctttctgtgttttcaaatgttttcatttgaaatgttttcattttctaatgttttcatttgaaatgttttcattttcaaatgttttcatttcattttcaagtgttttcatttgaaaacaataactctttaatcttttctcttctagtccttttaccttttatgtatctttgaatttttactgctttggtcagttaccctagtactaagctgaccagtagctaatatcgatcttgttgtggactgcagggagtaagcttgctagaaatttggagaagaagatattcagggacatctgggcattgtttctttctgtcctgctggatgaagatgtagttttgatgatgcaccacatggcttaagaaccattggagccctggtttgaaacattttcttaattggaattgcataaatagtataagttcttccagaatgttgaagtaagccttgcatataaaagggcagtaatatagtaagaatttagctttccacaatgcagcttctactttgtcccttaaaggtttatttcttctcactgttagtaaatgtaggttaaggttctgtaattaagatcatctttaaacctcttttcttttaaaagttcaatgctagaagactttttgccttaactggcttgtctccacttctagtattccctcaggtcaccaaaatattctttaaacttctctttattttgctgagaaatagtttatatttttcaagtatccaagaaagatatttctataatgaaggtcaaataaatgaaagttcttgatttctgatttcctcagcattttatttagacttcttttgtggcatacaatacatgtttgattttttgtgactggtcttcttaagttcaaaaagaaattgtattctcggttttcttggtgtacagttttagatatatctaaaacttgcttaggttttggttggttcagtatatcagtctttgagatatttttgttacatatatctgaaatagataggtttgtccctatttgtccctattgttcttttggttcttgttcaaagtatttcagcgccacattgttgggtgttaaggtattcatgattgtaatgtatttaaaaatgtgtatcccccccatgacacatgtttacctatgtaacagaccttcacatgtacctccaaacctaaactaaaagtcaaaaataataataaaaatgttttctttttaactactatgtaatcttattttttcacttagattttaaaaaataaaaatttttttgtttgccttttaagttcgtatcccacctttctttttggttaacactgcaacatcttttctttttttctatttttattttatttatttttatttttcttgagatggagtctcgctctgtcgcctaggctggagtgcagtggccgatctccgctcactgcaacctctgcctcccgggttcaagcgattctcctgcctcagcctacctagtagctgggattacaggcacacaccaccatgcctgtctaattttttgtattttagtagagatgggtttcacgatgttgcccagggtgggctcgaactcctgagctcaggcagtctacccaccttggcctccaaagtgctagatttacaggtgtgagccaccgcacctggcttctccctttatttttaaccttttgtattcacgttttgaaataacctcttgataacacactaatggatttaatttttgaaagcacccaacgtatatcttttttgttggtaacttaatttacatatttataattactgttttattaaaacttatttctgtttatcatcgtttctttttctctctttttctaacttacacctcttatacttttttttttttttttgagatggagtctcactctgttacccaggttggagtgcagtggcacagtcttggctcactgcaacttctgcctcctgggttcaagtgattctccttcctcagcctcatgagtggctaggattacaggcaggcctggctaatttttgtgtttttaatagagatggggtttcatcatgttggccaggctagtcttgaactcctggcctcaagtcatccacccgcctcagcctcccaaagtgttgggattacaggcgtgagccactgtgcccggccactcttctaatactttagaacattcttatctgcctttggtgtctttcctctctttctctacctccttccccaaaccaaccagtgaacctaccacaattgtctaggattttagtcacgggttattatagatattgtgtgtgatagctcagttaaatagactttagagttatttttccattcttatttcataagtcgtttatctcttggctttctctgtatattggaatattttctctaagagtgctttcaaagaaatctttgtgtatttgattttgcgagttatttgatatttcaggatatctcatttcaatctcaaatacaaatagttgtttagctgactataaaatagcaagttcaaaggccatgtttcctttacacctttgacaataataatctattgtttcatttctatcattttatttctttatttatttgagacagagtcttgctctttcacccaggctggagtgcagtggtgccatctcagctcactgcaacctctggctcctgggttcaagcaattctcatgcctcaacctcccgagtagctgggactacaggcatgcaccactgtgcccggctaattttagtagagatggggtttcacgatgttggccgggctggtctcgaacttctgacctcgagtgatccgcctctcttggcctcctaaagtgctgggattacaggtgtgagccaaagtgcccagccttcttatttccataattgttatcagtctaatctttgttcttctgtgatcttttttccctctggaagttttaaaattttctcttgactttgttcttaagttgcatcagaacatgtttatgttttgactgaatctgagccagttcagtctgaggttttatatatttctttaattgtaggtaatacttgataattatttattgagatacttctctcccccattaattttttctcttattctgagacttctgatagatatttcagcttctatttctgttatctacatattttaatggctaatctattgtttaaaatctttttatcttatgtaggaggtgggttaaactaaataaataaatacaatctttttatcttgttggtgtctttttggagggatccttgacttaaccatgtagctaatgaattaatcctctagctgtgtcccttctgccatttagccaatccattgcattttgtatgtcaaagattatttcttttatatttaatatcttcagttggttattttttatttataagtacttggcttttgtgtttccaatattctttcttttgttgagaatatttattatgcttatttttgagttcttactgttatctgggccattgacactgattttgcttcctttttataaagtggcttagttttttatacttctttcagagtgcttgtgctgttcacaccattttatcctcttcttatctctcctcaagatctcatattcccttggaactataagctaccttagttctttgctgttgtgtagttatatgaagggcctagggaagagtgaaagtctggaccacaacttttaagactttggataggtttagggaatagaatggggttatttttatttttaagggtctagcttctgatgttgccatctgggattatctacttcctctttgcttctctcctgggtggtctgtcctactcttcagcaaacctctattccctctgcctcagctactgctcctttccaggcactaccacccttagatgtaaatgctgccagatattcaggggagaagtgaaggaaagagaatggtcaggggctggccagctcttctgtattggttatcagtttttgcctcatctgtgttcttgtgctgtacttgcataaacctgttgcctcttgatggtgctgctgtttttctttctgatgtgagggagagagaagagcctatgaaaaaagttttcttttcccacaggtaattctgtgctgtgacacagtccttctttcacttgtagggactttgttaattcaatgctaaacaccaaccatcctctgcctaagatttctcagagttttgtgattaaaaacttctgagatctcttaagctttttttcttatctctgtaaaatttctagggtttgatttctggagagagctagcaggctgtgcctatcttgtcttttccaattctttattacattaaaaaattttattgttactgttattttttttttgtgcacctgccccgacaaacccagccaggccaattcattaaaaaaatgcctttaagtacagtcaagggctgcatggtttggtcagtgatggactgcatatatggtggtggtgccataaaattatagtacttaactgtaccttttctgtgtttacataggcaatcattgttacaattgcttacattattcagcacagtaacatgctatatctaggagcagtaggctatagcatgtagtttggttgtgtagtaaatttataccatctaggtttgcatcagtacactccatgatgtttgcataatgatgaaattgcctcacgatgcatttcttagaagatatccgtgttgttaagtgatgcatgattgtccatatatatgtttaatgtctttacttaattagaattatttgtatattttagcgtgtagtttatttttatttggcaatcggtcttagaaactttcatgccaggacaaacagtagtgattcttatgatagacaaaggagactcagaagggtgattaggggtggagagtggtggatgttgagaaattacttaatgggttcaatgtacatttggatgatagatacactaaagcccagactttaccactacacaatatatccatgtagcaaaattactcttgtacttaataaatttatacaaaaagttagggaaaacagggtaatgtctacttaattaaaaaccataaggatataaagctttctatttgtaactaattcacttaataaactttactgttatggtccaaataaaccaccttctaggtagttttgtgttttcatctctatctgatgattctaagttgtatttatgaaattctcaagaatggggattcagcatactgcttttctaccccttagatcctaacacagtgctcgaatcctgaattagttaataaactttaataaacagaagtatatctctctgcaggatttgtcagtctctttagaagcagtgtatggacaagccaaagaaggagcaaattctgatgaaatacttaaaaaattttatgactggaagtgtgataaaagagaggagttcaccagtgttagaagtgaaacagacgcttctctgcaccgtcttgtagcatggttccaaagaaccttaaaggtaataaaagctcctgcccggttgtgtttgtagcataaaccagggaatatatattttaaaaatcacgcgctttgttcaagagctgacatcatctacctactatgtatcagatttaaaattgccaccttaccagtcaaggttctttattagcttttagtcagattgctccttttattagtctcaaaaaaatcatatcggtcttgttcctcctttttctcagcttttcctaaggattgtcctctttcctcttttaaccatttatttattttcttacagtatgctatgtgtatgtaccttttcctttcagtgcataaattttatgagggtaggcacttttttttcctgcattcctagttcttttacattgcccagggtatagcttaatactctgcttcaggtattaaggcacgatgaatgctgattgaattaaatgagatatttcatgtgtttatttttgcaaatgaggtttttgacctatctgtggaaggatcactgatttcagaagacgcaatggataatattgatgaaatcctagagaagactgagtcaagtgtctgcaaagagctggagatagctctggttgtgagtatcgatattctttattattgcctcctttgaagcagtgtggtttcctttcatggttagaaagtattaaccaataatagagtttttcttgctagttagaaagtattaagactgatcttagctttcttctaataggcttgttgaaagagtaacaatgtctagttctaatccagacaccatgcaaagtcttattcttaggtgacatttttgttttaataggacatttcacataaaaaatctgtttaattctaagaaaactgctcttaatttgagtggacaatcttgtctatattttgattcttgaatgcgtcataccaaatgactataagaagagactccttagagtttgtgaaaacttaaaatctgagagagctctgaaagttgacacacaagatggagtggtcatcctctttctttctccattgtgtatattctttgttacagtgtcaaggtaaaaattagtgtagctactccaaagggtgttttgtaattttaattattgctcattgggactcttcccagttattcaggctgctttccaatgtttcagtggttaggcttctcattttacttgttttttcttttttttactttttataattttactcatattggcattaaaaatacattaagaagttttatattgttaaatagtcctgatgtagatagttttgtcagacttgattttagtagtagttgttaacaggtgatttctaaaagtaaagtgttgaaggtctatatattgtttatagttcttatatttagcatattagtatccctgatttccattaatgctcttattctacacagctttgggaataatggtgtaatacgggtaaagtttcccatatgaatggctttgctttttttagagagacagtgtcttgctctgtcgcccaggctggagtgcattgatgtgatcctagctcactgcagccttgaactccttaatctccctgcctcagcctcccttgtagctaggactacaggtgtataccactgtgctcagctaattaaaaatttttttttagggactggtctcactatgttgcctggctgccatatgaacatctttgatatctatctatcttctgactaggaaaacatttgtgtttaagaactgttttgaaatcactgcggaaatctgttaaaggcataattttgaagtttatctattgttattggaggccttagctgttttggatattcctttgtgtataattctatgtgtgtgatttcatttaggatcaaggtgatgcagacaaggagataatttcaaatacatatagtcaagtactgcaaaagattcattcagaggaaaggctcattgccacagtacaagctaagtacaaggacagtattgaggtttgattgtgctttctcttattgatcttataaattgatgatttgaatttttcagtacttaaatttttctattgttgtttaatactcagtgtcagtaaattgttattactagaattcactgtcaactggaaatggtgatttttgatgatataaatatatcaaattttttattgttttaaatattttattatgtccatgagaaccacaatttttaacatcattttctttttgcctgtatgagtctactgtagataatttgctatatacagaaagataagaaataaaacattgcttataattcccttagcctaagagatagttttagagtatttactcactggatgtgcatctgtatgtttgtgagcatatatatatgcattgcattgttttttaagttacttcaaacatactttcttcatttaatggtatattatgaacatttttctatatgatttttctatactgtcatcttgagtgactaaatcctcatccctatgtagatgtacaacaacattaacctttcatgtgtgttggacattaaggttacttccaatttttcctaccataaataacactgtacatatgtttgtgcataattttttgtttttatttctcagatttctaaattctataattactgagttaaaaggaatggacattattaattaaaacttgatacatattttcaaaccacttttgggaaagatgatttcagtttacatcctcactagaaattcctttttcatccatactaacaatgtgtgttttattgtatgtctcagtttgaaatattacttttgtctttgttactttgagtgctggaactgatattcttctaaatagaaacatggattaaaaaggaaatctattgaattgtcttgttgaaaattatagattttcttggtatttcagtctgaactcagtaaatactagttgaatcttaacagagaaataataaatgatcactgttcaataaatacttttcttatgtgtttgaaaatacgtaacttttgtttacttagtttaaaaagcagcttattgaatatttaaataagagtcccagtgtggatcacttgctatccattaagaagacattgaaaagcttaaaagctctactcagatggaaattggttgaaaagagtaatttggaagaggtaaggaaacagttgtttcttactgatctttatgtgcatctcattttacttggtctctgcttcataaaaataatgcataaatacactctttacaataagagagccattacattcacattttgttttatatactttatcttgttttctgtgtatataaataaaattgagattacagtaatagtgtaaaaattttcctatatcattaaatattctttaaaaacattttcctaggctgccttggttcttagtaacatgaacattttagaataattttaaaagctcttttagtttggactgttagaatgtttattgtaataccaacttgctacatgcaggtgacagggtaccccctcgaaggtagcgttttgtcataaagtatttttaagatcatggtatcttttgttaactccctttttatggatagatgtaatatttcttgcaagtattttaagttgcttttatatgataatagaactggagaggattaggatgccctaatctggactaacttcttcctttaggcttgaaactttgtgaataagatagtaaactttgtgttcctttgaggatttgatttatgtacaaggatctgtattatgccttaatccaatttgaattatctgtcttctacttctgagcactgaattgggggtggagcggaggactattctagaactaatatcatagttgaagaactttctagttttattctattctgggctttggggaagttgatttttttagtctgatttttcaacttttggagaaatctgacttttgttatactttaagttctgggatacatgtgcagaatgtgcaggtttgttacataggtatacacgtgccatggtggtttgctgcacccatcaacccgtcacctacattaggtatttctcctaatgctattcctcccctagacccccaccccctgacaggcccagtgtgtgatgttcccctccctgtgtccatattttctcattgttcacctcatcttatgagtgagaacatgcggtgtttggttttctgttcctgtgttagtttgctgagactgatggtttccagtttcatccttgtccctgcaaagaacacgaactcgtccttttttatagctgcataatattccatggtgtatatgtgccacattttctttatccactcaatcattggtgggcatttgggttggttcgaagtctttgctattgtgaacagtactgcagtaaacctacatgtgcatgtgtctttatagtagaatgatttataatcctttgggtatatacccagtaatggtattgctgggtcaaatggtatttctggttctagatccttcaggaattgccacactgtcttccacaatggttgaactaatttacactcccaccaacagtgtaaaagtattcctatttctccacatcctctccagcatctgtggtttcctgacttgtgtgtgtgtgtgtgagtgtgtgtgtgtgtgtgtgtgtatttgtatgttgcctatgttgttttttttttcattattatactttaagttctacagtacatgtgcacaacgtgcaggtttattacataggtatacatgtgccatgttggtttgctgcacccattaactagtcatttacattaggtatttctcctaatgctgtctctctccctgccaccccccaccccacaacagaccccggggtgtgatggtccccttcctgtgttcaagtgttcccattgttcagttcccacctatgagtgagaacatgtggtgtttggttttctgtccttgtgatagtttgctgagaatgatggcttccagttgcatccatgtccctgcaaaggacatgaaatcatccttttttatggctgcatagtattccatggtgtatatgtgccacatattcttaatccagtctattattgatgggcaactgggtttgttccaagtctttgctattgtgaatagtgccacactaaacatacgtgtgcatgtgtctttatagtagcatgatttataatcctttgggtatatacccagtaatgggatggctgggtcaaatggtatttctagttctagatccttgaggaattgccacactgtcttccacaatggttgaactagtttacagtcccaccaacagtgtaaaagtgttcctatttctccacatcctccccactgtctgttgtttcctgactttttaatgatcaccattctaactggtatgagatcgtatctcactgtggttttgatttgcatttctctgatgaccagtgatgatgagcattttttcatgtgtctgttggctgcataaatgtcttcttttgagaagtgtctgttcatatcctttgcccactttttgatgggattgtttttttcttgtaaatttgtttaagtcgtggtagattctggatattaaacctttgtcagatgggtagattgcaaaaattttctccattttgtaggttgcctgttcactctgatagtagtttcttttgctgtgcagaagctctttagtttaattagatcccatttgtcaattttgtcttttgttgccattgcttttggtgttttggacatgaagtccttgcccatgcctatgtcctgaatggtattgcctaggttttcttctagagttgttatggttttaggtctaatatttaagtctttaatccaccttgaattaatttttgtataaggtgtaaggaaggtatccagtttcagctttctacatatggctagcccgttttcccaacaccatttattaagtagggaatcctttccccattgctttcccagttttcccaataacatttattaaatagggaatcctttccccattgcttgcttctgtcaggtttgtcaaagatcagatggttgtagatgtgtgacattatttctgaggcctctttgtgttccattggtctgtatatctgttttggcaccagtaccatgctgttttggttactgtagccttgtagtatagttaaagtcaggtagcatgatgcctccagctttgttctttttgcttaggattgtcttggctatctgggctcttttttagttccatatgaaatttaaagtagttttaaaaaaattctgtgcagaaattcagtggtggcttgatgggaatagcattgaatttataaattactttgggcagtatggccattttcatgatgttcattcttcctatccatgagcatgaaaattttttccatttgtttgtgtcctctcttatttcgttgagcagtggtttgtagttctccttgaagaggtccttcacataccttgttagctgtattcctagataccttattccctttgtagcaattgtgaatgggagttcactcatgatttggctctctgtttgcctattattggtgtataggaatgcttgtgatttttgcacattgattttgtatcctgagactttgctgaagttgcttatcagcttaaggagattttgggctgagacgatggggttttctaaatatacaatcatgtcatctgcaaacagagacaatttgacttcctgtcttcttatgtgaataccttttatttctttctcttgcttgattgccctgtccagaacttccaatactgtgttaaataggagtggtgagagtgggcatgcttgtcctggtgacagttgtcaaagggatgcttccagattttcccattcagtatgatattggctgtgggtttgtcataaatggctcttaatattttgagatgcattccatcagtacctagttagttgagaatttttagcaagaagtgtgtcaaattttatcaaaggctttttctgcatctgttgagatagtcgtgtggtttttgtcattggttctgtttatgtgatgcattctgtttacttatttgcatattttgaaccagcgttgcatcccagggatgaagctgacttgattttggtggataagctttttgatgtgctgctgaattcagtttgccagtattttattgaggatttttgcatcaatgttcgtcagggatattggcctgaaattttctttttttttgttgtgtctctgccaggtttttgtacgaggatgatgctggcctcataaaatgagttagggaggattccctctttttctgttgtttggaattgtttcagaaagaatggtactagctcttctttgtacctctggtggaattcacctgtgtatctgtctggtcctggactttttttggttggtaggctattaataactgcctcaatttcagaacttattgttggtctattcagggattcgacttcttcctgatttagtcttgggagggtgtatgtgtccaggaatttttccatttcttctagattttctagtcgatttgcatagaggtgtttattgtattctgtgatagtagcttggatttctgtgggatcagtggtgatatcccctttatcattttttattgtgtctatttgattcttctttattagtctggctagtggtctatctattttgttgatcttttcaaaaaaccaactcctggattcattgatttttttttgaagggtttttcatgtctctatctcctccagttctgccctgatcttagttatttcttgtcttctactagcttttgaattagtttgttcttgcttctgtagctcttctaattgtgatgttagggtgtcgattttagatcttttccgctttcacctgtgggcatttagtgctataaatttccctctaaacactgctttagctgtgtcccagagattctggtacattgtgtctttgttctcattggtttcaaagaacttatttatttctgccttaattttgttaattacccagtagtcattcaggagcaggttgttcaatttccatgtagttgtgtggttttcagagagtttctcaatcttaagttctactttgattgcactgtgatctgagagacttgtttgttatgatttctgttcttttccatttgccaggaagtgttttacttccaactgtgtggtcagttttagaataagtgtgatgtggtgctgaaaagaatgtatattctgttgatttggggtggagagttctgtaggtgtttattaggtccacttggtccagagttgagttcaagtcctgaatatccttgttaattttccatctcattgatctgtctagtctaatactgacagtagggtgttaaagtctcccactattattgtgtgggagtctaattctctttgtaggtctctaagatcttgctttatgaatctgggtgctcctgtattgggtgcatatatatttaagacagttaactcttcttgttgcactgatccctttaccattatgtaatgcccttctttatttttatttttttttatcttcgttggtttaaagtctgttttatcagataccaggattgcaatccctgcttttttttgctttccatctgcttggtaaatcttcctccatccctttattttgagcctatggtgtgtctttgcacgtcagatgggtctcctgaatatagcacaccaatgggtcttgactctttatccaatttgccagtccttgtcttttaattggggcatttcacctgtttacatttcaggtcaatattgttatttgtgaatttgatcctgtcattatgatactaactggttattttgcccattagttgatgtagtttcttcatagtgtcgacggtctttacaatttggtatgtttttgcattggctggaaccagttgttcctttccatatttagtgcttcctttaggagctcttataaggcaggtctgattgtgacaaagtctctcagcatttgcttgtctataaaggattttagttctcctttgcttgtgaagcttagtttggctggatatgaaattctggtctgaaaattcttttctttaagaatgttgaatattggcccccactctcttctggcattgtacagtttctgcagagaaattgctgttagtttgatgggcttccctttgtgagtaacccaacctttctctctggcttcccttaacattttttccttcatttcaaccttggtgaatctgacaattatgtgtcttggggttgctgtttttgaggagtaggtttttggtgttctctgtatttcctgaatttgaatgttgacctgtcctgctaggttggggaagttctcctggataatatgcttaagtgtgttttccaacttggttcccttttccctgtcactttcaggtacaccagtcaaacgtaggtttggtcttttcacatagtcgaatatttcttcaaggctttgttctttttcattttttttctttaatcttgtcttcatgctttatttcattaagttgatcttcaatgtctgatatcctttcttctgcttgattgatttggctattgatacttgtgtatgcttcatgaagttctcatactttgtttttcagctccatgaagtcatttatgttcttctctaaacaggttattctagttagcaattcgtctaaccttttttcaaggttcttagcttccttccattgggttagaacatgctcctttagctcggaggagtttgttattacccaccttctgaagcctacttctgtcaattcatcaaactcattctccatccagttttgttccgttgctggcgaggacttgtgatcctttggaggagaaaagatgttctggtttttgaaattttcaccctttttgtgctggttttttctcatcttcttggatttatctacctttggtctttgatgttggtgacctttggatgtgtttttttttgtgtggacgtcctttttgtttatgctgatgctattcctttctgtttgttagttttccttctaacagtcagtcccctctgctgcaggtttgctggagtttgctggaagtccattgcagaccctgtttgcctgggtatcaccagtggagactgcagaacagcaaagattgctacatgtcccttcctctggaagcttcatcccagaggggcacctgccagatgctagccagagctatcctgtatgaggtgtctgtcgtcccctgctgggaggtgtcttccagtcaggaggatgggggtcagggacccacttgaggaggcagtctgtcccttagcagagctcgagcactgtgctgggagatccgctgctctcttcagagctggcaggcagaaacattaaagtctgctgaagctatgcccacagccgccccttcccccaggtgctctgtcccaggaggatgggagttttatctataagcccctgactggggcttctatctttcattcagagatgccctgcccagaaaggaatctagagaggcggtctggctacagaggctttgctgggctgcggtgagctccgtggagtctgaacttcctggtggctttgtttacactgtgaggggaaaactgcctactcaagcctcagtaatgacagaggcccctcccccaaccaagctggagtgacccaggttgacttcagactgccatgctggcagtgagaatttcaagctagtggatcttagcttgctgggccccatgggggtgggatctgctgagcaggaccacttggctccctggcttcaaccctcttttcaggggagtcaacggttctgtcttgctggcattccaggtgcaaggggggtatgaataaatattccagcagctagctcggtgtctgcccaaacgtctgcccagttttgtgcttgaaacccagggcactggtgatgtatgcatctgagggaatctcctgctctgtgggttgtgaagactgttggaaaagcatagtatctgggccagaatgaaccgttcctgatggcacagtccctcatggcttcccttggctaggagagcgagttccccagccccttgcacttcctgggtgaggtgactccccaccctgcttttgcttgccctctgtaggctgcacccactgtctaactagtcccagtgagataagccgggtacctcagtttgaaatgcagaaatcactcaccttgtctgttgatctcgctgggagctgcagaccggagctgttactatttggccatcttagtatctggatccttgaaatctgacttttaaagtgtaaaccaaactatctgaggcaggtatcaatcaatttagaaagtttgttttgccaaggttaaggatgcatgcctgggaggcaggtctgtgcctttctcagagatgattttgagggcttaaatatttaaaagggaaaggatggatactggggaaagaggaagaaattttaaaaagatgtgagtagataagagacagatggtttgaattctttaatccttgatcacctttcagcaaatacactatttacatttgagagaggggtagaggaatagtcactagctcagtgaatctgcatttttacatcagaggaaggaatcagatatgcatttgtctcagttgagcaaagggatgatgacttagagttctgtcctttgtcctgcacctgagaaaataagccatcaatttaccttgtcagggtaaaattcaacagaactgttttagggtgaagatcctgagacccataaggaatttcctactgagcaaattgtgagagaggtgtgcagggtttttatggttgtagctatcttatttaggaataaaatgagaagctggtttgcctgacacagttcccagcttgactttttcctttggcttagtgatttaaagttcacaagatttattttcctttcacaaaagcatacatactttttaaggtggcttatgtattatcattggagacagttcacacatttactcatccttttgttttgtttttaactaaatatcatgtagaagacaattctagggaattcaggtgtattctggttgctattattaacatttcttttgttcgaatggcagttggccatctttatcttagagaaaatctacagcagatgaagagacaagaaaaatctgtataattgattttatgtctttactttttgtaattcctttttctaggtttcagaaaagtcattgttagaataaattgacctaagttaattcagcaagtattagaagggtcttttatgtgctaggtactgaaggatacatagaaaccacacagagtaatttactatagaacttgaattcttaaaagaagacttgttttctctatgttaataaaaaacactttttctttctgattcaagtcagatgatcctgatggctctcaaattgagaaaataaaagaagaaataactcagctgcgcaataatgtctttcaggaaatttatcatgagagagaggaatatgtaagtatttggttctttgaagttttacattaggttttactctagaaattgaatttaaatacccgttttatgaagtggactgtaatcacaaggctagaggtattatatagaaagtttatatatatattgacctggtaagatttttgtaaatttagaaataaatttcacatgacaaaatattctgaccattgtaccagtgtggaaataactgaaaattgtaaagaaggaaaaacatcacttgtaatatttccactcagtgataatagtagtaatcactgttaacttttgactttcttttagtatttttttgtttgtttttagaattgagattatagcacagacacacttttgcatattgccttttttctgtttaacataaaacctaaagaccttttccttacatcaacgtcattttcccataatgttgcagtgaaaacattaatggagcacataatttagttgaagaatgtaacaaaataagtctacctggttttgggggcaggagaagttacatcttttaagtctctatttttaccactgatttttgtgagcttgggaaaataagtcattgtattttttctttaaaatggaagaatattgtattttatatctgggagatgttaccaggaagaagttagttaagaaacagtgctttgaaagtaaaaatactgaccgggcatggcggctcacacctgtagtcccagcactttgggaggccgaggcgggcggatcacttgagcccgggagtttgagaccagcttgggcacatggtgagaccccatctctacaaaaaatacaacaattagctggtcatggtgtcatgtacctgtagtcccagctgctttggaggctgaggcaggaggattgcttgaacccaggaggttgaggctgcattgagctatgatcatgcctctgcattccagcctgggcaacagagcaagaccctgtctcaaaaaaaaaaaaaaaaaaaaagaaaagaaaagaaagtaataatattaatactgtgaaaacaataggtaagtgtcatgctttctttagcaaattcatctgcgtatatgtaaataccttatggaccttgggttaaaatagcgatcttgcaatgatttgacaagtgtttagaagttttgcttaataaatatgtgataagtggcttttctttcgtgagggtactcaattttcacatttatttcaaagttacttatgtagagctatgtgttttttctcttaggctttaaaaatttttcttaacgaaacagctgttattttaaaatgtcactgtgttcttaatattttgagaaataatgacagttttatgcctcaaattgaaatattatcagacattttcattttagtttggaagtgggtgaggactttgaccttgcaagatttgtgcttatgtatgtatccaaagcttaaaattggtaattaaatttttcttcaattagtaagatggtagtttagatgggttaaaaaaaaaaacttcagccaacttaaatttaaaggagcaatgaacaattcgcaaattgggcagctgaatcacagcatattcggagagactctggggatgctttgtggtcagaacaaattaatagacgaaaaaaggaaagtggctttcagaaattggcagcgaggtacagaaacagctatattggttacagattggtgtttgccttatttgaacacagtttgaacacttagcagtctgtaagtggttgaagtatggcggctgggattggccaagactcagctattgttataggtccacactgctaagttacattttcagtctcgtctgcctgttaagctaggttgcagttcatccacaaggactcaaatatagaagtacggagtccttctcaggccatgtttaatttgctttagcagatgcaaggtgagtcgtggttttcacttgttatttcttgaagtagaaggcaaaatcagtgattatgtatcttactggatatgttataaggtagatgctgatatattttcctgaagagcaacatgtcaaaattgaatatatattgatctacagttaaaaactttttttttttaactttaggagatgctaactagtttggcacagaaatggttccctgagctgcctctgcttcatcctgaaataggattactcaaatacatggtaaactttgtttcccttgcgaattactactcttcagagggtgttgaaaagtgataatattaaatttgtgtcagtgttaaacttatagtatcttttaaataaaaatactcctgatgaatattttatgggtattagaactttttcttatgaccctttaatagttgcatggtatatatttgtatttttatgtaaatttgcattatccgtttttctgctttcctcatcctcattcagtacattgcatgacacttatttgaattataggtgtttactttttgaaatgacaaaataaaattttaactgctatttcaagagttaggataaaaacaagatattgctagccctgagggatttgagcacaatgggttttttaagttaaagcagtctgggaaaaaattctagagaggttggttaaggtagagatgttgaggtgggtatggttttctaggtaggcaggattcaaaagctggagatcagcatattaaataggggccatagggagcaggattagtaaacactggtttactaatctgttagtcctgaatctgttagtcctgcgatttatattgccttctacagtgagggcctagatgaggtatttattcattaagattgtcacgaagtccattataatggcttaaatatggtacagagagggatatttgtgtagacatgtgagtttattctaaaaaatatttaagattaaagttccctaacttaaataattactctaaactctttctagactagactttaaaatgatgtgagttttttcttgcaactatttagcttagtgattaccttatgcagtgtgggcaaataagtatgtactgccacatgggacttgaaaattaatatttaaaaatatgctaatctactttattatggaagattataaaaggtttgactcatggtttattgaagtctttaatggctttctgatgtttaactgtaatgtatgcttaggaattttttgtaggttgattatgtattgtagaatacttaaatgtaccgacaagacttaaaaaaaaaacccagaaaacaattctacaatgcctcttactgaaactgcaccacagtaaaacttagctttgtttaaaatgttgatgatcatattttagtgtgaaaaattattccttttaaaaagtagcagaaatatctagtaaaattagttattgaaagccattttcacttttgaggactccaaacaggggcagaggtgttagaattacttcatggtagtcataatttttggactaatctttcccatttgatacctacatttttgtcattattttaccttatttattttttgtttttttacaaatgtttatttcagtagtttttggggtacaggtgttttgtggttacatggataagttctttagtggtgatttctgagattttagtgcacccatcacctgagtggtgtacactaacccaatatgtagtccctcattcctcacccccgtcccaatcagttgttactttagtattttttaggaaacataagtggtttttcaagtaaacattagggatcctaggatgcatgtctggttgattctagtcatttcctgaatctgttctaaaattatagcagtaattaaatgtatggtgattacactttgggtaggaggagtttaagagccaggaactggagaaagtacacagttttaaagattttaattttgttggtttttccagtacagttgatggtgtccaagtcatttaatatcgtgtaactaattattttgatgatttttaagtgctgggattgtttggattctttaactgtgataaaaacttgtgcctagaactctggtggtctccttacaatgagcttggaacgagatcttcttgatgctgagcccatgaaggaacttagcagcaagcgtcctttggtacgttctgaggttaatgggcagataattctgttaaaggtaagtctaacttcttcttacttgtgggagattcagcagcataaaggatagtggtgctgttacatttcaagaaagaaaaaacctcactgttagttttctaaagtgtataagttgactggcatgataattgtgcttgtagtttggttgccagaactaattttcacttttaaagtttccctcaattgaacaatgagaacacttggacacagggcggggaacatcacccgtgggggcctgtcatggggtggggggcagggggagggatagcattaggagaaatacctaatgtaaatgatgagttaatgggtgcagcaaaccaacatggcacatgtatacatatgtaacaaacctgcacgttgtgcacatgtaccctagaacttaaagtataataataaaaataagtatataaaagtcattaaataaagctttgtctcacaagaaaaaaaaataaagtttccctcatttccctaaatagaatatgtccttaataggatatactttcctttttttttgggtgaacttattatagtcatccaatatctttttaaaattcttgattttcttacatttctccttgaaatctcagctgtgttatcagtacaatcttctactctttaatttcttcttctcattgatctgggaaactgttaatcatgataataagataattaatttggccttagttgctacacattctagaatgtgtagcaggctacaggtagaattgcactttccttttccaaattatagcattcaaagaagatagaaaagtacttataaaattaaaaaataaaattagatttgatttaacttaaaataatgaattatgtttaaattggaatgatgtataattataatgagattttcatcttggaattacgagtgcctctttctttggtacaagggctattctgtggatgttgacacagaagccaaggtgattgagagagcagccacctaccatagagcttggagagaagctgaaggagactcagggttactgccattgatattcctgtttttatgtaaggtaaagttcttatgctaatctcttgcagaaaccattttatcttgcagaaactattttatttaaaataaattttagctccaggttttagagcagcagttcattccccttaacataaaagaaaaattatcccatagaatcaatgtatgctaaaaatatgttgaagaagtttttacttggagtcacattctctgttttgcttcttagtctgatcctatggcttatctgatggtcccatactaccctagggcaaacctgaatgctgttcaagccaacatgcctttaaattcagaagtaagtaaaaagcactatttatttccatggatgtattaaatgagaaaataacacctgatatttattcaggcatactacatgctatgtattttgtaaaattttgactcatggtattctatttgtcacctcaagcctgtgatagaagttatcgtgttatatagatgagaaaaagcgttaaagggattagattaagtgacttgcacagggtccgttagccagaggtagagctgggactcgaaattaagtctttctggttccaaagcccaaacttacaactgctaagctgtgctgtatgtgaactgcctaatatagcacttggtactgtaagtgcttaagtggcagctttaatttttgtcattgtaagtttaggattagtaataacagtaaaggaggccctgattcttcttatggagtaacactgtttcagtctcttatagctactttacatggttggtatttgtaatccaagtcttctttgagatgatagaacaggtgtcctcagaccccaggtcgcagactggtaccagtctgtggcctgttaagaacagggcggcacagcaggaggtgagtggcaggtgagcaagcattactgcctgagctccacttcctgtaagatcagtagaggcattagattctcataggagcataaactctattgtgaactgtgcatgtgagggatctaggttgcgcactccttgtaagaatctaatgcctgtgatctgaggtggaacagtttgatcctgaaaccaaccccctgcatccatggaaaaattgtctttcatgaaaccggtccctggtgcccaaaaggtatgattgtacacacacacacacacacacacacacacacacacacacacaaacacacacaggcacacatggtatcaccattacaaaatcaagccttcatctggtctttctctatgctgtattcttattaatggttcatttcgaggaaactttactcacttctagagcagtcttttaattagagaacagtttcaagattaaaatgatttgcctacttcctcacttcttttatgtgtacttatctataggaaactttaaaggtcatgaaaggtgttgcccagggtctgcatacattgcataaggctgacataattcatggatcacttcatcagaacaatgtatttgctttaaaccgtgaacaaggaattgttggagattttgacttcaccaaatctgtggtaagatatcatggttttacaaataggttctagactttatttaatattattaagcagtagttcagcacttatatataatataatactttattataggatctttgtcttcagttaaactgtgtcatgtagtataagcaactatttgccctcagctagatgctagaacagcaggagtattgtgtattttaaccataagtcttaggagctacctgacattatatactcaatggcattgacaacattaataattttgtcatcattaggaaacatttaattgctaggaaacatgtaaggaaactaggtggccatctcctaaacctctctccactggtgtccctccgtctatagatacaatttacatatacgtactttgctgttttttgattaataatgtgcatttttagaaaccggggaaccttggactttttagtttaaatcctgattcacctctaatggctgttaattcagtgtcatattacctcagaataggcagtttgtagagatagcaaaatcacacaatttaagagcatgttgtgatttttttgtcgttataatggaaacaattctctattttaattgagaaataaaaattgtatatatttatcatatacaacatgatgttttgaagtatgtatacaatgtggagtggccaaatcagtaattatttttctaaacattacagctttattgagatacaattcacataatgtatacaattcattaatagtttgtagtacattcacaaagtcgtgcagtgataaccagtattgaattccagaacattattaacattcccaaaaagaaaatccatactgattagcagtcactcaaatttcccacttcttctcaagcctggaaactacgaatacactttctgtctctatggatttgcctatttggacatctcatgtaaatggaatgatacaatatgtggccttttatgctaatttcacttagcatagtgttttcagagttcatccacgttattgactgtatcaaaatgtcattcctttttattgccaaattatatttcattgtatggatgcaccacattttgtttatatattcatcagttgctggacatttggttgtttatacttattggttatatgaataatgctgctatgagctttagcatacaatattttttgtgtggacatgttttcatttctcttgggagtggaattactgggttacattgttttactttttgaggagccaaactgttttccaaagtggctacatcattttatattcttcccagtaatgtatagggattttgttttctctacatccttgccaatattttttattatctgagcaattccctttgactagtatatgttataatgcttttatactttggtcatctgcaagtcatagtgtaatgctactggagtatatatagtcttaatggttttgatatggtagctcaaaaagatgagaaaatgaaactgcaactgtaatcaaaagctggattgtacaggatttatacagattgattttctgaaatatttactttattacattagtttaacaaaattaagatatcctaagaaatataactaaattatgaattttgaaagatctcaaccttcaggggttctggttagtttaccttttgagcatactatttgcataattatagatatgactacaataattactctttagtcattcgtcatctgttattattccccaaaacattgtttttaattttcagttaaaaatatttattctgaaatattgatcaaactcaccttttgctacattttccatgcaattttcagattgaagtggttatcaggaagataaatttgaaaagtagtctgaggtcaagatcattgcttttcaggccttatagtgcatacaactcacctggggttcatgttaaaatgcaaattaatattcagcatttctgcagtggatcatctgcatttctaacaagctaccagttaatgctgtagctcctggcccttggaccatactttgagaagcaaggatcaaaatcgtagctagaaaaaagatagcacttagtgacacatgctaggcattgtatctctgtaaggtagacattatttccattttacaaattaattcaggctcaaagaggtttacacctactatgtacccataaaaattaaaaataaattttaaaaatggacaaaaaagaggttaaagccctcggtcccacagcaaataaataggagagtggggaattgtaaccaagatctgcctgaatataggattcatgctattgtcactgatcatctttgacatgttagaaatggtatatttagagaatgatcagtaaggaaggaaagtgctttgtaggatttcagttcttaaatgaattatttagaattttcagaattagaacatggcactgctgctcactcttgtgaaatttattttttaaaaagagtatcaaatgtttaatcacagaataagtggttgttagtattaaatctgttcaagtctacaaagtgaatgtaaaaaaaagtcccatagttaatttattagactgattttaagagcaatttataatagcagaaattggtaaaaatatttgaaagcaagggaatgaaatatttaaaatgaatttgttttttgtattgattaaatgcagagtacttcacagaaagtcacctcaactgtgttgtatctgaaatatgtaaaatattgtttttgcagagtcagcgagcctcggtgaacatgatggttggtgacttgagtttgatgtcacctgagttgaaaatgggaaaacctgcttctccaggttcagacttatatgcttatggctgcctcttattatgggtatgttatttttttgttgaaatagatcatatatatatatatttcagtatataaagtgatgattttatagtgattctccttaaaaataaaaagcagcagacttttagtagaactttaagttttaacaaaaactattgatatgcttcctattacctattgtgtactttctacaaattggcttgatgtatattttaggtatcatgctattgtcttggttctgttgaagtcaagattaacagtgaagatgattttgtcctacattaatctgaaagcagttcatgcatatatggaaaataaatgttaaataagccttgggtatattcctgcttccagtgtagaccaaatagctgtttctcatccatagtttaagaattaagaagttggatggagctggagaccattatcctaagcgaatttactgtggatcagaaagccaaatactgcatgttctcacttataagtgggagctaaacactgagtacatatggacacaaagaagggacactggggtctacttgagggtggaggttgggagaaaggtaaggattgaaaaactacctgttaggtattaggctgattacctgggtgacaaaattatctgtacaccaaactcccatgacacactgtttacccatgtaacaaacctgcacatgtaccccttgaacctaaaataaaagttggaagacaaaaaaataaaaagcttgtttcatgttgtactgctattttacgtagagaatgcctctttttccaaagtcttgagtgtgacaaaaccttatctttgttgatcacataaataaaaataatctccttgttagaaaaacaagagttaagagggattaagtattaagagaaggaagactattcttatcagcccaggggccagcaagcattttctgtaaaggaccagatggtctctgttgcaagtactgagttctgctgctatagcatgaaagcagccatagacagtatgtaaacaaatcagtgtggctcttttccagtagtactttatttatggatattgaaatttgaatttcatgtagtatgcatgtgcatgaaatagtattccttcagtttgctattaaacatttaaaaatgtgaaaactacccttggcttgcagctgtacaaaaacaagtagtggaatcagtttggtgcagaggccatatagtttgctgatctctgttccaatcagtgtaataaggtcaaaaaaagaaataaaagtcatagagtttgaaaatgaagaaataaagctgtctttatttgcagatgacatgcttaattatgtagaaaatctttgagaatgtacataaaagctactagaacaaatgagtttagaaagatagcagttttaatttcaatataattgtgtttttatataagcaacaaataataggaaattaaaatttaaaaatcatttacaaaagtattaaaatatggaatttgtaggggtaaatttagtaaaagatgtgcaagagttgcacactattaaaactacaaagcattgttcagagaaactcaagaagacataaataaatggagcgatacaccatgctcatggactagaagacattgtatggatatcagttgttcttggcttatagattcgatgcaatttcaacaaaattgctggtagattttgcttattttttcagaaattgacaattagattttacaattaatataaaaatggagaggatctgagatagccaaaacaagtttgaaaaagaacaaaattgaaggacccaaactacctgattttatgacttaatagattctaggaaattaagacaatgtaggcctagagtggtggttcaaaactgtaatcccagcacttagggaggctgatgcaggaggattgcttaatgccaggagttgaagactagcctaggcaacacaagtgagcaccccctgtctctacaaaaaatagaaattagctgggtgtaatggcgtgtctgtggttctagctccttggtaggctgagacagaaagattgttggagtccaggagtttaaggctacagtaagctatgactgctccactgcactccagcctaggctacagagcaggaccctgtttctaaaaacacaagtgatactgctgtgaagttagatgtccagatgaatggagcagaatagagacaatataaatagactgcacatgtatgataactggcttttgacaaagatgccaaggcagttctctgggtaaaaggagaatcttcaacaaaaatgatacaggccaactcataccatatgtagagaataaattttgattcatttcttataccatgcacaaaaattagctcaaaatgtgtatcagacctaaatgtaaaacgtgagtctaaaacttatagaagaaaacataggatgaaatatttgactttcgatttggcaaagatttcttaagtaggacacagaaaacatcaactctaaaagaaaaaaatcatttggatttcatcaaaatggaaaaccttgctcttctaaagacattgtcacaaaaatgaaaggcaagctacagactaggagaaaatatttgcaaaacatatatctgacaaaaatattatatccagattatcaagagctcctacaatcaatactaagaagactgcccagttaagaaatgggcaaaatatttgaacaggtactttaccaaagaaggtgtccacatggcatgtaagcatgtgaaagatgctctgaacaccatttgtcattagggaactacagattaaaaccaaaatgagataccactatactactcactataatgtataaaattaaaaagatcgtaccaacggttgcttagatctgttgtacctagaactcatatatattgcccaggggaatgtaaagggaacaaccactttgaaaaacatttggcagtttgttaaaaggttgaacatattcctaccctatgacccagcaattccacttctagatatttagccaagagaaatgaaagcatatgtccacacaaagatttgtatgtaaatattgaaagaatttatgtgtaatagatgaaaactagaaacaactcaaagtccatcaacagatgaatggaaaaacagtctgctatgtatgtgtctatccattggaatactactcaggaataaaacgattgaactataaatataactcagtaagataggtgagtcttaaaataattctgccaagagaaagaagccagatgataaggtttggctgtgtctccacccaaatctcacattgaattgtaatccccatgtttcaagggtggggtcaggtggagataattgaatcatgggggtagtttcccccatgcagttcttgtggaagtaagtctcacaagatctgatgatttcataaggggcattttcccttttgcttggcacttcttgctgcccccatgtgaagaagaatgtgtttacttccccttctgccatgattgtaagtttcctgaggaatccccagtcatgctgaactgtgagtcaattaaacctctttcctttataaattacccagtcttggggatgtcttttattagtggtgtgagaagggaccagtacagtaaattggtacagagagtggaatgctgctgtaaagatacccgaaaatgtggaagcagctttggaactgcgtcatgggcagaggttggagggctcagaagaggacaggaagatgtgggaaagtttggaacttcctagagacttgttgaatggctttgagcaaaatgctgatagtgatatggccagtgaagtccaggttgaggtggtctcacctggagatgagggacttgttggaactagaataaacgcgactcttgatgttttagcaaagagattggtggcattttgcccctgtcctagagattggtgaaactttgagcttgagagagatgatttagagcatctggtggaagaaatttctaagcagcaaagtgttcaagaggtgacttgggtgcttttaaaagcattgttttgtgtaatcacaaagatatggtttggaattggaacttatgtttaaaagggaagcagagcataaaagttaggaaaatttggagcctgatgatgtggtagaaaagaaaacccgtttcctgggagaaactcaagccagctgcaggaatttgcataagtaacaagtagctgaatgttaatcgctaggacaatggggaaagtatctccagggcatgtcagaaagcttcgcagcagcccttcccatcacaggcacagaggcctaggaggaaaaaatggtttcatgggctgggcccacggtccccctgctgtgtgcagccttcagacatggtgccctgtgtcccacctgctccagtcatggctaaaaggggccaaggtacagctcaggccatggctttagagggtgcaagccccaagccttgttagcttccatgtggtttgagcctgaaggtgcacagaagtcaagaatggtggtttgggaacttccacctagatttcagaggatgtatggaaatgcctggatgtccaggcagaagttttctgcaggggtggagcccttatgaagatactctgctaagacagtgcaaaacggaaatgaggggttggggctcccacacagagccccaactggtgtactgcctagtagagctgtgagaagagggccacagtcctccagaccccagaatggtagatccactgacagatcacactgtgtgcctggagaggcaacagacactcaatgccagcccatgaaagcagccagaagcggggctgtagcctgcaaagccactggggcagagctgcccaaggctgtgggagcccactcttgcatcagtgtgacctggatgtgagacatggagtcaaaggagatcattttggagctttaagatttgactgccctgctggattttgaatttgcatgaggcctgtagcccctttgttttggccaatttctcccatttggaacaggtgtatttacccaatgcctgtaccccattgtatcaaggaagtaactaacttgctgttgattttacaggctcataggcagaaggaacttgccttatttcagatgagactttggactgtggacttttgacttaatgcttaaatgagttaaaactttgggggactgttgagaaggcatgattgtttttgaaatgtgaagacatgagatttggaaggggcctggggtggaatgataatggtttagctgtgtccccacccaaatctcaccttgaattttaataattcctgtgtgtcaagggcaggcccaggtggagatatttgaattacggggtggttcccccatactgttctcatgactttagccctatgcctgcatgtatatttaaagttgtctggtttcattgaaccagcaccctcatggaaataaactagcatgattttcatcaatgcttcagtaatctattctttatatcagaagggtgaaagtaaacatatcaagtttttttttttgtttctgggaggactcataagatatcccataagtgtggtaatagcagtttttattccacctatttcctttaaatgatagtaaaaagctccatgagtaaatatattgtctgattttctactcttatgtattgttgattaagtcctttaaaaactttatttttagattaacttgtacaatggacttttttttgtatacattctatgaattttaacacacctatagattagtgtaataaccactgccacagccaggatgcagaacagttccataaccctgaaaattcctgtgtgccatccctttgtagtcacagcctcctcccaacccttaaacgctggcaaccactgaccttttatcactgtgttttgtgcttttaagaatgtctcacacatagcaatatgaaccttaaatgtaaatgggctaaatgccccaattaaaagacacagactggcaaattggataaagaatcaagacccatcagtgtgctgtattcaggagactcatctcacatacaaagacacacataggctcaaaataaagggatggaggaatatttaccaagataatggaaagcaaaaaaaaaagcagggattgcaatcctagtctctgataaaacagaattttaaccaacaaagatcaagaaagtgtaagaagggcattacataatggaaaagggatcaacgcaacaagaagagctaactatcctaaatattatatgcacccaatacaagagcaccaagattcataaagcaagatcttagagacctacaaagagacttagactcccacacaataatagtgggagactttaacaccccaccgtcaatattagacagatcaacgagacagaaaattaacaaggatattcaggacttgaacttagctctggaccaagtggacctaatagacacctacagaactctccaccccaaatcaacagcgtatacattcttttcagcaccacataacacttattcagaaattgaccacattattggaagtaaaacactcctcagcaaatgcaaaagaatggaaatcttaatggtctctcagaccacagtgcaatcaaattagaactcaggattaagaaactaactcaaaactgcacaactacatggaaactgaacaacctgctcctgaatgactactgggtaattaacaaaattaaggcagaaataaataagttctttgaaaccaatgagaacaaagacacaatgtaccagaatctctgggacacagctaaagcagtgtttagagggaaatttatagcactaaatgcccacaggagaaagcgggaaagatctaaaatcgacaccctaacatcacaattaaaagatctacagaagcaagaacaaacaaattcaaaagctagtagaagacaagaaataattaagatcagggcagaactgcaggagctggagacatgaaaaacccttcaaaaaatcaatgaatccaggagctggtttcttgaaaagattaacaaaatagatagaccactagccagactaataaagaagaatcaaatagacacaataaaaaatgataaagcagaaatcaccactgatcccacagaaatccaagctaccgtcacagaatgcaataaacacctctatgcaaatcaactagaaaatctagaagaaatggaaaaattcctggacacatacaccctcccaagactaaatcagcaagaagtcgaatccctgaatagaccaacaataagttctgaaattgaggcagttattaatagcctaccaaccaaaaaaagtccaggaccagacagatacacagtcgaattccaccagaggtacaaagaggagctagtaccattctttctgaaactgttccaaacagtagaaaaagagggaatcctccctaactcattttatgaggccggcatcatcctggtaccaaaacgtgccagagacacaacaaaaaaagaaaatttcaggccaatatccctgatgaacattgatgcaaaaatcctcaataaaatactggcaaactgaattcagcagcacatcaaaaagcttatccacaacaatcaagtcagcttcatccctgggatgcaaggctggttcaacatatgcaaatcagtaaacataatgcatcacataaacagaaccaaaaacaaaaaccacatgattacctcaatagatgcaagaaaaagcctttgataaaattcaacacccttcatgctaaaaactctcaataaactaggtattgatggaatgtatttcaaaataataaaaggtattcatgacacacccacagctaatatcttactgaatgggcaaaaactggaagcattcccttgaaaactggcacaagacagggatgccctctctcaccactcctatttaacatactattgcaagttctgatcagggcaatcaggcaagagaaagaaagggtattcaaataggaagagagacagtcaaagtctgtctgtgtgcagatgacatgattgtatatttagaaaatcccatcatctcagcccaaaatctccttaagctgataagcaacttcagcaaagtctcaggatacaaaatcagtgtgcaaaactcacaaacattcttatacacccgtaacagacaaagagccaaatcatgagtgaactcccattcacaattgctacaaagagagtaagatacttaggaatacagctagcaagggatgtgaaggacctcttcaagaagaattacaaaccactgctcaaggaaataagagaggacacaaaaaaatggaaaacaaattccatgctcatggatagggagaatcagtatcatgaaaagggccatactactcaaagtaatatgtagattcagtgctatccccatcaagccaccattaactttcttcacagaattagaaaaaactactttaaatttcatgtggaaccaaaaagcccgtatagccaagacaatcctaagcagaaagaacaaagctggaggcatcatgctacctgacttcaaactatagtacaaggctacagtaaccaaaatagcatggtaccggtaccaaaatagatatatagaccaatggaacaaaacagaggccacagaagtaatgcctcagaagtatctacaaccatctgatctttgacaaacctgacagaagcaagcaatggggaaaggattccctatttaataaatggtgttgggaaaactggctagccatatgcagaaaactgaaactggaccccttccttacaccgtatacaaaagttaactcaagatgcattaaagacttaagacctaaaaccataaaagccctagaagaaaacctaggtaataccatttaggacataggcatgggcaaagacttcatgactaaaacaccaaaagcactggcaacaaatgccaaaattgacaaatgggatctaattaaactaaagagcttctgcacagcagaagtgaacacatcagagtgaacaggtaacctacagaatgggagaaaatttttgcaatctacccatctgacaaaggtctagtatccataatctacaaagaactgaaacacatttacaaaaagaaaacaaccccatcaaaaagtgggcaaaggatataaaccgacacttctcaaaagaagacatttatgtggccaacaagcatatgaaaaaagctcatcatcactggtcattagagaaatgtaaatcaaaaccacgatgagataccatctcatgccacttagaatggcactctttgaaaagtcaggaaacaacagatgctggagaggatgtggagaaataggaacgctttacattgttggtgggagtgtaaattagttcggccattatggaaaatagtgtagcgattcctcaggcatctagaaccagaaataccatttgacccagcaatcgcattactgggtatatacccaaaggattataaatcattgtactataaagacatgcacacttaagtttattgcagcattgttcacaatagcaaagacttggaaccaacccaaatacccatcagtgatagactggataaagaaaatgtggcacatatacaccatgcaatactgtgcacccttaaaaaaatgatgagttcatatcctttgcagggacatgggtgaaggtggaagccatcattctcagcaaactaacacaggaacagaaaaccaaatacctcatgttctcactcataagtgaacatgttctcactcataagttgaacaatgagaacatatggacacagggaggggaacatcacacagtggggcctgttggggagtgggggtctaggggagggatagcattaggagaaatacctaatgtagattatggtttgatgggtgcagcaaaccaccatggcacatgtatacctatgtagcaagcctgcacgttcttcacgtgtatcccagaacttaaagtatataaaaaaaagaaaaaatagaaaaaaatataaataaaaataatatcatattagtggtatcatacagtatataattttgtgagtctagcttctttcattcagcatgtgaatcatcttttgtgattcattcaagttgtctaatgtagtttttcccttttttgtttctgaatagtgctctgttgtatgtacataccaaatttgtttgttcacctgttgcagaacatttgcattgtttccagtgtctgactattgcagataaagctactgtgaacatgtgtgtataggtttttatgtgaacgtaagtttttgtttctctatggtaattacccaggagtgaaatttctgggtcagattgtaatcgtatgtattattctttaaggacctgccaaactgttttccagagtggctgtactgtttttgattttcacctgcaatttatgaaagtttcagttcagcatcattgtcggcacctcgtattgttattatcttctattttagccattctcataggtgtgtggtagtgtttcattgtggttttaatttctctaatagataatgatgttgagcatcttttagtttgtttattattggctttctgtattttctttggtgaagtgtctgtcttttgcctgttttttaattggatttttgttttattgctgtagagttttgggcattcataaatacattctagatagaagtcctttatcagatgtcatttgcaatgatttttttctggcctgtagcttttctttttattttcttttcagtgtcttttgcagagaaaagggttttaattttgaagtttaatttattattgttttctttttatgtatcatgcttttagtgttgtgtataagaactcttcgcataacccaaagacttgaatattttttcttatattttcttctaaaagctctatagttgtatggtttacatttagagctgagatctctttggatgtaatttttgtgtaaggtgggaggtttatgtcagggttcatgtttttgcatatggatgtccaattttacaacaccatttttttaagagagtgttattctctgttgaattgtctttgtatctttgtcagaaataaatcggccatttttgtgtgagtctgtttgtggactctttctgctgttgatctgtgtgtctatccgtttaccaacatcatactgtcttggttactgtatctttatagtatgtcttaaaattgggtagtatgattctttttcagattttagctattcagctatctttccttttttgtatatattttattttatattttacatcttaccttattttattttattgagacgtgtaaggtcagccgagagaaaggaaaaatagacctaaagtcaggcgcgtaagtttattgaacctgaggggctgcttcacctcactcagaggaggcagccctgagtttacaaaatgaggggtttatattggagaagggagtttgagggagttctttggtgtggccgcattccagggttgtttgctggttaattttgtcacatatcaccttgtgacatttgtggtagcagaactttcaggaaggtgtaggtaaagtttgtttattcttccaacgacctcccgctgtgcggtccagatggttcgtaattggggtttgtttatccagcaaggtctgataagtgaagtctgctggcttcactgtggtgcctagataagggcttagaaatgtaaagaggcttgggggaagggtggacagcacggagacgtttgaggggagcgccaagaagctttatggggcagtttgtctttaagacgcagtctcactctgtcacccaggctggagtgtactggcacaatcttggctcactgcaacctctgcctcccgggttcaaatgattcttgtgcctcagcctcccgaggagctgggattataggcacccgccaccacactcggctaatttttgtatttttagtagagatgaggtttcactatgttgaccaggctggtctcgaactcctgacctcaagtgatccacctgccttggcctctcaaagtgctgggattacaggagtgagccactgcgcctggctgcttttccatgtatattttacaaacagcttgtctgtgtgcacaaaagccctgctgtgattttgattggaattgcattaaatctgtagatcaatatggggagaattgacatctttactacattgagcctttaatttgtgaactccatttatttaaattttctctggtttcttttatcaacgttttgttattttgggcttacagattctatacatgtgttgttagatttatacctaagaatttcatgtttggaagctattgtgttttttaaaaatttttgttttctagttggtcaagttcttttttacaacagtatttttttgatagtaaagttagtttggtacgaaaggctgtgtatactttgaccttcctcctcaaagaattgggcaatttattatgaaagcacatagtgtaaaatatataaaagggcaaaaagtcaagatccaagggctgtgcttaaaaaggtaatattcagagttaaactggaagcattatcaaaagattttatttacaaggccatgaagggattactgtcactttgtctttaaaaaaattttagaaatagcaataataaaaaagtaatagtttgatagcaaagctctagaatactaactagatattttgggcatatcaaagatactgtggttttagatcatttttcttatgagatccagattaaatgaagtgttctgaagactgcctacagaaaattcaaaacaatggacaattcaagtgttgtgggttattaccttcagtaataaaccatatctttttttaaacgtttaaattaggtttgggggtacatatgcaggtttgttatatagataaactcgtgccacaggggcttgttgtacagattattttgtcacccagatactaagcctagtacccaatagttattttttctgcccctctccttcctcctaccctctgcccttaagtaggccccgtgtctgttgttcccttctttgtgttcatgagttctcaacatttagtgagaacacagagtatttggttttctatatcttttaactgaaatacatggactatagttttatcatgacaccatttgtattaaggttcttcactatatttttaggttattatggaaatcttaaaggtgttttctagaagccagtttttaaaaagtataacagttctgtctgatgttacattgaaaaagaattgtgtttctgtgtgtgttgaggagtactgctgtgaagaagttgaatataaagaagagaatggccccctttctttgtttatttttatttatttatttatttttaagagatggggtctcactatattgctcaggctggtctcaaactcctgagctcaagcgatcttcccacctcgatctcccaaagtgctgggattacaggcatgaactaccacgtctgtcccccttttatttattcagagacacattttcagtgttgctttccctaaaatgcattttttcctgctttatttttctgttaccatattatacacttatttatctttattattgtctgcttctaccactcgagtggaagctttttgggagtagcttatctatcttgtttgccactatatcctcaaatgcctagaactgtgcctggtgcaaagtgggcactcaaatattagttgaatgaatgtttaaattttagccacagttatatgctgaagtattaggctttaaaaaatagttccatgtttttttcctgagttcatttacttacctctcatttatggccccatgtacatcattttattctttaaaaccttgcatgaagattttattccgactcttaatatatttctaggagatgttagtggtcatactgatcacccagtgaacctaactttgcatttctggaccttcttaataacgtgagacccaaacctttatgtaatttcagtcacttccccaaaccaggattttgtgaatctctacaattgttatttttcaaaagtaatagagtccaatccattatatttttctcctaacaggatttcctgtcctctcatttactgtgtctgctaatcttaaatctccagtgggtttatttactgtctctcttttcttccagtttatcagcagccttctagcttttttctttatttactcattcttggaccctatcatacaattcccagactatgccttatattcccatttactcctgttcttctgtttagtctttttggaaaaaactcaattttagataagctatggcctgccatttgtgagtaaaacattctttctcatttctctctctctcttttttttttttgagacggagtcttgctctgtcgcccaggctagggtgcagtggtgtgatctcggctcactgcaacctctgcctcctaggttcaagcgattctcctgtctcagcctcctgagtagctgggattacaggcgcacgctgccatgcctggctaattttttgtgttttagtagagatggggtttcaccatcttgctcaggctggtctcgaactcctgagcacaggcagtccacctgcctcggcctcccaaagtgttaggattacaggcgtgagccaccacgcccagccccatttctcctttttaaaaagttttatttctatgcgtcaataacttttttaaaggcattacattttatttctttaacagagtgtgaccaaacatatttgtttttattttttatttttttattttttggagatggagttttgctctgtcacctgggctggagtgcagtggcactatacagctcattgcagcctcaatctgttgggctcaagtgatcctcctgccttagccccctgagtagctgggactacaggttgtatcaccactcttgactcatttttgaattttttttgtaaagatggggtttcaccatgttgcccagcttggtctcaaactcctgggctcaagcaatttgtccacctttgtctgccaacatggtgggactacaggcatgagccactgtgcccagcccatatttgttaatttaaggacattattatgtctctttataacatggtggtaacatcctcccttggtgagagcacatagaacatgtttggaactaactgctttagaaagttttatctcattacaccctcctaacaagcatgtgagggagtatgttattatccaaagtatagatatgagaattttgtgtgtcagagaggaagtacctgagtgatgccccatttcagaattttagtgtctcgaggctccatgcaagaccaccttctgccttcacatcacatattattaagcctggaaggcagtcttcactgaagccaatgatgaacaactgatgaagggaacccagggctgggaaataagttaccagtaaatgtcatggcattgaccactatgaagtcccttgtatcatattattccccttttaggcatctttaggcttgtctcctatgtgctgtttttttaagaagttctctgcttacaaagtcttgcgtggatgtatttaatacttttgtttggaatacaggtacacttttcacacgtgatacctggttttcatgtgtaatccaaaaataagagacaatgggaaagttatgttccatatgctgtcctttcttgaggaccagctcacgtgacttgtgataagctctcccaccttctctgaaccttagcagtgcctctcaggaatatgctaactaagataaatggagagaaaggaacatgggtagcagccccttaaaatctagaggttttatgattctaacatcataatgaagcagactggggaatagaactcattattgtagaattgaatgtaggaggattaagagatacaggttgggccgggcgcggtggctcacgccagtaatcccagcattttgggaggccgaggcgggtggatcacgaggtcaggagatagagaccatcctggttaacatggtgaaaccccgtctctactaaaagtacaaaaaatcagccgggcgtgttggctggcacctgtagtcccagctactggggaggctgaggcaggagaatggtgtgaacccgggaggcggagcttgcagtgagcagagatcacgccactgcactccagcctgggtgacagagcaagactccgtctcagaaaaaaaaaaaaaaaaaaaaagagagatacaggatggacggactcactaatctctttagtacccttccctgtacaggaatttcgtgtattaatatttctgaaactgctttgagagccaatcaagaaccttagactggtcattcctgtcttatcagatccaaatgcagagaacttggaggaggttcacctttcaaggtttttgtttttgttttttaagatagtctatttacccatatttttattcttattctttttaaaatttctaatgtttcagcatttctccttttatcatttttatcctaataacttcttttggccattctttcaaggtaagtctactggtgacaaatttttagtgtcctttatctgagagcatcttgatgtcacctttatttctgaagaatattttcactgggaatagaattctggattggtagttctttttcttttagcatttggaaaagattgtgctactttctttaggtgtccatggtttctgatgagaaattcactgtcatttgaatcatttcctttataggtaatattacatttctctctaaccagtttcaagatttttgttttctttagttttaagtttattatggtatgtagtggcatgtgtttctttaagtttattctgtttgaggttttctcagcttcttcagcctgtgggcttatgtttttcaacaaatgtgggaagttcagcaattatttactcaaatgcattttagccccccaccctttctcctctttttctaggactctgattatacaaattttctgtcttttattgtctcacaggttcttggggctctgtttatcagggtgtttttttttgtaatgatggttgttcaaatgggttattttctattttttcatcttcagattcattagtgctttcctgtcatatttattctatcattcagtccacctaatgagttttaacatttttgattactgtttttctgttataaaatttccaattgattcttttttatatcttctgtcttctgtttctttgctttctattttaaaaatttaagtgtgtttgtaattgctctatgcagcatttttatgatggccgttttaaaatccttctcagataatcacaacatctgttctatttggtgtccggtggttgtctttttctcagtcaagttgagattattctggttcttgatataaagtgattttttattgtaccctaaacatttgggttattatgttgtgagactatgaatcctttttaatatatatatatatatatattttttgtaggcagccaccctgtttaggtatagtatgcagttccagatggggttagatatgtagttccccactgggctctgctgacatcaccccagcaaaagtggaatgcccagttgtactgccttacttctccttgctgctgacagatgggagtgtaaattcagcactttattgagttcttttgacaccgggagaccaggaggagcaaagtgttagctataactgtttcaccaccaccttattccaccttcttgtgccttgttgctacctggtgagagtggaagttttactccccagtgggtcctgccaacaccgtggggagtgggcaatgaaaaactgaatgctgactcgtactacttcacactgctttgtttcactttttttggctgctgggtgggagtggaagtaagccctgttctgagtcccactgacagtatcccagactgtagagtgacagctagtgctgtttctcactgctgtcttctgcctctgttgatgggtggaagtagaagttcagttccctgtttggcttcatggataccatgctagtggaggaagcaaagggatgacttcccatgacttgttgctgctgggtagggctgaaagtccagctcctcactcagcactactaatactacggatgggatagggggcagtttttcgtttggtgtgtgactggaatagggtatattacctattacagttttctgttctgctaggccaccctcttcccagtcctgtggctacaggaagcaggcttttcttggagcttttgtgtgtgtgtgtgtgtgtgtgtgtgtgcctgtgtctgttggcatttctgggtggcagacttctcaaggaccccatcagagatataggggggcaaaaagaaagcccagggaactcaccattatattgttcctcaagtggcaaggtcctagctacttcaccttcttctttccatcttttagggttttcctgtgttgtattatagctagagttgtttgttttttttaagaggaaaggttgatgtgaaatgtgactactccttggctggaaccccttgcatgctcttgtaccttgggagctgaatgctgttgcactgcattactttaattgagcccttggtgctttcttttggttctttgacctcctcacagccacctcattctcacattcctctcaacaattattttaaaccttttcatcaattctccacttaaatcctatcctcattcttctcagatgatcttacttcttattttactgaaaaacttgagatcatgttatgtgcttttcatcaaatttgagcacttacaaattacagtcatccctcagtatacacagggaattggtttcgggacccccacatatgccaaaatctgcgcaaagtcccactgtgagtattgtggaacctgctaatacgaaaagtggaccttttatatatgcaggctttatgtcttattaatagtgtatttttccatccatgtttggttgaaaaaaatctgcatgttagtgggccaacacagttcaaatctacattgttcaagggactacattatctgtttacccagtcttctatctttgcctcctatttcagagaattaaagtgctccttccccagtgcaagtaattcagtaccgtaacatacaatatggggttgtaaccttggagcggtaggctacatgtatagcctaggtgtgtggtaggatatatcatctaggtttgtgtaagtacatttgttatgatgttcacacaaggatgaaattgcctcatgatgcatttctgagaatatattcctgttatgtattcctgctgttaaacagcacgactgttgttttgtcagttactgagagttgaagtccctggctataattgtagacttgcctatttctcctttcaactctatcttgtggtttaaggtcatcttgtataatatgtacatatttaggattgttatgtcctcttagtagattgatacttttatcattatgtaatatccttctttttctgtagtaattttctttgctctaatgtctactttgtctgatattacagccattcttgtgtttcaacattaatgtttgcatggtatatcttctgccatccgtttactccaaaggtacctacattgttgaatttggagtaagtttcttgtaaataacatatagttgcattgttttttatttactcttgctgatctctgtcttttaattggggtttttaggccatttacatttagggtaattattgatattttagggcttaaatctaccattgtattactggttttgtttgtttcttgtttctttttctttttttcccttcctgtgcattacttgaaaaaattttctaccattgtattactggttttgtttgtttcttgtttctttttctttttttcccttcctgtgcattacttgaaaaaattttaagagtccatctttttatatatatatatatataatatatataatagatataaaatatataaattatatatataaaaatatataatatatataaaatagatattatatataaaatagatatatataaaatagatatatataaaatagatatatataaaatagatatatataatatataatatataaatatatattatatataaatatataaatatgtatatatatttgtatataaatatgtataaatatatatttgtatataaatatgtataaatatatattatatataaatatgtataatatatatttatatataaatatacataaaatatatgtatatatgtgtgtgtgtatatacacacacacacacacacacacctacatgatgtcttattttttttaaacaacacctgtactccagataaatatggtcaaaataaatgaaaaactcaagatgacattattcccatttgtctaaaggccgggtgttgtgtagatgataagcacctgccatttatgatgacaggtgatagatccaaagtaattgccagatttgttaatttttttccatttctaaatcatccataaagaaaatcacatatagggtcacatcatccttacagtagtttagcagagcaactgtgccatctagattgatgttttcaccagtaaaggactggtagtttttgaaattagcaagtatgtgcttgatttgttctgcagcttctgccataaaaggttttactctttctggtcttcattcttcaagtttgcctttgattgatttaatgtaatctttcatatacatcttgtaggcttcttttatgaagccagcttgctgcaagtgatggttcatgacaatatcaataccagtgattactgtgctttcagtaccttcacccttgggtccttcagtagaggcatttccaccaatgagcaagtcatcaatattaccctatgtcttactgaccatcttcctctccccctccaggcacagcctgtttgcagtatctcagatcttgtaattgtcagagataatcatgatggtggctggaggtagatgatagcagtgctcgcttatagcagaagcctggagcttggagcaagtatggtgcagttggaaaggcactccagggaataggaagcatccagaaaagtatattgtgtttttgagtgtattgcctcttacagttttcctagtggttggtttgggtattacaatatacatatgtggcttattacattctagtgatgtcagcatttcaccattttgagtgaagtatagaaacctcacttcctttgaggttcctttattctccccacttttaaatatcattgtcttgagtatcagatggtggtgtaattttggtttggatcatcatatatgattagaaaactcatgatgagaaggatagtctgtggtattagtcatatttctgtttttttccattgttatttcttccttcctgatgctccaagactcctttaaaaaattattttctttttgtttgaagtacttcctttagccactctttaagattgtgtctagtgacaaattcctttcgttttcccttatttgagaacatcttgatttcactttcattactgatggatagttttactggacatagaatttgtggtggttgagagttattttcttttaaaagttgaaaaatgtgctacttccttcggtctccataatttcatatgataaacgtttatcatacaaggtagtatttcttataggtagtgttttatttctctgtggttgctttcaagattttttctttgtctttagttttcccaaacatcttttttcattcctttcctttttttttttttttttaagatttttttctatttggggtttgcacatcttctttaatcttcttcaaaatttgggaacttttcaaccattattttcttaaacttttttttattaaatttctctagatttagggagaacaagtgcagttttgttacacaggtatattgtttaatggtgaagtctgggcttttagtgtaattttgaacagtgtacattgtactcattaagtaatttctcataccccacccctttcccaccctcccaccttttcgaatcttcagtgacttttattcgacattctgtgtccatatgcacattttatttagctcctacttataagtgagaaaatgcagtattgggctttctgattttgagttgtttcacttaagataatggcttccgattccatccatgttgctgcaaaagatatgattttattcttttttattgctgaatattctgttgtatgcatgtgtgtgtacatatgtatgtatgtgtatatgtgtactcacacacatacatacacaccaccgtttctttactcactcatctgtagtcactattttaaaatactcctttagccccattatttttttccttttcttctgagactctgaaagttggatcttttgttattgtctcacaggtccttgaggctctctgttcttttttttttttttttttttgtctgttttctctctgatcaggctgagcagattgtattgatctgttctgaagttcactgattttgtcttctgtcatttctgtcatttcaatttatcccatccagttttaagatttcggttattgtactttgtagttctgtaactttcatgtgattctttttaataacttttttctttgctgaaatttctttttatttaccttagagaaattataattgtttgttgaagcattttatgaccattgcttgaaagttcttgtcagataattatgtgattcattgtggtgttgattgcagtttctcgttgaagttgtggttttcctggtactttgtatgacaagtgatttttaattttatcttggacattttggatactattttaatagattctgggtcctactgaaaattttattttagcaggcagtcaccttgtttaggtttaaacagaggtcctggactactttttgaactgtggttttaacgacaatctaattttcagaaacttttcagttatattttgatctgcttgagttgttgcgtgctgctgggcctccagtggtccctgctgatggtgtttgagggaatgaaaggaacttttcaaggctgaactgcctggtgcttctaagtatgggaatggagaccctggtctatgggatgaagcttcttgagctgggtgctagttgtggcaggatctctcctttcctatgaccgatgcagaatacctccagaaccatcccttgttatggtgggatccccctacttatgggtgtcagagtgtatttactggaccagctgcttgtggtgtggttttcctttgttggtgcctgtggcctcgttggtgtctcaggtggtgctgctgctgaggatggtgaatgcttcccctggctgcttattgacagggaggtttccagttgaaccttcttgctgtttcttctggcctcacatggtggtgttgatggcaatcctattaaattcaagagaagaatgaatctacctgggctgctttctgttgcaggcttaggagttgggaaacatcagatctggctcacttatttttttttttttttcagttgggagggttataagacaacctgttactatgttgttcctctagtcctggggtcttcaactagtttttcttccttttttaaacctttcagtgttttcctttggttatattttatggtattttcaggttttataattgtacttaatggagaggaacaggaagagaccaaaagcccttttgctcattttttaattgcaatgggtggaacttatttggatctggatttaaataaactaaaaaagtaaactaatttgatatgagattactcaaattttgaaagctaggtattttgtataaaagtatttttcctataatgatatgattgtgtaaaaataaaagactgtctcttagagatatgtactaagatatttataggtgaaattatgaaatacataggatttgcctcaaagataatatatatgcgtttgttcatagggtaagagtggtcattggctgatggttgttagggctaggggatgaatatgtgggactcagaatacctttgtgtatgtaaaaaattctccatgtttttaaattaaatttaattaatttattttttgcatccccctgatttctgaagtttttttttaagtttagcttatatttcttgaacaaagtttagatattatggtagaaagaaacttgcctgatttattttctttgtacctaatttttgagtattggtgaggctaacataatataggctaccaagttctaacacgttttcttataaggtgaggaaatattaaagtgtttatagtgtgtacatcccctctgatcggtactttaggagccccaggaaccatttggttgcttgtaattagaatgaaagtgcttttaccctgtaagagagttaatgtgctttctttaagtaagctcttttctagtcaccaggatctgaagttccagagttgactcttctatagattggcgtattaatacattggacatttattcattcttactttctttcacagctttctgttcaaaatcaggagtttgagataaataaagatggaatccccaaagtggatcagtttcatctggtatgtgacctttttgacatttactggtttgaaacacatgcagtaatataaacttagatatctgactgaaagttgtcctccagtttttctaagaatccaaattaacatttgcaataaatgaagtattgaaaaaaattcaggtgccctacttaacaccacttaattaatacaccagggttactctgctgggttgtttgtcacacagattatataaataatctaacaattagggaagaatattgtttactatgtgtttcaagatcatattatagtaaaataatgttttattataacttagttttttgtaagtacctaactatatctttgtcattcacatatgtattcagccaacatattttgagtagctatttctgtgataggaattgaaccaggtgctaggattacaaggattgtggcattgagaatgaaatgaataatttagaaatgtgaacaagtaagtgattaacatctataagttgagtaattagcaagtactttgggggtactccatttaccctgatttgattattacacatcatatgcttgtattaaaatatctcatgtacttcataagtatgcccataaagatttaaaaataatgaagcccctaaaaaaagtacttggggggaagctgatttttagttctgcaaagaaagggggaattcagtatgactagatataaagaggataaatatggcagtaaatgagtctataagagtataatgatcagactctggaagttcttagctattttgagttaagattacaatgaaagagtacatataattttgttaaactcagtagttccttatttgaccacacaaatattgtataataccttctaatgtcccacgaaatcattttaaaaaaacataccttagaaatgatattaaggagctttgccacacttcttgggtagcagtaaaaagcatttcagacaacttttgtgagattataaaactttgtgttacacttcctgattatctctgtggaaggggataacaaagaaggttgactatggtttacagttttgaaaaggctatgataaaaatttattgctattagatagaaaaataccagaaattctgtattagaggttacaacttcaccaaaagtgcacatccagaacccttgctttcaggtttgatagaaaaattaccttgtaccaagttatcctgaaatttagtttaaacttaaaacttatattacagtttcgtgagtcaggaatctggacacagcttatttgggatttctgcttcagttaatttaaggttgcagttaagatgttggctgggctacagtcatcttaaagctcgattggagatgaatatgcctctaacctcacatgtttgttcataggattctgtttctttcagtttattagaatgaggacctcagttgttctctagttgttggccagaggttgccctcaatcctttgccctgtttccatcatggcagcgtgtttcattgaaatgtatacgcagagaaggcagtagactctgttcactaagacagaagtcacagtttttcatagcaaaatcatataagtgatatcccatagtttttgatagtattctctctaaagcaattctctaggtccaagaggaaagaattatgtaaagttatgaataacagaaggttggggtcttggggcaatcttagaagtctgcttactctaaaatgtaatctggccaggcatggtggctcacgcctgtaatcccagcactttgggaggccgaggtgggcagatcaactgaggtcagaagttcaggaccagcctgcccaacatggtgaaaccctgtctgtactaaaaatacaaaaaaattagctggatgtgctggcgggtgcctgtagtcccagctacttgggaatctgaggcaggagaatcacttgaacctgggaggcagaggttgcagtgagccgagattgtgccattgcactccagcctgggcgacagaacaagactttgtctcaaaaaaaaaaaaataataataataatctgcctgtaatctgcaagtaatcatgccttgctaggcatgcagctaggtatatgtataatgaaagtaaatgtaaatacacagtccccgtttaatgtgggtagctactcatggattcaaggattgtggcattgaaaatgagattaataatttagaaatttgaacaagtaagcaagatttataaattgagtaataagcaagttcaaattataaaaatcttggcttgtatagtatttgcttctgtgatctgagtcagttattagtgctgggaatggaattacctttacctacattttgtgttcacacatagctgcaaaacaagtcaaggctctgtagtcagcaccttacagataccataccacaaatggagaagaatataaatgtatggaaccatgtagttgagagagttattagaggataattaatacacccttctcatccttcagaatccctccaataatatccccaagagatggccttcagcctctgcttaagtagagtaatgctgattttggtagtttgtgtctaaaagttggtccattccatttaagttatctagcttgttggcatacagttgtacatattttctttataattatttttatttctctaagttcagtagtgtcccctttttcatttcagattctggcagtttcagtcttctctcttttttttcttcgttagtccaaataagtttaaatacctagcttttggttttattaatttttctgtattgtttttctgttgtctattttcttactttctaatctttattatttctatccttctgcttgctttagatttagtttacaacatatattacacagttatcacaccttataaaattaacaaattgtaatattatatttaaatttccctaattgtcttaaatatatttttaaatggttgcttttttgaaattagcatatcaacaagatctacctgtattgggttaatatatctcttaatctctgttgagctataaagttcccccacaactctttttctccatgccatgtattatgtgaaaaaaatgatttcattttccatactttggagttggctgattgcatccttatggtattatttcatagttctcttttccccagttgaaaaaagtggtagatacagaggttaattaaatttacattcagtttttacaggcagtatattttatattattgtgtcatatgagggggatcatttggtgtttgattgtcacagtaagattgatcagtgtgttcaggcagaaaattttgtatgtacaggggtatatttttagtttttctatcccattggtttgtttattcatatcccagtgcctcactcatttaactaaaatagactttatagtagctttttaatacttatagggctagttccttcttcactgcttttttgttttgttaaaaaaaaaaacaacaaaaagcaacaaaaaaataaagtccgaagtcccaggttggagtgcagtggcacgatctcagctcactgcagcctctgcctcccaggttcaagtgattctcgtgcctcagcctcccgagtagctggtactacagtcacatgccaccacacctggctaatttttgtatttttagtagagatggggttttgccattttggccaggttggtcttgaactcttgacctcaagtgatccacctgcctcagcctcccaaagttctgggattacaggtgtgagccactgctggccctcattgctatttttaaaatcagctttcatggctattcttggttgtcattcttctaagacatctttataattaacttgtttggtctcaaggaaaaaaattatatttttattggattaatataaactttttaagtcaacttagggaaaattgtcccatttgttatgagagtcatttttgttgaagaccataataagacttttgttcctgatctacttttgtggttttcaggagcatgtgttattttttctcatttggattttgtaatatttaattgtttgcacctagggaaggtaactatctttaaatgttcttaaaaacatattctgtagagtacagacattggcattcattcatttatcaaatatttactgaatgtctgctatattcagatactgttttttgctactttctggagatgaagtgacaaactaaaatttcaaatcttaaggatcttagagtgtaatgcagacactagcagtaaacagatgatttctttcctttttttttttttttgagacagtcttgcttggttgccaaggctgaagtgcaggggcacgatctcagccactgcaacctctgcctcccaggttcaagcgattctcctgcctcagcagcttgagtagctgggattactggcatgcgccaccatgcccagctaatttttgtatttttggttgagacagagttttgccatgttggccaggctgatcttaaactcctggcctcaatgatccacttgccttggcctcccaaagtgcctgcctgaccagcagttaaacagattatttttattcagtctgatatgtgctttggttggagtaatcataagaggcaaataaaaggtatactaaggtgtcaaataatggaatagcaacattacaggatcatttacatgttctaatacaaataatgtcctttgaaatggagggatataataaattctagctcccataatgatggtgataatgatagcagcagtagaggtgatcctagagagtgatcacttaaaaaccaaaaccagaaatagttgactagatgaagaaatttacccttccagacagagaagcttcagtgtgacattttaatagtgtcaaattctgaccagtaccttgttaaaagagggagaaggaagtaataaaatttatttgttcgtatttcacttgtttttgagagatttcagctatgatttttttccttttacactttttccccataattcaattccattgtttcagtattggaggcattccatttcaccaaaaagtacagtcgtccctctgtatacacaggggattggtacagataaaatctacgcatacccaagtcctacagttggcccagtggaacctatgcatatgaaaaatcagccctttgtatctgtgggtgttgagtcctgagaatactgtgtttttgatctgtttggttgcagatgtggaaactgcagatagggagtgctgactgtacttacttatttcatattgatacataatatttgtacatatttatggggtatatgtgatattttgtaacttgtatggaatgtgttaatgacagtcggtatttagggtatccattatcttatttattatttctatgttttgggaacatatcaagtcctctcttctggctattttgaaatatttaatacattgttaactggagtcatcctactctgctatcaatcactagtacttatttcttctgtcaacctggttgtttgtacccattaaacaactctcttcacccccttccacctcacccacattctcttagtctctggtatctgtcattcaactctacctctatgagatcaactgttatagctccgacatatgagtgagaacatttgatatttgtctttctgtgcctggcttatttcactttacagaatgactgttccatccttgttgctgaaaatgacagaatttaattccttttttatggttgaacagtattccacattttctttatatttctttaatagtgttccacattgtctttttccatttgtccattgatggacgcttaggttggagtccttacctttgtaattgtgaatagtgctgcagtaaacatgggggtgcaggtttcatatactgatttcctttttattttgatgaatatcaaatattttgacacttaggttgagtccttacctttgtaattgtgaatagtgctgcaataaacatggggatgcaggtttcatatactgatttcctttttattttgataactatcaagtagtgggattactggattgtatgatagttccatttttagttttttggaaaatatttgtactattttccatagtggctatactaatttacatttccactaacaatgtataacagtttcctgttctccacatctttgtggagatttttcaaaatagtatttggctattttttgtcattttttaaaatagtggcattctagctgatgtaaaatgatacttcattgtggttttgatttgcatttctctgatgattagtgatgttgagcatttttcatatacttattggtcatttgtatgccttcttttgagaaatgtctatttatgtcctttgcccactttttaatggaattgttttccctgtcgagtttcttgtatattctggatattagtcctgtgttggatgaatagtttgcaaatttttccttcaattcaacaaattgtctcttacactctgttgattatttcctttgctgtgcagaagcattttagttaagtatagtcccatttgtctctttttgtttttgttgcctgtgcttttgaggtcttagccataaaaatctttgcctaggccaatgtcatgaagtgtttcccttatgttttcttctagtatttttatagtcttgggttttacatttaagtctttaatcaatcttgaattgatttttatatatggtgagaggtgagggtctactcttactcttttgcgtatggctatccagttttcccagcaccatttattgaagtgggtgtcttttccccagtatatgttcttggtgcctttgtgggaaattggttggctgtttatttctggggtttcaattctattctataggtgcatatatctatttctatactaataaaacgctgtgttggttactatagccttgtaagatattttgaagtcagtgtgatgcctccacctttgttctttttgctgataactgttttgactatttgtgctcttttttagttctacatgaaatttaggatttttttctatttatgtgaaaaattacattgctattttgatagggattgctttgaatctgtagatttctttgggtagtatgggcattttaacaatactaatcttctgatccaggagcatggagtgtctttccatttgttagtgtccttttcagtttctttcatcagtgttttgtagctttctttgtagatatcttccacctctctgtttaaatttcttcctaggtaatatatttattttgtagctgttgtaaatgggattactttcttgatgtctttcttagctagttcattattggtttatagaaatgctactgatttttacatgttgattctatatcctgcgatttactatattaatcagatctaaaagctttttggtggagtctttaggtttttctagatagaagattatgtcatctgcaaagagggacagtttgactttttctttttctttttttattattattatactttaagttttaggatacatgtgcacaacgtgcaggtttgttacatatgtacacatgtgccatgttggtgtgctgcacccattaactcgtcatttagcattaggtgtatctcctaatgctgtccctcccaccaccccacaacagtccccggtatgtgatgttccccttcctgtgtccatgtgttctcattgttcagttcccacctgtgagtgagaatatgtggtgttcggttttttgtccttgcgatagtttgctgagaatgatggtttccagcttcatccatgtccctacaaaggacatgaactcatccttttttatggctgcatagtattccatggtgtatatgtgccacattttcttaatccagcctatcattgttggacatttgggttggtttcaagtctttgctattgtgaatagtgccgcaataaacgtatgtgtgcatgtgtctttatagcagcatgatttataatcatttgggtatatacccagtaatgggatggctgggtcaaatggtatttctagttctagatccctgaggaattgccacaccgacttccacaatggttgaactagtttacagtcccaccaacagtgtaaaagtgttcctgtttctccacatcatctccagcacctgttgtttcctgactttttaatgatcaccattctaactggtgtgagatggtatctcattgtggttttgatttgcatttctctgatggccagtgatgatgagcattttttcatgtgttttttggctgcataaatgtcttcttttgagaagtgtctgttcatatccttcatccactttttgatggggttgtttgtttttttcttgtaaatttgtttgagttcattgtagattctggatattagccctttgtcagatgagtaggttgcaaaaattttctcccattttgtaggttgcttgttcactctgatggtggtttcttttgctgtgcagaagctctttagtttaattagatcccatttgtcaattttgacttttgttgccattgcttttggtgttttagacatgaagtccttgtccatgcctatgtcctgaatggtattgcctagttattcttctagggtttttatagttttaggtctaacatgtaagtctttaatccatcttgaattaatttttgtataaggtgtaaggaagggatccagtttcagctttctatatacggctagccagtggtcccagcaccatttattaaatagggaatcctttccccattgcttgtttttgtcaggtttgtcaaagatcaggtagttgtaggtgtgtggtattatttctgaggcctctgttctgttccattggtctatgtctctgttttggtaccagtatcatgctattttggttactgtagccttgtagtatagtttgaagtcaggtagcgtgatgcctccagctttgttcttttggcttaggattgacttggcaatgcgggctctttgttggttccatatgaactttaaagtagttttttccaattctgtgaagaaagtcattggtagctcgatggggatggcattgaatctataaattaccttgggcagtatggccattttctcgatattgattcttcctacccatgagcatggaatgttcttccatttctttgtatcctcttttacttcattgagcagtggtttgtagttctccttggagaggtccttcacatcccttgtaagttggattcttaggtattttattctctttgaagcaattgtgaatgggagttcactgatgatttgactctctgtttgtttgttattggtgtataagaatgcttgtgatttttgcacattgattttgtatcctgagactttgctgaagttgcttatcagcttaaggagattttgggctgagatgatggggttttctagatatacaatcatgtcatctgcaaacagggacaattggacttcctcttttcctaattgaatgccctttcttccttctcctgcctgattgccctggccagaacttccaacactatgttgaataggagtggtgagagagggcatccctgtcttgtgccagttttcaaagggaatgcttccagtttttgtacattcagtatgatattggctgtgggtttgtcatagatacctcttattattttaagatacatcccatcaatacctaatttattgagagtctttagcatgaagcgttgttgaattttgtcaaaggccttttctgcatctattgagataatcatgtggtttttgtctttggttctgtttatatgctggattacgtttattgattttcatatgttgaaccagccttgcatcccagggatgaagcccacttgatcatggtgggtaagctttttgatgtgttgctggattcggtttgccagtattttattgaggatttttgcatcaatgttcatcaagaatattggtctaaaattgtcttttttggttgtgtctctgcccggctttggtatcaggatgatgctggcctcataaaatgagttagggaggattccctctttttctattgattggaatagtttcagaaggaatggtaccagctcctccttttacctctggtagaatttagctgtgaatccatctggtcctggactttttttggttggtaagctgttaattattgcctcaatttcagagcctgttattggtctattcagagattcaacttcttcctggcttagtcttgggagtgtgtatgtgtcgaggaattcaaccatttcttctagattttctagtttatttgcgtagaggtgtttatagtattctctgatggtagtttgtatttctgtgggatcactggtgatatcccctttgtcattttttattgcatctatttgattcttctctcttttcttctttattagtcttgctagcagtttatcaattttgttgatcttttcaaaaaaccagctcctggattcattgattttttgaagggttttttgtgtctatatgtacttcagttctgctctaatcttagttatttcttgccttctgctagcttttgaaggtgtttgctcttgctcctctagttcttttaattgtgatgttagggtgtcaattttagatctttcctgctttctcttatgggcatttagtgctatacatttccctctacacactgctttgaatgtgtcccagagattctggtatgttgtgtctttgttctcgttggtttcaaagaacatctttatttctgccttcatttcgttatgtgctcagtagtcattcaggagcaggttgttcagtttccatgtagttgagtggttttgagtgagtttcttaatcctgagttctagttcattgcactgtggtctgagagacagtttgttataatttatgttcttttacatttgctgaggagagctttacttccaagtatgtggtcaattttggaataggtgtggtgtggtgctgaaaagaatgtatattctgttgatttggggtggagagttctgtagatgtctattaggtcctcttggtgcagagctgagttcaattcctggatatccttgttaactttctgtcttgttggtctgcctaatgttgacagtggggtgttaaagtctcccattattattgtgtgggagcctaagtctctttgtaggtcactcaggacttgctttatgaatctgggtcctcctgtattgggtgcatatatatttaggatagttagttcttcttgttgaattgatccctttaacattatgtaatggccttctttgtctcttttgatctttgttggtttaaagtctgttttatctgagactaggattgcaacccctgcctttttttgttttccatttgcttggcagatcttcctccatccctttattttgagcctatgtgtgtctctgcacgtgagatgggtttcctgaatacagcacactgatgggtcttgactctttatccagtttgccagtctgtgccttttaattgaagcatttagcccatttacatttaagattaatattgttatgtgtgaatttgatcctgtcattatgatgttagctggttattttgcttgttagttgatgcagtttcttcctagccttgatggtctttacaatttggcatgtttttgcagtggctggtacctgttgttccatgtttagtgcttccttcacgagctcttttagggcaggtctggtggtgacaaaatctctcagcatttgcttgtctgtaaagtattttatttctccttcatttatgaagcttagtttggctggatatgaaattctgggttgaaaattcttttctttaagaatgttgaatattggcccccactctcttctggcttgtagagtttctgctgagagattcactgttagtctgatgggcttccctttgtgggttacccgacctttctaaactctggctgccgttaacattttttccttcatttcaactttggtgaatctgacaattatgtgtcttggagttgctcttcttgaggagtatctttgtggcattctctgtatttcctgaatttgaatgttggcctgccttgctaggttggggaagttctcctggataatatgctgaagagtgttttccaacttggttccattctcttcgtcactttgaggtacaccaattagacgtagatttggtcttttcacgtagtcccatatttcttggaggctttgttcatttctttttattcttttttctctaaacttctcttcacacttcatttcattcatttcatcttccgtcactgataccctttcttccagttgatcgcgtcggttactgagtcttgtgcattcgtcatgtatttctcgtgccatggttttcagctccatgaggtcctttaaggacttctctgcattggttattctagttatccatttgtcttatttttttcaaagtttttaacttctttgccattggttcgaacttcctcctttagcttggagtagtttgatcttctgaagccttcctctctcaactcgtcaaagtcattctctgtccagctttgttcagttgctggtgaggagctgcgttcctttgtcggaggagaggctctgatttttagagtttccggtttttctgctctgttttttccccatctttgtggttttatctacctttggtctttgatgatggtgacgtacagatgggtttttggtgtggatgtcctttctgtttgttagttttccttctaacagtcaggaccctctgctgcaggtctgttgtagtttactggaggtccactccagaccctgtttgtctaggtatcagcagtggtggctgcagaacagtggatactggtgaaccacaaatgctgctgcctgatcgttcctctgggagttttgtctcagaggagtacccggctgtgtgaggtgtcagtccacccgtactggggggtgcctcccagttaggctactcgggagtcagggacccacttgaggaggcagtctgcctgttctcagatctccagctgtgtgctgggagaaccactactctcttcaaagctgtcagacagggacacttaagtctgcagaggttattgctgtcttttgtttgtctgtgccctgcccccagaggtggagcctacagaggcagggaggcctctttgagctgtggtgggctccacccagtttgagcttcccagccactttgtttacctactcaagcctgagcaatggcaggcacccctcccccagcctcgctgccgccttgcagtttgatctgagattgctgtgctagcaatgagcgaggctccttgggcgtaggaccttccgagccatgtgccggatataatctcctggtgtgccgtttgttaagcccattggaaaagcgcagtattagggtgggagtgacccgattttccaggtgccatctgtcgcccctttctttgactaggaaagggaattccctgaccccttgcgcttcccgggtgaggcgatgcctcgccctgcttcagctcacgcatggtgcgctgcacccactgtcctgcacccactgtccggcactccccagtgagatgaacccgttacctcagttggaaatgcagaaatcacccgtcttctgcgtcgctcacgctgggagctgtagactggagctgttcctattcggccatcttggctccaccccctgacttgttctttttcaatttggattccttttatttttcttgcctgattgttctgactaggacttccaggactgtgttgaagagaagtggtgaaagtggagatccttgtcttgttccagttctttagaggaatgtttttctttttctttctttttttttgtttttctttttttttgagatggagtttcgttcgtgttgcccagctggagtgcagtggcgtgatctcagcgcgctgcaacctccacctcctgggttcaagcagttctcttgcctcagccttgccaagtagctgggattacaggcgcccgccatgatgcccagcaaattttttttttttttgtattttttagtagagacgaggtttcactgtgttggtcaggctgatcttgaactcctgacctcacgtgatgtgcccacctcggcctcccaaagtgatgggattacaggcgtgagccactgtgtctcactagaggattgcttttcttttccccatttagtaatgatgttagctgtggctttgttacagataggctttattttgttgaggtgtgttacttatatacctagtttgttgagagcttttatcataaagggatgttttaatctatgaaatactttttctgtgtctattgagatcgtttgccatatggtttttgctctttgttcagttgatgtgatggatcatgtcgctgatttgggtgtgttgaaccatcctagcatccctgggataaatgctaattaatcatggtgtattatgtttttgatgtgctgttggattcggattggtagtattttgttgaaaaattttgcatctgtgttcatcagggatactggtctatagttttttgttgttgttgtgtccttgtctggttttggtatcaaggtaatggtgggctgggccttgtagaacaagttagggagaattctcgcctcttgaacctttgcagtagtttgaggataattgatgttagttctttgaaagttcagtagaattcagcagtgaagctctgtggtcctggacttttctatgttgggagactttctcttactgaccaaatcccgttacttgttactggtctgttcatgttttctatttcttactgattcaaacctggtaggttgtatgtgtccaggaatttatatatttcctctaggttttccagttgttcatgtatagttattcataatagtctttatgttttgtatttttttgtttgtttgttttgagacagagtctccctctgttgcccaggctggagtacagtggtgcaatcttggctcactgcaagctccgcctcccgggttcatgccattctcctgcctcagccttccacgtagctgggactacaggcgcccgccacaacgcctagctaattttatgttttgtatttttgtgatatcaggcatagtgtcttctttttcatttctgattgtgtttattgcagcttttttaaagttttagtacagctagcagtttattgattttgtttatcttttaaaaaaattttttttgtggatcctttgtattttttttagtgtatttcacttagttctgctcccatcgttattcttcgttttctactaatatgtatcaggttgtttatttgtaatcttactccttttttgatagaagaatttattgctataaacttctcttttctcactgcttttgctatatctcatcagttttgttatgttgctttgattttcaattgttctaagacattttcttattccctctttaacttcttccttgaaccagtgattgctcgaagacattttctaattccctctttaatttcttccttgacccagtggtcattcagcagcacgttgtttaatttccatgttgtgtgtgtgtgtgtgtgtgtgtgtgtgtgtgtgtgttgtttttgagctgggggtctcactctgttgcccaggctggagtgcagtggtgtgatctcatctcactgcaacttctgcctcatgggtacaagcaattctcctgcctcagcctcttgagtagctgagattataggtgtctgccaccacactcatctaatgtttgtatttttagtagagacgaggtttcaccatgtcagccaggctggtctcaaactcctgaccttaagtgatccacctgcctccacctcccaaagagctgggattataggcatgagccaccgtgcctggccaatttccatgcgtttgtatagttttcagtttctcttgttgatttttagttttccattgtggtctgagatgatactggatatgattttaattttaaaacattttttgagctttgttttgtggcttaagatatggtcgtttcctatagaatgttccatatgcttatgagaagtatgtgtattctgttgctgttgggtaaagtgttctgtaaatatctgttaggttaatttggtttttaagtgcagtgtaaaatcagtttttttaaaattaattttctctctagattatctgtctagtggtgagagttgggtggagtctgtttctccctttagatctaataatatttgatttatatatctgggtgctctgttgttggatccatgtatatgtttagaattgttacattctcttgctgaattgatccctttattattatataatgaccttctttgtcactttttgctctttttgacttaaagtctgtcttacctgatacaagtatagttacacctgcttgcttttggtttccttttgtatggaacatcttttcccatctttttgcagcatacaattgggtcatttaaaaaaaagaaaaactcctttcaaccagtctatatcttttaggtggaaagtttaactggtttacattcaaggctgtcattgatacatgcatgagggttaatttctgtcattgtattaattgattctggttgttttgtgtatcttttgtttcttattttctctcttattcattgtggtttggtggttttctgtcgtggtaacacttgaattatttcttttatttgtgtgtttgttttaccagtggagtttatatgtgttttgtaatggtagatattgttctttcacttccaagtatacaactctcttagtagagacggggtttcactgtgttggccaggctagtcttgaactcctgaccgcaggtgacctcaggtgattccccccaccacggcctcccaaagtgctgggattacaggcataagccactgtgcccagccagatgatctatttgcagtgtgattatcggctcattattttggtgtttttttttgttgaggggagtaccagatacctcgtcagtcatcttgaaacccctccttcctgactgtatttattgaaaaaataagtccacttccttcttcattacagatttgtccttttgttcctttgttttgtaacacctgtttttccttgcaggatgataaagtcaaatccctcctctgtagcttgatatgttatagaagttcaatgactgctgaacaagttttaaatgctgaatgtttcttgatgccaaaggagcaatcagttccaaacccagaaaaagatactgaatacaccctatataaaaaggaagaagaaataaagacggagaacttggataaatgtatggagaagacaagaaatggtgaagccaactttgattgttaaattattattgttgttgttgcagaggttctttttaaaaactttggtttggttaatacacagaaatatctagaaatgttctgggactagttgagttgtatctttagtattcaggttgtgaaaaataaagatgtttggctatgca

SEQ ID NO: 1253 - DNA, 880831 bp, Homo sapiens
ttagaagctctgagaaatcatgggccgtgcggtaggggttgaaatgctcaaaggtccacacttcttgaaataaacagaatggtcttgagtggattgcaactgttttggaaatagctttgtgaaaagagggtggagagctactcaaaattctacgttagagagactgaaaagacatctaatttcattgctcggcaggtaagtgatagcgctattatttttgttttttaaaattctaatgacttgtcttatggtttaacagaaagatcataagcagtgtaattttttctggggttaacgaggagacaagcaattttgttttaaaataattgtttctggatcattgtgtgacaagaagaatcaaaataacatacatgttgccttacataattacagtaaacttttagctggccatttttcttattgcttatctaatatctttttggatctggcatatcttgtttattttttcccaaaactaatgcaatcgtttggcaagataattttgttgtcttatgtatgccataaaaagtgatcctgtctgtgttacatagtatgcaagactaaaaaagttaaaatagagagggtttaaccatgccctctaacatattttatattgttataatatactaaactatgcatgggaacaaatacatgtatacatatacaccagatttctcactccatgccaacctccaagtatacctacacctgtaggatcttacgtaaggagacactcatatttttacttagcaccctctttccagcctttgaaagctcaagattgctttctcaaacctgatctgccagaaagcagaaaatgagaagctttagtgtgcctctttaggagagctggatttcaaaatcattctaacttattagttctgcaaaatacatttgtcagtgaaatccagaaagtgatagggaccagtaggttcccgaaaaaccataaactttaaaatgctaattaaatctgttttctgttgattcttatttctagttttcccctggagctttaaaattacaatctttcacagtgaccttgataagcattctgctttaataaaaagggttcactgggcaaaagcagttacacaaatttgtaacccgtgcctgacatttcactaagaatccgatcaattccaatgagtacattcagttcagtgaagagttttgacttgcaaggatggaattttacagtcatgtaaatacatgtgatgagatattcataatcaactctgtgaaaagagtctacccctttgaaaaattacaggagatctttaggttttacttttaatttcactggttgtgtgtaacgatagtaaaatggctctaatgcatatctatacgtaccttccttctcaattttaacacaaaaatcattggaggccgttacagtggcattcattggtggggtgatgtcctcttgttttatgttggctgagtgtagcaattactctgaggaaaaatcattcttaactgtcaccacttaccatgaacctgcttgcttagcagaaaaggagcagaggcatctatgtcactgagctccttgggggctccgttgccctatataggtcaagaatgattatctgaggaggagaaacatgtattattgatttggattccttcccagaaaacctacaatgtgctcttaacacaatcctttttttcctcagtgggagaggtatggaagtgaaattatcacatggaagacttaatcatattttaagagagttacagcatgtctttagacaattattttggctgtcaattaattaacacagagggactcccctagtcagtagggcataaaatgtaagcagagaatgtgtttcaagaagcactcctctgtgtatatggccgcagttccctcctcaggggcagagggggcaggctttctctatgtgtaactgaaatctcacaaagtgaaagttacctttgcctaatcccttaggagatttagtcacagaaatatgtaactctaattcaccccaaactcatgaaactgcatggaaacccttgtcaatccttatctgtagggaaatgtccttacattgagatagagtttgggaaagcaacttaatgcctaccaatgctaatctctaattgtaaagtagatagtcaaacaaacaaacaaaaagggggtagtggaaaccaatcttcattattgcacagaatcacttgtctttaaagaaaaatcaacattttattaagggatatctgtaccccactaagggcatctatttgctttgatagttattttgttttgctaaagaaaaaggatgcatgaggtcttgggagtaccaaacacactatcttttccccattaaaaaaaaaaaaaaagttttattggataagactaagtgttgttggctgttgcttacatttgagactcaaaagagaaaggtgagatgggattacataatctagaaaatgtaaagtatatataggaccagaggataatttaaaatgagccctggaatccattcaattgccttcttccaaaatgttataaaaacacttcttgattaatttttgcatagactatataaatattacttgtatattctaatgtaattattcataccatgaaatcgtattggattttaatgctcacagtttgcctttggagttatttacttgggtttcaatcaagttcaaacatttatcaaaaaatataaaagtaaaaaatgactattgctaatatttagtaattggctgtttttgaccacttaaagatttataaattccaagcagctagcctgcttactcacctagttctgttaagcaacacaaaagccactaggaaagaaaaaagcatattgtaagctagaaattatttccatagtaatctcaccttcccagaaatctgtacagtgtgttatagaatagaattcaaatggagagagatctcttatttggtgttttcttcctatttagcttagcagagtgagcacatagcatgtgttggaagagacaacatcctgtggtaagaaacatgttacacatcatgttgtagggaaacaagtactacttgacagtcaaaagatcagaattttttaactgctggccataagatcttctacaagtcactcaatccactgcagctgaatttttcttccttaaatttggggattctttacttttcaatgaagacacaataatttacatacagctgatacctgaacactcatgagataagtgaatgatgcctactttgtgggatactggaaagtcgaaattcaatgattttgagagtgttttggaaacaagtgttatatctgtgagttattataaataatttccaatagcattcattcattcgtcaaaaaaaatcccactaattactaaataacaggcacatcccttatacttaacaactctcagcatagggaatataatacttccctgatacttcagcagtcatttcctttacatctcttaatggtataaatataagtgatattcaatgaaggtggacttggtttcaaaaatattttattactcagaactgacaccacattctatatcaattggacaaacttagttgacctgagtctatttcaacaactttcattttgaccttcaaagaatctatcatgtcgtgtcataattttctagtttataaaggaggattaatgtttgtcattagtgatattgataaggaaactcatacgatgaaatacacttcaaaactccatatcctaaaacatacagaaagcattgtgatttgactgctggcttgtgagcatggagtgaaatgtggacaacatgcgggctgatctaaggggctagcctggaaatgctgttaagatgttgttttgatttagtcgaaagcctagattttattcataggcctctttaggacatctctttagaaaatcgaataagcagtatttcattgcttatttgcttttcttagtcgggttttaaacgtcactatgattttttcaatgtaatttatcaacatttggtctgtatagatttctagactatcactaaaaatatactgacagtattcttaggaaatataagtcaatgtttggtgttacagttatttccagcattgttttgtggttaaattatataattgcaccagcgataaaaaattatatcatcacttacttagtaatataattcagatttttttttgtcaaatacacacacacacacacaaaaacccagaaacagtcaaaaacataaaatgaaaaagaactgagagtaagaggtcattaaaataatgtcttgaggccagagaatttatctttgaattatccttaaattttcaccgtgaagtttcttcagcacattctacacactgaaagagtcagaaaatcattttgggtctcctgaatttggtcttcaatttgtcagcaaagataaagtgatcatgttatattttttttcaaaaagagtgtcattaaatcaattcatttgaatacttgcttattatcacttcatcatatgtaatgtacatacttgaagatatttttaaaattaaaaattgtgaagtaattatatgctctatgtttaacaaatttactcacaatttcggtctaagatttagttttttaaaagaataagtgcttgcctggtaaattcactaaataagctaatagaaaatagaaatcttttagaaatggtgccaaaatttgaacaataatgtgttacttatataaaactatgaaaaggccaagtacagtggctcatgcctataatcccaacactttgggataccgaggcaagaggatcacttgaagccaggagttcaagaccagcctgggcaccacagtgagacctcgtttcttcaatagaaaaaaaaaacataaaaaataaaaaaataatatctgggtgtggtgaatgtgcctgtagtctcagctactcaggaggctgaggtaggaggatcacttgagcccagcagtttgaggctgcagtgagatataatcacatcactgcactccagcctgaatgagattctatctcaaaaaaatatatatattaaaaataataaattttatttgaatcttttcaaggggtgagaaataagtatgtgagattaagaaatttagatcatagatgagaaaagagtattttatggttaaaaatgcatccagtacacacaaaatctgaggttcaacatggtttgtcatcaattggttgtgtggacttgggtaaatcactttatcttaatttaactgctcagctatatccttggtcctattggtaaatcattattatgtccatgagaaaataaacaatgtctatgtttagttgaactcataaactttccttccacatctgtcatgccattcttcttgaaaatgtttccgtgctctcatggtggaacatacatgggatttagaatcagacttaagttcgaatcctgttatagaaatggcattaatgacaaaaacttgggcaaggaatgtgaagtctctaagtctgatgtccactgcagtgtgttgctgggaacagttaatgagcaaattgtatacaatggctagtacattgaccgggatttgttgaagctggtgagtgttatgacttagcctgttagactagtctatgcacatggctctgatcaactaccgctctctcatttctccagataaatcccccatgctttatattctcttccaaacatactatcctcatcaccacatagttcttttgttaatgctttgttctagactttcccttttctgttttcttattcaaacctatatctctttgcatagattgtaaattcaaatgccctcagggtgcaggcagttcatgtaaggagggaggctagccagtgagatctgcatcacactgcagaaagtgagcccgtcaagagtcctcgactcagctctgctcagttagaacaaaacgtgagaactgaaaatagagaattttgtgtgaaatctactttttgctttacctaatttcattgttaaaattttgcatgtagcgaaacagactacatgctagattccacacatagctgccgaaccttttcgtttcccatttcaatgacatttaatagaaaccctaaactgagatattcagtcagattttttccagacctttttgtttttatctagaaatgagacaatgaaccacgacttgatgaaaaggttcatcttaatatgtttttacaattttaaaataaataaacctaaaaaataatgagtggctgagataaaatagatacttcatgtttttgaatgggcaaaagttttgtggggaaaaattaactcatagaacaaataggaatgaagataggtcaataatattacataatatgttttattccagcatcttttccagctactgtttttgcccctcatacacatgcaacagctacaataacccagataataaccttgattaacagtgagactaagaaaagattattagttattgactaatatctgcaaatatcccttcttcccagaatacaaattttctacttttgtgcctactcatatgtgtaaaaacagataatttctttagaaagttattttttacatttcatcagcaaattataacacactctatagaatattctgttggatttcacaaattggaggcagatgtcttattgtatgttcggtgatgtaagtccacacacccacacaaccgcacaaacacagggatggataagattatgctttggtttgatatatggcaatttttttttgtaatttcttcttttctaatccttgttaatagtgactgtgccaaagggaaaaacaattctgcagttattgatggaaaaaaaggagcttattttgcctaattggtatttgtatattttaatttctttttttgctagaagtgacaaaatcccagcttaaagtggcttaatccaaataagcaactaaataaaaaatatatttgcaaaagagaattactggcttatgcagtagcagattatagcaggtatggcttgattaaagtgttcaaatactatccgcattcttcagtgttgtcttcattccaaagtacggtttgcctacgtgataacatttgcctctttctctgttctcactgtctttctccctcactcctgtctatgtttctgtttctgtctgtctcttttctccccctctcttcttcatctctttctctgtcttactcacctccttaccagttatagttctacagtgtttccttcccaaatccagttcacttcctcaatagttccagtagatgtactgggattgaccaagggaatattacatattgggctggatcttgaagtaggatgggctttacaaaaccacactgattgaggggtattagttattgactaatatctgcaaatattccctcttcccagaacacaaatgactagcatagtgcagttttcagtgaaaggggagactacattaaaggatagaaaagaacaacacttgtcctctacaatgctagtgaagaatctacccaagatttctaagtcactgaatttatctactgctgagggaatactcagcaaaagtgggctcattggcttgttgtttctctaaaagcttttttttcctaaggaaagaatgtcttaagatgaaatgtttgactttaaatgtaattaacatatcaaagttttgtgggtgtccttttactatattattaacaaatgaataatatgaaaaggacacacaagtggattaaaaaatcattggggataaaaaaatagttattccagaacagttattttttctatatttggtgacttttttcagtagttttaaatgatatttccttatttaacacatggtggagcctgttccagcttagctagactatttcccttttgttttcctggtctggttttaatcttgaagaagtaaaactcccgaaagtagattaatctacttgtgtacattttacaccattattatagatgagccaatcaagagtaatacaatagcgcacacttagagtcaaagtaagtcagattgtggtagtttgtccaattcattaacttcataaattaactttatttttctcttcaaacacatctttttctcaacttaagaatccttttaagcgattagagaaaactaaaatatgtccattatctacctaagtcatttgcttttattttccatattgtgttcttttccaagaaatctccttgaagttggaactagaagtttcagtataaagtcttcatagggcataataaatgcatttgggaaaatgtaaccctacactttagtttccgttcgtaatactattttctcacattctatgtgttatacatgattgttagagtcctgttttagggaatctcatgtgattctcacagcaggactaggaagctgactttttcattcctgttttgcaaatgggacaatcaagctccaggaaagttaaatgcttctctatagattaagtcaaaattgagatttaggatcaatatttaatgcttttctattcataagtggtttaggaagaaaaactgcctctcttcttataacacctattataggcttgacttgctttagattgcagtaaataaataaaaaaacaaataaacaacaacaacaacaacaaacagaacagctgaatttcattgactttagttttactaactaagtaactggaggcgtttagattctcaagaatcttgaagggttcatgtgttatcttgatcttaatcttatacaaacagagaggtttttggacagcataatcacatgttgaaagtcatattttacaagcttcagggaaccatggtggaccagagttgattctattgcagaattcagacttgagatgatgagagctggacctaattgggtgaaggttagaaattagcctattaaaactaaatgactagatgttagtgatgccgctatcaaataaaacaagaatcaggaggaggccaaatgagatagtgtttttgtgtactaggtaaatgctcacatatgtaagtgtgaaatacgcttctttggaaggaaagatgtgatatctgacatgggacatgtcaaatggataatgagaggacataacaaccaaatgcaggtgaagaacccattaattttagaaagagggtaaaacctgacctatctaactcagagctaccgaagtggagattactgctaaagctatgaaaatttattagctatttgagagaataaaagaaaaacaattgtttacagacataaatatctttcaaaagtaagaaaaaaataagagaaaagaaggtcataaaagagtcgtagaaagtgtaggggaaaggtataaaggaaaatgcatggagttctaacaaacataccatggttaacagtgttgatactgcacagaagtgaaaggaatggatgtttgaggttcctttgggtttgctcaaaagcagatcacagggcatcctggagagaacgatttctgaaaaacgattaacataatgtttggactgtcagatcctcaagatcaaatcaaggatagacagtagaaagatcacgttcattctaggaagatagtagggatcagaagggattttgtgacaaggaaaaagcactgcagaattattgctgacaatgtgtgttatctcccttattgcttccggtttacagcctgctttagaattaggtgatgctgcatttctgggaatatgagtgctttgttgcatttgatcagatcaggtctgtctgtggtgattaaggtctagtgattggaattataaatgagagtatagtcaaccaaaaagatacacatactacctgggaagacatctgtttaaagttttcttttctccacctcattatatattcaattttaagtgatcatgtaaaatatgcataaaatatacacataaaatagtcaatagttgctcatttgttttagccactgagaattgactgagttctccacttggaacatgtaaggtagtgttgactttacttgaaaggctgacatccatttcagataacggtgtctctttttattttatcatcctattatattctcttctacgtgatttgccttctctgcttttcatgttgtgtaaaattttcatatttttctaaaagaaattttggagcatgaagaatgcatacaaggggtctgcagacccatctaaactttgttagtagactttatatctcactgcggctcaatgacctggaagataaactggccctgtctgttccatcagaacaacaggaatttcccgagttcaggcaaacagaagtttgcttttgtctgatactcaaatttctctctcaatcactcagattctccagataattgcctggcttttttcttggtactagaggagtgaattatctactttctggaggccaattaagttttctaaaccactagtgggcatttcagcaaattaccttttcagtgcactaaaaagctcctcagtaacccaaaagaattaatgtaccaccaaacagtgggcaatttattccctcaccactgatgagggcagacagtttagagcattaatgggagcatttacattgagtcacagtgaagtatggagtcactgagcctttgtgaagctaacccatggagggtgaggaggtgtttatcactgtggagaagggaggagggacaaaggagatgatccctacccttaaaagctgtagataatgctgtcagccattatctggatggaattcctatatcatcatctgtatatttggcaataataggcaagttaacaacccatggtcatgaataattatctggttttagagttgtataaaagtattctttgtgaaataatcaaatcttttattttttcatgtactgaccattgctatttttatcctggtcctgtttgtgaaatgggataatttatttctgtcaactaaaaaaatcaatgacttggatgtaaatgaacctactacatgtaactggttttggttttaactcttctcctgtttttctccataaatgtactgataaatgtaatgattcgtgtctactttattaattactgctatttcctgctgtggtagatattccacctgaaatatctggaaattcaactgaaagaattgtttaaggccctttttcttaggtctcatgaatcatatttcaagcaatatatgcatattactacataccattctaccgaataactcaaagatatcccaccttgtttttaggagatattgtcaaaaacactgacaaataccaaagatttcctagtcatgcttacgaatggataaaattgtttggagaactaaacaattctactatgtataattcaatgttgggattttgttaaaaaataaaattccttcaaatcttacccaatctttatttctgtgaaacatttttgggaggggaaaatatggataaaataggcctaatagtagaataatcaattaaatgaagcctagaaattatttacattatttttataagcatataaagtcttcaatagcctattttcttctgaggagaattaacaaaattccaaatgaaatacagtctcttccttcaatgtgtacttccagaacatttgcataagatcttcactgtaatgaagccaaattactcagccttttcacgtttataaaggatacatgttaagacattgagtcctaggaggaagatggcacttaaatacatgaaagttttgagcatcaatctcagactatattataactgctcctaatgaacatggaatttaaacaactggaacaaatccaataaggagaaaaaaaaaaggcttggcatctgatgagttacttagcatatctttttgtaaagaataaaagctctctggcttccaacaaagagtttgtgagctgtatggcagtgttttgaacaaggagatcatttataaatgctgtctttatttgggaaataattatgggatgcagctgcaagttttaatgacttttaataaagtatgttataaagtgaattagcaataaatatctaacagatgatactgaatcaagacattaaagaacatcattagacctatatcttggattgctaaagcaataaatgtgtttttgttaataccagtggttttttaattttctaggacattctgaaggaaattttaaggcaggttaatttttaatgaatagggttagtctatcaactagctctgctagcccagtacaattttagatatgtaactaatagggtatcaaagctgaaaactcttaaatttcaacaatatatagaattataaaataagtttcaccggtagtatctgaaaatacagtatttcagccacttaaattattatgactttcataaagaaaggtatatgtactttatagaggaaaaaaagtttgttagaaaatctgtgttcaacacttgctttgctggcattaccacaactaaatttcaatgtcaggtggtcagaataccaatgatcaggggcaaatacagataataacccacacttcctgtttgtacaagtattactatgccacctcagtatgcagaataatgcagtaaaaatttgttttaaaaaccaagtttagttaccaacctccagaagtgagcagagccgggctaacatagcattgtgatatcactataagctggctttggaaatgtactcacagatgatcaggttaggaagctgaccctcagaatgtctgcaatttgtttcaagtttcaaatttagtttatgagggagtttagacattaattatgttttatttcatgatgatactccaaaaaggctaaagaaaagttgaataatgtttaatgggtacctctgtatgtaaccatagttcagggcaaatgagcaatctaggatgctgagaaacaagagaagaggcaagttgtaagtcttgcttgacttctcaaatgatattcaatcatggttgaattcccttcgtagatgcagctattggccaggtgtagtggctaatacctgtaatcccaactctcagaaagtctgaggcaggaggatcgcttgaggccaggagttcgagatcagcctggacaacaaagtgagacccccccatcactacaaaaagtaaagtaattatccggatgtggtggtgtgtgctggcagttacagctactcaggaggcagaggcaggagaattgcttgagcccaggagttcaaggctgcagtgagccataatcataccactgcattccagtctaagcaacagaaccagtacctgtctctaaaaaagtaaataaataaaataaacaaattacagatgcagctatgcacagttatgttatatttaaataattacttgtcttttaactttttactttaattataaactgaaagaaggttgcagacataaatttctcatgaaaacttctccaacttccttcatgataacatcttacataattgtaatacaatacccaaaccaggaattgatattatacagtattgacaaatacactatagccttatttagatttcaccagtttttacctgaactaatttgcctgtgtgtgtgtatctgtctgtctgtctgtctgtctgtctgtcgctgtgtgtgtggagttctgtgtggtttatcccatacatagatttgtataaccactctcacaatcaagatatacaactgttttagcaccacaaataaacttccttggtttatctggtacagtgtgattcacacccagctaccctggaaaccactgttctgctctctatctctacaattttgtcattttgagaatgttacataaatggaatcatatggtatgtagcatttgagatccattttttgcactcagagtaaactatccaagttgttgcctgtgccagtagtttattcattttaattgctaaatagtattttgtggtattccagcttttccaatctgtttgctcatttagtgattgaaggacatttaggttgctttcagtttggggctactgtgaataaaggtgctatgaatattcatgtacaagtaattgttattcagtaatagagaactggaatatctccctatgagcacacttgatcacttaataggacgtaataacaatatattttgagaaggtaggtagaccaggtactagagaatgacttgaatcggtcatcctaagttttaaactctggttttcatgggtgggtgatggttttttactggttgccttttctctattagtttcagatatataatactgtaaaacaataataaggttctagaaattaatgtaaaatttaaacaaatcaataaacttcccacacaagtatcgattttctaagaagaggttctaggtaatgtcatatttacttgattttataattacccatatgttctattacgaaaaaataaataggtttgtgaaaggtaacaaaaaatctacacacaatttgtacaagtataatttttttacaatttatattttttagaagttcacaaatatatttataaaaactggagcatatattgtgccataaagaaaactatgctgaacttcaaatgattaaatttcaaacaccatgatgttatatcaatacaatttaattaaacataaattaattaaaaataactagagtttttcaacaaataaatatgaaacaactgaacattcacatgcaaagaaaatgagtctagacatagaccttaacagtattgacaaaaattaacttaaagtgaatcattcatccaaatgtaaaattcaaaaccactaaactccttgaagatatcataagagaaaatatagatgacctttggtatggcaatgactttttggatgtaacatcaaaggcataatctttcaaagaaataattgataagctaaattcattaaaattaaaaatatctcctctgtgaaaggcaatgtcaagagaataagaagacaagctatggaaaaggagaaaatacttgcaaaggatatatttaataaaagactgttatttaaaatatacaaagagcacttcaagcccaacaataggaaaataaaccaaccaattaaaaaatcggtaaaggaccttaacaaacatctcaccaaagaagacatgcaggtggcaaataagcatatgaaaagatgctcaacaccttatgtcattaataaattgcaaattaaaacaacattgagatgccactgcacaacaaaaaaattagaaaattagaatggccaaaatctaaaacactgacaatacaaaatgttgacaagaatgtggggaaacagaaacttatccattgctggtagaaatgcaaaatggtagagccacgtggaatacagttggggacttttttacaagactaaacatactcttagcatacaatctagcaatcacacttgttgttatttactcaaattatttgaaaacttacgtccagcaaaactggctcaggaatatttatagcaactttattcataataccaagcttggaagtaatcaaaatattctgcagtaaatgaatgaatacataaactctggtacttccaggtaagggaatactaaaataaatgagttaaaataaatgagttattaagccatgtaaagacatggactatatgtgaaatatatgttaatattaacttacttaagaagttgagaatatattttaaatattaagttacttaaatattatggtactaagtgaaagaagctaacctagaaaggctacatattatattattccaactatatgacattctggaaaaggcagaattatggagacagtaaaaaatataaaaatcataataaattattgattgccagaaattagggggagggagggataagtaggcagagcatagatttttatcacagtaaaactaaactgtatgacactataatagtggacaaaagtcattatatgtttgtccagacccacagaatgtacagtacctagagagaaccataatgtaaatgatggactttggggctgggagtggtggctcaagcctgtaatcccagcactttgggaggctgaggggtcagatcacaaggtcaggagttcaagatcagcctagccaacatagtaaaaccccttgactactaaaaatataaaataatagtaacaaaaattagctgggcatggtggcgtgcacctgtagtcccagctactcggggggctgaggcaggagaatcgcttgaatccgggaggcggaggttgtagtgagccgagatcacaccactgcactccagcctgggcaacagagtgagactctgtgaaactctgtctcaaaaaataataaataaataaataaataaataaataaataaataaaaataaaaaagatggactttgggtgaagatgtgtccatgcagtttttttgtttctttttttttgagacagagtctagctctgtcccccagactggagtgcagtggtgtgatatcagccgctcattgcaacctctgcctcctgggttcaagcgattctccagcctcagcctcccaggtagctggaactacaggcactcaccaccgtgcccagccaatttttttatttttagtagagacagggttttgccatattggccaggctgctctcgaactcctaacctcaggtgatcctcccacctgggcctcccaaagtgctgggattataagtgtgagccaccgcgaccggccagagattcttagactgtaataaatacactactctgctggtgtgcaacaaatgttgatagtaggctaggttgtgggtgtggcagcgcaggagctatacaggaactctctgcacattttgcccaattttgctgtcaatgtaaaactgctttaaaaaatagtatatttaattttttaaaaattagaaaattttcttgtttgtaaaattaagaaatacttttccccagtgcaagaaaaaaaataatattttttaaatcagaaaatattttaaacaaaaaagtaataaaatgttatacatatgattgtttaggacatgcataatttataagtaattctctagccttaaatatatttttggaaagaaacaaagaataaagatgactaagcatccatgtcaaaaattttaaataaatctaaaaataatcacagtggaattggacaagaggctataattaatataagaatgtaattaatgaaaacaaacacaaacgtagtataggaaaacaaagaaaaagctggcttttcaatagatttatatgtgaacaaattatggtaggacatcaagaaaaagggaggacttaaataactaataaagaaaataaaatcaagataacatttatttaaaagttagtagtatattgacaaccacttcccatcaatattttagaaattttattttcaacttataaattcctagaaaaatataattcattggagaggaaaggatgaaagcagggggcatgggattcattcctctcctgaggacatgataaaggccagtgactcatctgaatctcttcctaaatatgcagccactggcctcttactcaatggtacttgctaggcggagaaggcaagcccgcatctatgtagagcttgtgcaggccatccctgatttaggattgattatgggttccccgaagaatgtcatagcaacgatgcaactttctgggctgtgaaatggaggtcttttgtgaggtaatctgtgcatcccactcagggacatcctctgacccagtgagtgaggccggaaggacgcacctggggggctgcccccctcccatcccagcctgtgctgctgggtgacaggtgtcagtagctttatcagggaggcctgacactggatgagatccctgaatcacggatttatggttgagcaactcagccctttgttttagcttatttttttttaattttttttattatactttaagttttagggtacatgtgcacattgtgcaggttagttacatatgtatacatgtgccatgctggtgcgctgcacccactaactcgtcatctagcattaggtatatctcccaatgctatccctcccccctccccccaccccaccacagtccccagagggtgatattccccttcctgtgtccatgtgatctcattgttcaattcccacctatgagtgagtgtttcctcaagaggcagaaaaccaaaataacaaaacaagtaaacaactaaaacaaaacaaaaccaaaaaagccttataggcattgaagtaataatttaattgttagaaaaacataaataaactacaagtccagactgcttcgaaaacaatttatactaaatagccaagaaaaaaatatcttggagatgaggacaaaaagaagtctcccatgaactttataaggttatcaaattttgaatttaaaacataacaagagatagtatgagaaagacaatacataaaatagaaaaccacatccaggaatagtaaaaaaaatcattcttggtgccttttttacatttatatcagtgaggcaaggttattctattcaaaaagtaataaagcaattagcactattaatagattgtgagaatcatactataacctcaatatatagatttttattaactaattaaaaattattcaaattcctgataacatctaataatctagcaatctagaaataaaagaggactttcttaatctgatgaaggagatatataatatatatgtgtgtatatatatatgtgtgtgtagcatatgtacatattatacatatgtgtgtgtatatatatatatatgttacagaaaccatcattctttatttatatatgttggaaattttctatttgaaaccaggaacacagtaagaacaccagtaaaaccacttcctttccatattgcattgaaagtcttttccaccacagtaagcacattaacgacaataactgacaaacattttaattgttagaaaggaatacaaagacacctgccatactttccaatatttgcacacagcgatgctcccaaaatttataaataagatattagtaagaacacttgaaaaaatgctgcatgaaatatgaaaattaaaaaataaactttgtttagataccagcaatatatacattaacacatctatagcaaatgatacatataaaatagacaccttttaatgtcacacaacaattaagaatgatcaaaaagtaagcctacctaaagcaataagaaaaagatacatttcaaaggcaaaaactattaaaagactttgcaattccccaaagaggaaacccaaatgttgcataaagaaaaggtgttcaaccttactgattctcatggaaatgcaaattaaagccataaaaacagatagaccaaacaaaattactaaatgtaacaagctctgatatacatgcagagcaacaggaactctcatattgcaggtggcagagtaacatttacaatgtggccgaccaacagtttggccttatttattaaattggaatatccacatatcctataaaccagggactgtaccctgaagaaacccttgcacatatacacctaaatacatgtgagattcatagcagcatatttcataaacaagggaatcatagacactgtagactactagagggaagagagaagtgggggcacaggtggaaaaactacctattgggtacaatgctcactatctgggtgatgggatccgtaacccaaacctcagcatcgcacaatatacccatgcagcaaacctgcacatgtaaccctaaatctaaaataaaagttgaaatatttttaaagtgtgaaaataacctagaagtctatgaaaaaactaaccaaaaaagcaaaaataacctagaagtttataaacaaactaacaaacaaaatcaatatcggtatgtattcacacactagaattccatcagcaatggaaatgagaggatgatggctacttgctcaatatgaatgaatgtcgcaatcacaatactgagtgaatacaacaagatacaaaaggaaaagaacacattatgattccattcaaatgaagtttcaaaactggcaagaaatattgtttttagatgtatagatattaagtagcaccatggttggaataagatggcttctggctgaatgagggaggttatgagattctggcgatattcactatcttcatttggacagtcattagtagttactagctttaaacacataaaagtatacatatatattttatgcattgtgtgtgcttaattttttataattaaaggaaaaaagttatacaattgaagcattaaaacaggacagtaagtcctctgctcacccttccccatttcatgaagcttcaaatcccttttgtggaagagacacagatcactaaaacaggtcagttttacttcaaccactggtgcttactcagttttctgttttagttcctattacagcttctaaaacatagtaagtgctcaaacacatttgttgagtgagtgaaggtctaacattttaaagaaaattaataacttttgctctgttgtttaatcctaatgcaattctatttacttttcttctaactttttatttgaaaaatgtcaatcttagaaaaaaattgaaagaacccacaaagtgaacacatataatatcttcactgagatttattaatattaaataatattgaacattattattgaataatatataactttcattattaatgtccagtgtcgtattattacacatggtttctatccatctcaaactagtcattatgtctttaaaaaaaaaatagtcagaacgtatttaatgacaatttatttgatccctgttgtttttttaaaatacattgagatataattcccataacataatacttaccctcttaaagtgtataatttagtggcttttagtctatttacaaggttgtgcaaccatcaccactatttaatttcagaatgtttccatcatctccaaaacaaactctgaaacattagctgtcactcctcattctcctttcctcccagaccttggcaaccactaatatattttccatccctatggactttcctattctggacatttaatataaatgaagtcataaaatctgtggtcttatgtgattgacttctttcacttggcatactgttgccaaggttcatccatattgcagcatacctgagtgcttcatgctttttcatagatgtataatattccattgtatgatttttttaccacgttgtatttatccatttattacttggtgaacattttgatgttcccacttttttattattatgactaaagctgctgttaacattcatgtgcaagtttttatgtgaacgtatgttttcaatttttttggatatatatctagcggtgcagttgctgggtcatatggactaacatcatgaggaaccacaaaactgttttccaaagtagctgtacattcccaccaacaattcatgaagtttccgatttttcctcatcctcgccaatgcttgttagtgtctgtcttttttattatagccatccgagtggatgtgaaggggtaactgactctagttttaatttgcatataattagcgactttttgatgcttatgattttggtgtcacatctaagaaactattgcctaacttaagagctcaagattcattcctaaattttcttctgagaatttaacagtttagcttttccatttttgtctttggtccgttttgagcaaacttttttatatgccatgttgtagaggccaactgtatttatttacttatttatttagttagttatttttgcttgtggatttccagttgttccagcaccatttgtttaagaagctgttcttttctcattggatgatcttagcacattattggaaatcaatttgctataaatgtaagtttttgttttttgaactctcaattttattccattgatgttgatgtccagtctcatccaaatattacacaattttattattgtacctttgtactaaattttgaaagagatgggtgtgagcccattcacttttattcaacctgtttgatgcttattaattcatgtgatgcatatttattggtaacctcctggacttggttgtggaggtttggcagggatatcgctacatatttatggtctctgcttaggttaggaataacgtgggaaagggaaaaggcataaatgtgaaaagataagtaaacctataatttatatccaagatgtttctttctttctgtctctcaacaaattcataacagaaattaaatactctgagaaggaaaagtgaataaatagtacaatctgtgagatgagtgtgtggacgtaagtctcttatctagttaggatgtctgggctgctattcaaaacataaacctaaatttgactgggttattctctagtctttataaggtataccttacttaaattgataccttccctgattacacatacctttccttgcagcaagcatctttcctggccatgatcacctctcctggtcatatatactatatagatctatctatctatctatctatctatctatctatctatctatctatctatctatctactcaacccacctatctacctatctatttatcatatcatttttgtaatattatcatgtagactttctttgagagaaaatataatagaatggtattttcaaattaggcaattcacaaagatttcagccaattttcaattcaatataaaataactgatgcaaggtgaaaatgctatgataaagactaatgcgaaagtggaagagacctcagagagaaggtgggactaaattactcactggaaattatacccctgaagagtatgtgtttaatgatagagtttgctctggaatgtgaaataattgcaaaataaaggtaataattgccattgtcatgattatgtcgacaagtcctatgacatttcatcaaaaatacagatgcaaatataagagcaacatgtttgtgtatgcatgtgaaaacagtaccatgtgtgaacaagtaaataagttggtttaaaatctaatctccataagaaaatatgggtttcttcatgaaacttccatcagcaaaatagctcaaatgggataggattagatgagcaacctggagaaaaaaaaatgctgaaacaaaggaattgtttctctttgaatttgtgagggaaaaatgttaaacatattttcaaaagaaactattatttatcttcatgagaaagcataataaatcaatgccaatgctgatttagcaccagtaagtttaagccatcccgtaccataaaggttgaagaaggcagaaaaggtgttgtctagatcattggttaataaaactgaccaaacagttgtaggaagcatttgaaagtatgaatttaagaacttattccagacttgctaaattttaatcttatctgtggaatgagacagcagccaagcagaagtgtgtgtgtgtgtgtgtgtgtgtgtgtgtgtgtgtgtttgtgtgtgttaaagcgcttctgaatgttccgatgacatcttcttagaagaaatgtttggagagcaacctactccgatgaggactttgatgcatgtcttaggggattcccatactatttcactcacaaagggcccccaaagccattaattccttttttttttttttttggtgtcaagcacaggccttcaatgactgcagagatgcttaggaagaattttacaaatgggaaatgctgggtcactggaaaaaaagtggcttcatgtgaggaaggagatgtaaaccaaaaaaaaaaaaaaaagaaaaagaaaaaaaaatcatgcagcccaggtgactctatccaaatgcacaccggctcccattttcccagccctggttaagacagacaggagaaatcaaacaaaggtttgtagaacccaactgatgtatgctcagccaggacatctctcctgtgctcttggcacaatcctttgtcaccagcctgcagctctggcccagtgttggaagccagatttccccaaaccttggcaactgcaaaacccaacactgcaattcacctgatagcctggcagatgtactcacttacagtctttcaaatttgtatcctaacttcattctcccttcatcttccctattggactatgaggtataactgtgccttttctattttttaaatgctcggctgcaatatctgcgatcttccctctgacatggatagcagtgaactctggcatttacattttaaagggacgaattgattatgtgaaagtgaatccaattaaaactaattaaagttgaaactaaaaatgtttatgaacactgaaaaaaatcctaattggaatggttcacagagagacttattcagcaattgttgagtttccaatatgcaaagaactaggggtcattgcaaactagtggatataatttaaagggcttagtgcaggcataaggacccttaacagagttaaccaaaatgttgtcagctgacttaacgccttttaaaaaataaattttataattgatttagatacaaagaacattttccttttttttaatgtggctcctctatctgctttgaaaattcagtgtgctgaaagtgtcgaggtcccttttgctacagtttccctgtttattaatatgagttcattttatagggaatctgaatataaacaactcgaaattttagagaattatggtggaagtatcactcacgtttggtaactaaaatacaaattgtcaaattggttcaaataaagtaataaatatatcaagtacttttgagaatgaaaaatataaaaaatgatttcctccagaaaattcactttggcactatttatgcttttttacaatatgctctgttttctgcaatttgaaaaatgtgtcactattatgtaaaattcttcctgccacttactcattccacttcctgacttttctttttgtacccaaatgttcatagcacccttatctagtcaaaattagaaataacccaacagtccatcaacaagtgaagagcaaacatggtacatccacacaagggaactttttcaagcaaaaaacagcaattatgtattgaaatacttattgatacatgcatcaacctagatgaacttcaaaacagttatcctggctgggtatggtggctcatgtctgtaatcccagcactttgggaggccgaggtgggcagatcatctgaggtcaggagttccagaccagcctggtcaacatggtaaaaccccgtctgtagtaaaaatacaaaaattcgccggacgtggtggcactcgcctgtaattccagctactcaggaggctgaggcaggagaaccgcttgaacccgggaggcggaggttgcagtgagccaagatagcgccactgcactccagcctgggggacagagctagactccgtctcaaaacaaacaaacaaacaaataaacaaacccagttaggctgataaaagaagtcagaccaaacaaagggaaaaaagagtacacattatatgattccaattacataaaattctagaaaatacaagctaaactatagtggagtggatcaggagctgcctgggacaggaagaagcaggaacgtcaggagaaagggatgacatagaggcctgcggggacttttaggggtggggttcagcgtgctgataatggcaatggtttcgaactatacactttaaatatgtgcagtttgttatatgtgaattatctccataaagctgttacaaaattaattctggctttttatttgtactgtttcaaggtgaactagaacatttaaaattctctatgtagctcacattacatttctattggagagtactgatggagatctaactatggtttttcaggaaatatgaaggacaatgaaacatgctaaccacaccactgggatctagtcagctacactcaaaatgtggaaaccatagtgaacaaatgattaggcttttttcaacaactaatgacaagggaaaccagaggtaaaaagggtcatgtgaaaaataccaaccaaatgcaatgtgtagcttttcagactgtgattttacatttccttttagagttattcagctgtcttggaggcagacagttttcttttctttctcctttcctctcttctttcctgccttcctccctcctccttctgagttcctttttgaaacattattcctgtcagatccacaagctaatatttttggcatagtcattgacttgtccctcccttcttttctttatcctatcagtgatcagtcttaaattcggccttgtccttatctttgaacctgcctctcccttccctggctacaaaagtagcctcattattggttccctgactcctttcaaatccatgccatgccactctgtcttattttctgaaacccaaattctaatcattccatgaccttgactattaacctccattggctacccacaactgaccatgtaattccttggtgtaatttgtaaagctattctcaagctgagcccaattgtctctcgaatctcatatatgatcattgcccatgatgtgttcccaaataacaggatcagctcagtgtgtgccaagcattttgcatgccttagctaatttaatccacataataatcctagaaggtagataataattataatccccactattttgtagacaaaggagcatgtgcatgtttattaaattggatactcaggatgaaaatcatcactacatagacaggattcaaattaattgcagggctatactattcttccagtgccaaaaggtgcatttgtggaatttctctttgtccctccctatcttaccatgccttcttttcttttgttttcttttcttttcttttcttttcttttcttttcttttcttttcttttctttctttctttctttctttctttctttctttctttccttcctctctctctctcttccttccttccttccttccctccttctttctttttcttcctttctcccattgtttcttggacttcataacaagagtttatttttttcctatgaaaatataaatttaaactagataacatattttgactgtgtaataaatttgtacaaattgtattaaatttcaaatcttgttctagatgttgctcttttccttcagcattatgtttgttggaaatctcaccatgttgtttctgaagctttagttcagtatgtgtaagtgtttcatagtattccacagtggtgccctatcacgttttaccagtctgtctcctagagatggattcttaggttattttcaattatcagatactatgcatagtagtgaaataagactttaggatatttcactgattaacttatgagtgtgccgattcaaaatgttttcacattttaaattttatttagtactgcagactgtttttagaatggccatttcaatttatacttactctttccactagcgtgttaaaatttctgttctctaacattctgtataaactttggcattagccaccctttaactttaccgttctaatgggtataaattcatatgttggcaactaaatttgtatctgtattactactagtgaatgtgagaatctctttaattttctttcaaccattaggccctcatctatagcttgtctatttatagtcagttgccaataaatagtttaattgaataagacccttgtcattgaccacttagtatacacaccacaaatgctcacttaataaaaagcaatgtactacactttgtttgttgttgttgttggttttttctgaaacagactcccactatgtaaaccatgctggtcttgaactcctgggctcaaacaatcttttccactttagcctcccgagtaactacaattacaggtttaggccaccgtgcctggcctgcttattttgtatgtcaaattcctgctatgtcttttgagttggctcagttaaccatgggtaacaaggcataaaatgaccttttcaaactattagtcattaagccttttaaaataaccaaaatgaacaacttgttctctgtggtatattctatgtttagcaaaggcccaccctcaatttctctattctgctagaaagcattgggtttcagaagttctaaccatgggcttcttggaaagtcagcagctcctgagaggtctagggtctagcaggccgagagcatctcttttctgccttttacttaaaaacgaaaaatgaggaacaataaaatatgtggagtaaaatataagcaaaactgaaaaagtcttatgatacacagtaataagataatacatgagaggatatttgaattcgacatagcatgagatgatttcttggcttctgggagttgactccatcaggctttggtctgtataatctggagtctgtgaaatttgaggtgcttgggttgaacaaaaccaatacagagaaattgcacactgagtccttgaggtggcaggatggcacaaaccaaatgccctgaaagacctgggaaactgcaccaaaaggtagtcagctaggtaacatgcaccaaatacattgagcagggatgtgcaaaatgcctcgaaagacagaggatcccagcacccaggcggtattgtaatcacatatctgaggaatggctgtgcccactcttggggtgggtggtggttggttagcttagcgaaaaagtagattttcctgggaaatactgtctcagtgaaaaggggaatggctaattcagtcacagtggcaggtgtatctttatttctacctgctttatctcttaacttgattatatacaatatgaaattcatgtaaaaaaatcctttattttgactctgttttttatgaagcaaactttcataacatttggcttcctctcaggtttgctcaaggagagacaatgtgttcaacagatgacatttctgtacagtctctttcaccaaatgacgttttgtaaatacttattgaggacctaacatgtgcccaatattgtactaacaacagagaactcaaaacagttatgaccctgtcctcacagaacttgtagtcagatggtagagagagataccaaatattaaacacagaaatattgaatattttaagtatgtaatcatacatgtgaaaatagaacacatgttgcaaaaacatcatgagacaggatactgcttatgtgaatactttagtctcaggggtcaggaatgactgctctgaggaaatgatctcttagctgatattctaagtttaaaaaactttaactgataaaatcaacatatgtttgatggagcaacgtttaaggcactgttggaacagcccttgccatttagagatgggaacgtggactggactgaattcatcaataaaatgcccctttgtgggatgcatctgagtggggcaccccctcttctcaggacaaactcttcagtcctgtagcactctgcattcaagctctgacaacgcaagagtgggtggtttcacaaaggggggtttccctttgaccctttccctgctttctgtccaaaaaatatgaatataacaactccagcctccgtgcagttccttttgaggagacttaacattgctgaagaggttgaacagctcccttctagaagagccaccctcttcccagaagaagttgtctttatggaactcctacacctttaaggctcaccagaatggtcacctcacttataactgatattcagaatctgatatcactttcttctgacttttcctctgaaattcattaaacaaatgtttatatattatatattatattaatatatatttacattaatttatatacattatatatttatatttatatattatatatttacattaacttttatatatatatatatatgcatatttgaaatggctctgaagctggtcatggaggcctttgcacctgcttcaggttcatgggcagcctggcctgcggcctgagtgagcccctctgggctctggctgcctgcctgccttgaagtctggctgatgttccagctggaagcctgtgtcacattccactagcagatgtcctgaactctgggataagtctctaattgaagggtaggaagctttctggatagaggttggatttgtcattctaatatatgttaatctgtctagaaggatataaatgaccttttctctctcgcttttaccattttgtgtttatttacttgtttttagattaatagattttattagtatgcaagacctactgtgaacattgcactggagtaaaaatttcgagaagtgttcagacatatgttggtcatatgtttgacatgaaaaggtatacaatctagtggcatatatgagaatgtacacaaataattagagataaatatagctcaaaaagacaaaagggaggaagggtacgctaaatatagactaggacagacctgccttttcaatctgaacattagtagagaggagtaaaggtaatattgtaaaccttgcccacaaaatctgataagaagttttctgaattgatgccctatttgtcttgactgagacctacccaggactgaagacaaggaaaaatttactaacaagtaacacaactttcatttgcatatcactttccagcttacaaagctctttatagacaacatatttctttttcaaaataaattttattttttgagtagtttttaatatacagaaaatttgcaaatgtggcacacagagttctcaaacaccccatatgaagtttcttttattattaacatcttacactagtatggtatattttctaaaattaataaaccaatatcaatgccattttttttactacagttcctacttaatttaagttttcttagtttttatctgctgttcttttttctgcttcaagatcccacccaggacaccacaggacattttgtcctcatgtctcctcagcctcctcttagttatgatcatttcccagacttcttttattttcggtgaccttgagagttttgaggcataattgtcagatattctatgggatgtccctatattggggtttctttgatgtttcaagtatgactagattgagtttatgtgatttgaggtggaagaccacagaggtaaattgccatttcattgcatcctgtcaacacaacgtatcaccgttgatgtggacttcagtcacttggctggggtaatgtttgtccggtttctcctctgtaaagttactttcccttgcactccacccacctccatactgtgctctttggaaaatagtcactatgaggatttaggcttcatctcttgagggtttattatctacaaaaaatatttgcaatttctcttcataagagatttgcctcctctccaccatttgatgttcaaatctaatcattcattgtatcagtatgaactcatggatgtttattttgtaatttcagtcataatgcaatactcctttattttgttgctcaatatgtttctttaaaaagtatttaaatccaccctgttcaaaaagaagttgggagtgaaagaacgtttcagaaaggtgaggtgatttgccaaaggacacacacccagggattacatccaaattatggtactcaaaggctgtattccttgcttacaaaaagggatccttcgatctagtggagaaactggccaattaaagaaagaattgcaaagtgggtgcttgcagtataaagatgaaatgtatgttctagtaactattggtaaatactaagcactaagtacaagtgctaatattttaggataatgttaatggcttcacatctctgaaactgctattgttcttcctgaaacagaacaaagaggaacagaatacttgttcaggctaggagaatggatttaggatacaaggtatgagtgtggaaggatctttttgtctgaaggcttgagaaaacatcctgtatttccaaatgacttctcttttgtccaatttgcagaattttaatccttgcccttctggccctataatccatgcatttaaaatttcactgtgagccccacattaatataaaacttatttggatgaaaatatttctgtacttctagtactttcagattacattgcatttcctcttcttttaaaatgagtctttcttggaaaagcaaacttttatatcacaatgtattgtatttgcattttatttccattttaattttggttcaataaatatattttagtacccacttaagtttaaatgattagtttttgttatcccattaatttgagtaatgcatttatttttttaaaagcttttaaatattaaagcaggaaaatttaatctcattatagttcaaaagcaaataaagtggttacaatatgaatgtagaattaaggaattttatctcactatattatcactgaagtatttgttgtataataattttaaaaaatatgtttaaatgtccccttccaaattatttcagcagttactatatccttatgttgtgtacctcttgattctggtgtgataggatccaagtaccaagtctttgaaaggtcccaattctaacacccatttcacaactctcactgagaaaagggcagctcctaggagagttaaacagtatatcaggtttgactttgactttatagagctctgtaggctgtagggtgtgagtctagaattctatttcagggattaatggaatttgctacatccttcattctacagatcagtagatgctgtgctaagaagaaatatttggaaaaaaagatatttgcataatttcataacatacattctttctttctttctttcttttttaagatggaaatcatcattctcagtaaactatcgcaaggacaaaaaaaccaaacactgcatgttctcactcataggtgggaattgaacaatgagaacacatggacacaggaaggggaacatcaccctctggggactgttgtggggtggggggaggggggagggatagcattaggagatatacctaatgctaaatgacgagttaatgggtgcagcacactagcatggcacatgtatacatgtgtaactaacctgcacattgtgcacatgtaccctaaaacaaagtataataataaaaaaaatccatgtaacgtctacttcacctttagttaataaatgaattcatcacctgcaagaaaaaaaaaaaaaaaagatggagtttccctctgttgcccaggctggagtgcagtggcgcaatctcggctcactgaaaccttcatctcccgggctcaagcgattctcttgcctcagcctcctgagtagctgggactacatgcgcccaccacaatgcctggctaatttttttgtatttttagtagagaccaggtttcaccagttgggcaggctatatattcttacttctttaatctgagtactaactactgattttttaatgtatttggtattgttttccattaaaatattaagcgccatgtaattttctcctgtggtgtgatgagtattctgaataggtatctaataatcatagatttagtaccctacttaagatacctggtcatttatttcatctttagtctttggatttacattgttcaaaacagtgttggaagtctggtaggttaacttcaatacttgaatacacaaactcacagactgttagaatctatggctacaggattgccctccttgcaatgtggaacttttgggagcagcatcccagcaggccttgtatcctctgctaaagcttacaggatacaaatgctttatttttaaaggtagtgtggtccatcgtagggcagctccaaataattagaaagctgaggtctgcattcatttaacctttcgtcatgggtcttatgttaagcagcagttgccccagtaatgctgccttataaacaaaatgacttacaataagcttgaaacaagcctttgttttcacattcaccagccagcagatgacccgtgttcagctgatctatgcaggactcagtcttcctgcagattcgctgggttcatgcactttgcctgccagggcccaggctaaaggggcagcagttgtgagtgtccttttccctgtgtggatgactagagcatgacaggcaagcctcagcacacaggcactgaaggcctctgcctgtgtcagttaactcaaggtctacctgtcaaagcacatggccaatcacatggccaagcaggaaaggagcaggcccggaccctttgtgcacagtgggaccaagaacaaggggatatttgctggacaataattcacaatatccttctccttaaacgtcatcgctgtatgaaagcaggtcattataagcatcttctgtttgcaaataaagtaactgacaatcagaaagattaaataccttgctctctaggttttactaactaggaaaaccaggaagcaaacttggatctaagtgactcaaaagcccctattttttgccaatgacctctctagtccagcatctctatctatcatctatgtatctatatcatctatctattatgtatttataaatgtaggaagtactttcctaaaggtttatcttttccagctgtaccgtttttgagttactgtcagcattctttttctgttgttgttcatgtaaatctgactcctggctacttttgtcaaaattatttcatactcttaagcatataaaagtccgttactataactggataaaatattgtaaataactttgtagacataatagttcaatatacattctctctaatttaggctacaatgagaccgtgaataaaatcttgaaaactctgggagatacgtgtatggtggtgggatatatacacataccaaggatttcaatcctccctaaattttacctgggcttttgaacattttaaatatttgaaaggcactggttttaacatggcttgcagtagcttttatattatagaatcaaaaaggaagtgatttcagaatattcttttctttactccagaaataaaaagctgatttttttttctgttctttggaaaagcagggaagtgtattaatattgaattaagtctcacaatatttttttgtagtcaaagtgggccgtctgatgtaatctgaatctggttaattttatgaaaatcaaccattacacgatattcttgttccttttacctagacaaaatctaaatcatgaaaagatgaatgttgtatctccatgaaataattaataggacatgtaacttctagttggattcaaattccacttcaattacattgcatgttctttcttcttaaaattaatgtccccaaatattcatattttcaatgattatattagcatattcaacatatacgtttaacacattcacaacaaatttagcaattcgtaatagctacgagaggtataaacaagagtaaaaagagcaattttggccaagtgtggtggctcatgcctgtaatcccagcactttgggaggctgaggtgggcagatcacttgaggccaagagtttgagaccagcctggcccacatggtgaaaccctgtctctactaaaaatacaaaaaattagacaggcatggcggcacatgcttgtaatcccagctacttgggaggctaaggcaggagaattctcaaacctgggaggcagaggttgcagtgagtcaagatcccaccattgcactccagtctggatgataagagcaaaactccgtctcaaaaaaaaagagtaatttctgtcctcaatccgtttacaactttttcccagtgataagataaacatgaccaatgtttaaccattttatgtttcaaggccataaagagctgtcctggtgaatacattctttttgttgtcaccactatctttatgagggtccaaagcaaccagagggcttttaccccatttccactgatacacacgtacacagtataaatggcatcttccaggaaggatacttcttcttaaacttaaatgtattctaatatcacaaagatgttgtctatgtagatgaacatatttgtgtttcccaacaaggagtgacaattggtaacaagttgtacattgctagaagactttttaatctccttgagagttgcctgaggagtgactttgtgtaattgtaatgaccagtttctaacttttctggagatcaaatcacaggagcttaacattttataggaaaatgctcaaagatacttaaacatcatccaaaaaatatgttttgactctattaaggctctgtgttgatattaaaagttgatatcaggcctggcgcggtggctcatgcctataatctcatcactttgggaggccgaggttggcagatcacatgaggtaaggagttcgagaacagcctggccaacatggtgaaaccccctctctactaaaaatacaaaaattagctggttatggtgtcaggagcctataatcccagttactcaggaaactgaggcaggagacttgcttgagcctgggaagcagaggttgcagtgagctgagatcttgccactgcactcaagcctgggtgacagagcatgactctgtctcaaacaaacaaatgaaaaaaataagaaaaaacacagaacctcttaattattctctcccttttaatctcataaaacctctgtaaattaaactccacagagactgatattttaattattttaaaaatctaacattaactcaattcatgttctaagctgggcctccaaaaactgttttatgtatatcatcttattattcattaattatcatgggttattttactgtggtgaggaagttgaaccttaaaattgtttcgattttctctaccagacatgaagattgtagatctattgttgtgaggaacacaatgtcttccccaaatctgctgatttttctctcatgacccttgtttggtgcattttttactatgtaatttaagatatttcttcaatttgaatgttgtagtcactgaacaattactatcctcttcttaaatcatctactgaatagtttagtttgaaaattatgttcctggacttttgaatgttgtactcgaatcttcttaagtactcttgttattttctttggtgcaaaatatcctctgtctcctctagaggctgtattttggtacagtgttcttggctcattcatgattgatgcctaaagctcagtttcggcaaaattagtgagaaggatgcagtgtctctgctcctcgggctggaaggctgtcagtcttttgctgaggcactggaaagaagcggttctcccctgagctgccttacctacaaattcctaagagcccccgggctcacggcatggagaggcccagtccaccttttggtctttcctgctacttcttccctgatctttgccacccttctctttaagtgctgcagagcttctgagatcacgccttccacaggagaggtgcaccgatcctcacccactggatttcaattctggacccaaagctccctcaggttaagtaggaaagttctttccttgttctcacactacacacctttagtgtttgaagtcatattcgttctgtccaggcctgatggttctaaaagttgctcttcttaggaaaggcactggtcattggtttgtggttggtgaagagaccagtggggatgttgtctaacaaatacttaccaatgaatcatttgaaatggcaccacacatttacatgaacacaagaatcgatgtcatcatgtgaaaaatggtgctagcaaactattctattttattttaaaaaaataatttacagcttaattgaaaatcaagatgaatactgaatccttaggtgttggactacatgtatctcagtccttatgttttatctataattcactgatcttcttgagaccactctcttttttttcttatagacatgaagctcacttcctggtattatagttgctattttgaattgcataaatccatgtgaaattatttggagtgaactttattaattcctggccttcatgtagctcattgtaagaaacagcattacttcatagatggactcagtaatgtctacgatttttatatttttccgttaaatatggaatatttagatctttcttgtgataaaagagacatctaaattccatgtgctcataggtaggttgtttgcctaagattgccatacttccagaagcacaagggaatacctgttaacccacgtttggcttcattgagctatccttctctagttatgtttttgtggtcaattgttagtggttgaaattcttaagtatatttcagttactattaaagtattccttggccaggcgcagtggcccaggcctacgatcccagcactttgggaggattgcttgagcctgggagttcgagaccagcctgggcaacatggtgaaacctcatctctaataaagatacaaaaattagccaggtgtagtggtgcacacctataatcccagctacttgggatgctgaagcaggagaattgtttgaacctgtgaggcagaggtttcagtgagctgagatcatgccaccacactccagtctgagatacagagtgagatgctgcctcaaaaatcaatcaataaaaaaaaataattatttaaaaacgcattccttaaaggaaagttcaaaggacaacttatgtcattatatctttacagactcttctctgagtaaattttaaatgttgcttgcttaatttctattaaaatgaatgttaaacatgttatcatctcaaagtcccatggcacatgataaatgcaatgaaattgtattaatataatttatttcccagttaattacaattggaatgattttgaaaaactgctcaacattttatatgctattcctctagtagttcttatttgtactaatatttatgctatttttaaaatttttaaatggaattggaaatccaggggagatttttttgccaattaagtaaaatacaccttattaatatgccagtattttgtcatactaatgtaactaattttcataccattatactatactaattactgtgctaattcatctttttattaggctatggcaaatacttaaagttgaaggcagagatatttcatctgtgaaaagggaaataatcagtggactaagaaataaaagtaatatgttgtgtattttgcttaagaaaaagggtatgtttgatcatgtataaaacgtctaggcagctggctttgatttggcatgcaaaaaggctgtggactcctaccttcacatctgctaaatgtggctataccaaatgctccccagctctcctctacttctcacagctctgagacatgtgaagttctcctgaaattccagaaaatattgtcactattgtgatgctgtgcaattctttacttgcaaagagctcactttattttttaaaaataatttttaaatgttataaatctgctgtccgaacaatacctaaaacgtcttttgttcattggttattcataaaacccttacaatcttagggttggcagagaattttgaattaatctattctaacacttgcatttggggggatagtaaaattgagactaagaaagattatatctttactctgactttatgcagatagtggtcaaagtaaagctagaaattaggtttgctgacatctaattcatcatactcttatgctacggaaaatacttaaaggtgaagacagcaatattttatctgtgaaaagggaaataatcagtggactgaaaaataaaagtaaaaataatcagtgttattaagacaatgcctagtggcatttggttacaatatctaaataaatcctcacaaatcttgagagacaaatgaaattagtccattttactgctgaaaccactgagacacagagaatgtagacactgagacgctggccccatcagataaccaggaaatggcagtgctgttaatgggaaacctgattccttagaagtatcgcaagaacaaaaaaccaaacaccgcatattctcactcataggtgggaattgaacaatgagatcacatggacacatgaaggggaatatcacactctggggactgtggtggggtggggggagcggggagggatagcattgggagatatacctaaggctagatgacgagttagtgggtgcagcgcaccagcatggcacatgtatacatatgtaactaacctgcacaatgtgcacatgtaccctaaaacttaaagtataataataaaaaaaaagcttaacaaccttaaaagaattaaaaattatatgatgtatagtctctgaccatcaaggacttaaactagaaatcgacaacagaaggaaatctggaaaattcacaaaaaaaaaaaaaaaaaaaaaaaaaaaaaaagaagtatccattgaactccttgaggcaatttctgagtgaagggagtagtaagggtaggtactgggaaatatatcacccagaactactcttttgtttgttgttatgagcatagttggaactggattgatctcaagaagattttggagcctggggaaagctttctgcaagaaatgttattttagatctaaatgtttttatcatcaacagactgttcttatagtgcttttattgtttactgcttttactgtttgtcttcattcacataacttccatgtgctatatactgtatcatgccatgaaaaataaaacaataaagcaagcccctgtcctcagagagcatctgaggaaagacagtagacagattatgagaagtgttgtaaagacttttttgtgctgttgtgttaaacaacgcaaaatcctgatgagaatatggggagagaagacctccctctaagggtgagaaccgaagagaggcataaaccatggtgagaggcataaaaccatggtgagaggcattccacagaagagaaacaactcacaaacgagcatggaaatgggaaagatcttggcctgtctgacaaattagaggctgctgtggctggagctcaggaatgaagaagatgctagcatagaataggttagagaaataggcagtaggctgagggtttaaggaggtacgtggtaatccacccattattgctactgttattgttgttcttatcaacagccaccaaaaagtatctgacttgggatgaggcagtgataggattgtgcagaggctgatgccacaccagtggactaggccacacatgacagtaatgtagatgtacagatagatgctggcagatttggaatgtgttaccagagttaaatatataggactttttaatagctttgacttaataggtaatcataagaagaaaccaaggtggaccttctagatgtttgacttggctaactagttgagtaggatacaaattactgaaatggaaataacttgagatagaacaagtattgactggtggcataggcagaaatcaattgttcagtatcatgtacgttcatgtagataaatttgttgccttccatgcagagatgcaaatcaataggtagatacatgagtatagggctctgaggagtctgaaattgacatataaatttagaaattattagcttataggtgagatttatatttataagaattaatgagatcatcaagagtgacaagaagattaaagtccaggaatgactttgaagaactccaacatttagaagaacaaagtaaggagaaaccagcagaatagactgtgacagacagggctctaacaggaaacaatgaagtcaaagcccctcctcctcttgtccatagatagagtagaccaactcacagaacttcagtcttctctccagggatccagccagtctgagaggacccttggggggaaacagaggataaatttcctgtcctcattgtcctctgtccttccttggttctctgttgatgctgcccattggccatatttccctgggaactagagattacaagtgcccttaccatacaggtcagggtcccaggtgctaaagagggtagacaagctggggagtcatctgaagatgcccacagaaggtgcctggcacagagagtaaaatattttaatttaagattatgaagattatatgctcttttcttaattttgatgatatgtaaatgcaaaggaaatgtagaagatatctatttgttatctcatcagggtatgttcagaattaagttacctgagacactggaaatttgctggaaaagttcataaccctattcaggcattggtattgttattgctgatgtcgggtcgcccattgagtaaaggaagacacatcctgtcagaaaaataaaaccagttttgtgcagattccgtttgcttattggaaaatcctgtctgtgaaaaaggtactatttcagctctgcagaggcaacttgaaattattttatgtagtaattgcataactacaacttgctgctttttccttcatgcacttctattatattcatagcaaaaatgttctagattgaaaaccaaaagatggaaattcctttatttctttagtgaaaaaagttaaggattgagatcatttaataatattttctgttacaatcaaattgtagaagacaagattagcaccgttatgagaatgatttgtataaaaagatttgtagtcacttagcatctattttaattccatctttatctttctgataattgtaaactaactgggtaatttttaaaggaaatactaccagagagagaatcacatatggttagaaagtaaaacttaaatgaatgttattgtcttaaagtgtagtaattaaattagtaggccacattcagagagatgtcaagtagctaaatggttcaagcacttgattagtaactatgtatcaaacataaaagtcaccaacagctctcctttataaaaattatgttaggctgtaagatctaataagtactgcaagtgaaagtgaatttgtaaatgctgctatttagaggagaaaggtgatttgtttataagtcttattctgtggcaatttttcaccaagaaatacgtactcaaaagcaatacttgaaagaaccagaaactgtattttctctgcagtttctttcagtctttaattttttattctaatacaatttgtatttctaaattgtcatgctaaattgaaattttacatgacagaagcccttagttaaatcttcccctctcataaaatactgagccagagactgatgacaaagcttattttcattattataagtccagagtttttcttttccaatgttaatgtttcctatttcttttttaaagcatatcgacttacttattgttctgcaatattactgtaagtaatatgtcttattgtattactccaaagaagaaactttgtattctagaaatattgtagaaaactacaacaatttttaattatttgagatcaatatatgctaaatgtttattttccagtattccagtaagcagaatgtttaactggcatctatttaattggtctgttatcaatgactcaaaaaatgtgatcaaatctgaagtgtttccatgaacatccaaagaaagattatgcttggcacaattttaatattaggtatctttagtgttatgtttataaaaggttcataatttatacatgttataagtgagaacactcttagtcagaatatttggcacacttcatttcctttcaagaccaaagaccaaagactttgtgtaatctatttcaatatacattcagttatctcctaaatctgttgtgtgtactgactggacaattcactctttgttttttgctagctaaaataattttaaacctaaaatgatctcattagattgcattcatgcggtaaagtgatgttgtcttccaatagagttccagtccctgctggctcgatggcaggctgtcttcataaggagctcagcacgcacattgccctggcacctcaggtgaggcagagccttgcactatggcagggtccagtgaatgcttcaagcctctttagcccattcacatgcacaggcaagaggtaaagctcttacagttacaaatccactgggagtaccttttcatcacttacttgtctttaatgggaaatgaattaacatgattggctcttaccaggaacttagtagtattcttttgattttaattgacttgctgcttacaaatgttgttaactcaccagaaagggaggagttcccaatattcgcattggcagtactctcctcagtaaaagacaaaggctaaatctttgtccaacattactagagatgctgccaaaccactgtggtggcccacgctgcaaaactgcattgtcacacatgaaaagggctctgtattccctcgctgtgtcatcatggagattaatatcatttataagcttttctcaggcttgtcgatttatgggcagtaagctctgagaagcccttgacattgacttctgagcccttggcaaaataattctaggacccaagtatgtcatctcattttctatgccatgtttcttctgctttcttttcattgccatatattgttttctctgccagaatacgtttctctccagctagacagatttgctgatcaaagaagtctcctgaagtgttacatacatcaattgctatttatttaacaggtttcaccgatactaagatcatagggatttaaaattctgatctgggttactttcattttgcagaaagatgtttaacttatttttgcaaatatagtaattttaggttctgcaaagacataatttaagcatttgagcaaaacacattgtacaacttgtttgagaaccttacaaagccaatatagtacaactgaggcaaaacctaaaacaaacaacccaaacagtgtcctttgactgaagtatccaaattgacaaaatctaatcttttcagataactggcaatcttcaactttattttgctattttatacagtggttctagcatatctcctcagtgtgtgttaaaactaatgtgggtggtaagtaagtttggttcagctgtgaaattggatgggtcatgtacagccaggcagttcatagcgtagggtagctctgaccagacacaggtttgtctccagatccacatttaaaaattgtacttttgttgattagtgtttcccaatttcatttattttactgagggttgcaaaatagcagttttctacctggattatattctctgcatgtatttgttttcatttctctttttttttaattttattttgctaaacagctatatgaaaggatcagacagacatatcctggacccactgatcatccttcatataaataaaagtaggaaaacaaagaaaaaaaatgggactttaagaaccatggtaaataatatattaacttagataagcatgggtaattcagtctctctcttttttaaagattttctttcccctcctccagctttatttcagccagatatagaaagacaaatactgcatgttattgtttatatgtggaatgtaagaactcatagaaacagagagcagaaaggtgttttgccaggggataggagggtgagggaaatggagggactttggttaaagggtatgaaattttagttacaagatgagtaagttaattcagtcttttaagacagcatgctaaaaagctctaacaaaagtagcatagtcagtaacctaacccagttctagaagcacatcattaagatggtgcttctgcacccctaactggtgttcatgtggggatcctgaagaactgtatgggtcttgtctcattctcacagtttccagcagacagccatgttttgtaaaaaagattgggaagagcaacatcagcaaaatgccattcccctgagctaattttagctatgacagtcctacatagagtatatttcttctcattccaatgaaatgaattcattttctaaatgtattattaactacagttgttgtttatctttatgttcctttacttcattattgctgtactttgtgtgaagtagtttaagcacttgaagttggtctagcctcatgtaggggggtaagtgtgtcatgattagtgtgtctccacacaccagatgagtgacaagcaggcagaatgtttgggaaggatagtccagcaggaaagaaacatgttccagaatgcagagaaccctcgattacttgattttacagttatgcagataaatgtaaaaactggaatgtcattcagtctgagccaggttacttactcagatgcttaccttcccctttgccctttggttgggttttggagagttgaccgaaaggggtgatggctttaaaactacacagatgaagcagactgcacaacatggggagaccctatctccacacaaattttttttttaaaagccaggcatggtggtgtgtgcctgtagtcccagctactcaggaggctgagactagaggatggtttgaaccgggagttgaagtccagcctgggcaacagagtgagattgcatcttaaaaaataaacaaataaataaacattattcaaatgacataggacttgtggatcatgagattagagtctagctcttaaaaaaaaaattctgctgtccaagtttaatgcttgaacttccacagttaaagatttaactcttcagtgttggtaagaggttggggattcaaataaatgtggagaccacgaaatgaaggtaggtgagagagaagccatttactagggctccaaggaagatgcagaggcccacaaaaggacaaaggcccagcctatggggatcacagatcagcactttaggttcactgtagggctgaacacaaggcacacatccagcagggaggcacatacctgcggacagaatggtggaaaaatgatgtccattttgacaaaatagggagtgaaaggacatccattatggagagatgaacagctaacagggggcagtgtcctacaattccaggagtgagtggcttgtcaacattttctttgttttctttctttttttttttttggagacagtctcgctctgtagcccaggccggaacccagtggtgtgatctcggctcactgcaacctccacctccagggttcaagcagttctctgcctcagcctcccaagtagctgggactacaggcgcctgccaccacgcctggctaattttggtaattttagtagagacaaggtttcaccatgttggccaggctggtcttgaactgctgacctcgtgatccacccgccttggcctcccaaagtgctgggattacaggcgtgagccactacgcccagccaacattttccttctaatccaagaatttactactatgaaatgtagttaggatcactcttaggcaaaaacagtatagcacataattacagataaatcattactggtcatagagtagaaagataattcttattatcagagaaatttctccatttgggtccccaaagcaaagattatggccttcataacagtgtaaatgtagcttcaaacaaagcctaaagtatcttgtgtttgaaagtgtgcttttaagcataaaattacatgctttttgatctgttagttaatgtgcaaaatatgattctccttgcaatatacacgttaaattcatctaattagctcttttgaatttttttgtttgcttcattatttctcaactactcaaaataagtagctgatatgaaattctcgatattttcattagtaattgttaaatcatattgcaagcattttctgatttatggaaattaggctcagaggaaaatgtacgggtgccaagggctttctcctccctccttgctgtccctgggaaagagcatgctggtgaaaagcaagaaggcaggacaaaagggggagacaagtcttttctgttattcttgattaaatgtcattgataaataggactccactgacttggagccctcagtttatgggattccaaatgctctggcatcacactcattggcccttgacttgttttccacagaggtgttgttagcacgctagcagtcactccccactgccccatctcagctctacacagacactaatctgctttctgtctgtatagatttgcctattttggacatttcatataaatggaatcatacaatatatgtgttttttgcaactgacatttttacttgggacaatgttttcaaggtccatccatgttgtgtagcacgtgtcaatacttcatttaattttatggctaaataacattccattatatggaaatgccacattttgttcatccgtttagcagttgatgaatatttcacctgtttctacttttgggctattatgaataatgcttttgtgaacagctgtatccaagtttttgtgtagagaagtatgctataatttacagttagtttttagaatacaaatggtaacctttccctatctgcatggcacacttgcttatccatgaatgttactgaagtccatttgaatcctttaaggtaaaatggatgaggatttctagtttaacccttatgcttttgagatttaaaaaactggatcccatgaaattaataaattacccaaggtgttacagctaattagcgtcaacagtataactcaaaatttgcttgagattcagttcagcattcttttaccgtgcattgtaaacccacacagggtgcaactgaactaagctgagatcatatgagctgacctgagaagcttccttttgtaactgtttttctttggagaatagatttggtttccaaacagacctatatctaattaccatatttgatgcttcataagaatgtgtgtgtatgcagtgatttgttttcttgactctcaatttgtatcgatttaatgtaacaacaaatatctattgagcataaataatgctgttaacattgaatattttggaatgcaaaggcaattacaactgtattaataaatcaagagtcaagataatacaacagttaataataaagtaggtaatgaagggttaaattgtatgtttttgggccacttacagcataatatacagaattgattgctaaaagatggattttgatcccacctttagtaataattagaaatctgattttgaaaaaagaaatctatttctttgagtgaaagttacattacctttgaaaggacgatatgttgatatctagggtgccttatagccataagatgctacagttcaaatggcaccatgtgttagagtaatacacacatatatgcagagacatataatgggcagatgctcacatatatcacatgtaagtgagtcagaaaacaaggtcatcatgaggaaagagctctaaaaagatctgggtcttgttccaactctgtggtgccactcaaagcccatgtgactctctgagtctgtatttacctcagatagagacaatagatgcatcctgccctcctcctcctctctttgggatgcaatgagataatggcccctctattcttgggtagagtattgaatatcttacgtggattaaggaaatgtggaggactccctagggccctacacaggaagagcattatcaggagcggaaagttacctgtataggaaaatgtgcttttattgaaatactatcttgaaaactttctatttgataggactgtcatcttccagaatcctagatgctggcttgggcaagaataaaacatatggacagttgtcagtggatctacaggtttagctaagcttggttatgcagggtcaccctgttctctgtggagtctacttcataaacatagctggactatttttatcccccctcagagctgtttccactttaaaataaatttctattcattgttgtttgccaggcaaaaatcatatgcagcaatgctactaacattgatattttatttaaacatgttgataagaatgtggcacctaataagaaatccatatcccaccatcagccataggcccagaatccactgtggatgagaaacttttgattataggaaaaagaataattggtgctttctaacctgtagaaacttggatgcctgttggagccacttgctattccttaaacataatcattcttgcatcctgacccacattcttcctgaaacaaaattttcaatattgtcttttttgttgctgttgaaggtctgtgtttgcaatgattaccttgctaaataaaaacttctgagtatttctacatcactgctaagaataatattttagtggaattccttagaataagactttctactatacattattgcacgagaatatgcctgatatacttaaaagagaacaatggtagctaacattgattgaaagcatctgcggaggcagctatttgttgaaatgccctctctacatcagatcacatggctcacatttacctcgtaaatttggaactcctgtcacccttttctaatggagaaggacacagacttgggagaattcaatgacttgttgaaaccacacaattaagtactatcaagtcacctcttgagtgtccatccaagtatagaaaaaatagcgtcttttctactggctttacaaaagggatttgtaattgactttcagggagtttgagaatggcaagaaaagccatgtcaatggcagccggacaaacattctccagcttcccctctgctcccagggcctccctggggctcagattagtaggttgcccttgagcggacattgagaaacaaatgcaaagccctgtggaaggcagctaaggtcagaggtggagaggaagaggtgtagggtggggagagcacaggtgactgtctgaccataagatgagcttcataatcagatgaggcggctagttggaatgtgaggtcagcaaggatgagaagcagatgagactagccctggggcatgcaggaagctgagagacttgagagagtggttcttttttggggggcgggtgatatctagggtgccttatagccataagatgctgcagttcaaatggcacaatgtgttattttgagtaacacacacatacatgcagacacatgtaatgggcagatgctcacatatatcacatataaatgagtcaggaaacaaggtcatcatgaggaaagagctctaaaaagagccgggtcttgttccaactctgtgctgccactcaaggcccatgtgagtctctgagtctgtatttacctcagatagagacagtagatgcatcctgcccttcttctcctctcgttgggatgcaatgagataatggccttgctctgtcacccaggctggggtgcagtgatgtgacctcaactcactgcaacctcttcctcccagttcaagagatgcttctgcctcagcctcctgagtagctgggattacaggtgcatgccccacgcccagctaattttgtatttttagtagaaatggaatttcaccatgctggccaggctggtcttgaactcttgacctcaagttgttccacctgccttggcatcccaagttctgggattataggcatgagccactgcgcccaacaaagagtggttctaaccacagattcccgggctgtttgtagcagggaggcaggcagtatctggcaggagcaggggtacagccagggatccacgactcctgagtaggtgcttctcaagccagaggcgggaagcgcaatccaagaagtgaccgtctccttgcagtttcatgacagcacctcctgtagttgtagcagatgaaagctaaacagattagttaaaggaatacatgagtggatgcatgaataaagtataagggaatgaatccaaccctaagttagaaaaccctcttcatccttaatcataccacctccatagttttcccttcctcaggaagcaaagcgccaagacatctacccacagcatgtgctgtatgaacggtttgctgcaaacactctgccaggattcaaataaacaggagatcagaaactagtgttggaaaatgtcttttggcacattgcccaactgtgatcttggcacggctgattttgttttggtttatgtcttgggctttcaatgttcattttcatactgctgtttcacaattttattttcttttttgagtcatagtttgtaagaacttggtttatattactattccaatgcaatagtgtttttcttttggtatgtagtatgctctccaataaattagaagtcactagtcttgcctctttaccatgcagaaaactttcctgatcaagcaagcattgcccctatatcttgctcctctccattctgtcagctgggtggaattcagtccagtgctaacaggttgaggtttcctttactacaagctactggtctttgcactgtaccttctgatgattgtttaatctcaaatgcatgtagcaatgctatgaatagctcccactttatttcagtgagttttaaaacttcatgaaaatagaacttcacagagacttcattttcttctctgttttccatagccaatatgataaaacgtgtttgtaaatcttttcaatttagaaagactttttcttcagcttctcatcaatgtctgatatttaagaacttatacataaagctcaaaatgagaaaaatagcttgcatcaaatccattaaattcccagaagttattttcaactccacccaagttaaattaaataacatgtatgcctcacaaaagtcacagcaccttgtttatagtaggcactcagtgtgattgatgtgtcaacttgtctaggccacagtacctagatatttggttaaacattattctagatgttcctgtaaaggtattttttagatgaggttaatatttgaatcagtagacttggagcaaagtagattactcttcaagtggatgaccacatctaatcagttgaagaccttggaaggataagactggctccccacaaggaggagggagtcttgccacatactgccttcaggcttgagctgcagtgtcatctctgccctgggtctgcaactagcagctgaccctgcagattttagacttgtcattctccacagttgcatgatcacatgagccaataccttcaaatcaatcccaatgtttctctagttctctctctctctacatagatagctaggtagattgatagacaggtagatgataactaggcagataggtagagattatatacataggtgaataataggtaaacaggcacaggcatatactctatctgttctgtttctttagaggactctggcaaatacttactgacagttggattagtccttctttcttcccatgtgggaaacctctggaacaggtgcgttctactcactttcaccttgtttaggcatatttgttgaaacaaagtttccccttttctcatttctacatttttattctattttccatttttagccaacattttgatatttatccagttccatgatagtaggtattcattagtgatctcttccaaaaattgtctttgttacctccaagatagatggaattattctcagtataattttgaagtttagtgtatttcattttttctataattgatagccatgtatggcacattaagtattatcaaaccacattagaaatagaatttaatataaattagagtttatttatacagtagttattaaggcaagttaaaattaatggcataccgaacaggatagagcatgggatctctgacctttattttcagttaaaatagaaaacattgaaatgataccactgtttcatgaaatgtctagtatgacgctctggcactgaccacactcgtctattaaattggcatgatttagctatcactgatatttgccattaattctgcttatacctatgagggtgataaaagtcaactgtgacaatctacacatcaatttagcagtaaggatacagttctcctgtggattctaacaaatctagtacagaaggaggcactcagtaggtgatgacgatgatgttaatggaatgtaatactcctttttatatgagtttctttatgaacttctggatatgtatacagtgactgaggcctggatatatttgctaatgcaacaactcactgtctaatcagtctgttctcctctcaaggacatttcactttgattctcatgcttactcaccttaacaaacagaaaatgaattcagaaatgaataattgggcttatgagtggaagctcaagagaatcctgctctggacaccaggacaatagtctctagggaaatgtgaaatctccataagcagacactgggttgcttttagctgcttaatgtggttgttgtcatgcgccttgattgctccaacctctctagccccatcagaaatgttccatttttagataaccgaatgtttttcatgaaaataacacaaatagggcccactctggcttttgcaatttcaaagatatttaaaaccaaatggcatattacaaattttagttatcatcctcctcttttatctattttttcccaaatgtcatttctactaattcagtgtttttctaacttcctcctgtgatctttcatctcctttcattttaccttttctttcagtctatatggaaattaaagggagtccatttttgagttcctgctgtttcagtgttttatgctggactttcttatgcctccccttcatctacccaactaagctctgtgcatcttccttgttatgactttttgctgcaagtatactcagcatgtaatgttcatctctagaatatatctggtttctatttctgattcaatttctacttgctcaagtctctcttggactatttttcttgtctctattgggaaaatctgagaaaaaaatagagtttggagcctgtctaattaggtttgaagctttggtaaagttgcttctttcaagcctcagtttctgtctttgtaaaaaggtatatttatagttattagtccataaaatcattgtaaatttgttgatttgtacgggaaatacagtcagtactttaagtgtttagttaccatttttgtttttcctgtttaaaaaaagtctatagcttattccagtctttttttaaattaattaattaatttttttttttttgacagagtctcggtctgttcctcaggcttgagtgcagtggtgcaatctctgctcactgcaacctcagcctcccaacttcaagctattctcttgccttagcctccctagtagctgggactacaggcacccgctaccacatctggctaatttttgtatttttagtagaggcggggtttcaccatgttggccaggctggtctcaaactcctgacctcaaatgatccatccaccttggcctcccaaagtgctgagattacaggtgtcagccaccacgcccagcctattccagtctttttgactaaaacacatatttaacctatggaaataatttatttttattttacttttattccattggtagtgaatttgtaaccaagaatgggtatgatgacgtgtgaaattatttcctttactatataggcatatttttatgtgctactttgtgtatatctagcatatattaaataataaataattgttcgatggttatattgcaatgcaaatagatgtttatgtaaatttagtgccatatcacaaatttgctagcaagatttttttcaataatctataaacaatgtcaagaaaatatttttgtgctttctttactatttggagagcactctattagaaaaaatgccaggaataataacaatagcttatactcactattggccaggcattgtcccaagggcgtaagtattttatcatcctcataacagtccttcgaagctgggccagttgtgatttttatttcacaaatgaaaaaacagatgtacagtataggttatttcttccccaaagtcacatgtttaatggcaagaaaaaggggcttgaagaatgcctgtctggctttggagtctgtcctcttagcatgcagaaagcctgttctcagggagcttacagtctgttctcaggatggtgttttgtcacatgtgacacagccatttgtttcatcttgttttatctattataaaatctacttctgtagacatgagactgtgaacttttctgtattgtttactttctgctttggtagatacatttgctcattgcacatacgtggtgatgcaagtttttcatctgataaaatcttcacttttcattgatttttgttctcaatttttattaatttattataatatataaactttgttttaattcgaattggttaatttggacaggaaaaaaagttcagtaaatataatttttagccttttctcaacctgccttcaccataagagtgccaggtgtctgagttcaaccctttctctgaaatagctttttcatttgtagtgagaattgataagtgttaattatcactgaaagtgagattaaagcagtgaaaagttccattaagaagaattaattactaggctggcatttaatggaaaggtcttaagcaaataataagatgccatcagcatcttattacatctcgctactgacatttgtagtttaagatcatgattatcaaattaatctggctttacagcagcttcctccctgtccccaggactgtgcacttttctacacagatacaagagcgagggtattctcctcagtcttggtcctatccttcagtgtcttgcagtacttcagagaatcaccctattcatcttccaagtccagttatgcttactctatacctggtgaacagtctttgtttttttttctgcaagtaaatacaatggtcttttcaccatatgtcaatatataccattggaaggaaagattttgggcagagcagaaggaaaaatgtattttgttcttccaatttctttgtgtccaaagccattgcccacatccttcattgaatctgatgatttaaaatgtgcccccaaagtctccagtacttaccaaaacacaatatatttgcttatgaaatttcagcaccttctcttcccccccaattatggtgtattttgtctcatgtaaagatcattaaacttttttgacttttgattcttgtgacttgagaattaccaataaagaacacaagcaaaaatattttacccattaggttggcacaatgtcttgacattgcattaatttttcagttccaaaattttcataagatctaaagtggaaagatccagatcactagatgcaatactgaaaggataagggcaagaacttgtaataaagtttaaagtttccaggtttctacatgcaaaagacatctccttattcagaggaaataatatcaatttgggaggatcagatgtagcttcaggatgcaggttataccaaagagatagacccttattcttccagatagaccaaagctatagctggaagaataatgaagacttctccatgaaagagaggacctcccaggcaagcaagaagccatttatctcctgcaatccaatcataattatttacaggcgctgtgttccagagttccagaaaaccaaaaggcagacacattccggatagaactggggatgacagatctttcccttggactgatgagcactacaggcaaagggcgatactgaggcagaataatatatttcaggctgcatttaaaactccagagacttgagtgccaagtaaaggagtctggataaagtctggaggaaggggacagagagagaatatttttgagctttggaaatattaactgggaattagtgtgtaaaatgaattggaggcagaatgatagacagattaggtgacagcaaagtaactaatggattggtggcttgtatgtgtgctgcttaactcaaaatcttctgcattgattatttttctttttaataacgtggtgaataattttttaagaggcttggtttactttttaaatttttttcttttaattatttatgagtctttaataattcagagagaggcattaatgcgaggaaaccttggatttgcttcaccacaggatgccataaactactttatgggaagttgtagaatttacaaaaattctcaaaagcaaatacacattttaattcatttaatctttttttttttttttttttttttttttgaaatggactctctctctgtcgcccaggcaggagtgcaatggtgcaatctcggctcactgcaacctctgcctcccatgttcaagcaattctcctgcctcagcctcccaagtaactgggattacaggtgcccaccaccatgcccagctaattttggtatttttagtagagacggggtttcaccatgttggtcaggctggtgtcaacctcctgacctcaggtgatccaccggcctcgttctcccaaagtgctcagattacaggagtgagtcaccatgcctcgccattcacttagtttttcaagttacatccattacatatgatcatgtagggtggggtcaggttaaagaagagagataccctcactgtcaaaacaacaatgacatcatggtgtatgttccaagttacagaatttgaaaagttgctatttcttcttcactcttcctcagccacactcaaaatgctgttatagattcatgctgctttttgatggtggaataaaaaacctgtgtgtgtgtgtgtgtgtgtgtgtgtgttttcaggctggtgtgctattgaatccttataaaacaagactgtctcatgtttttatttcttattttactcaaattgccaatacaaatacttattaaggaaacagttagaccaatctcagggtgacttgagaataggattggcgtaaagaatgcaacttttactctggttggcctcttactgctaaagggtttcagtgatttgacaactccagtaatatctctgtatctcaccatctggcaaaatttcacagtgcctatttgatgagtaagaggtgctacgagatcatcacgaggaaatttcagcaccaacaaacagcttcaagaattgtttatgcccactgggtagtgctgcaaacagacacatacactgaaatatgttgctttgttttagaaacacatgtacttcctgttgtagtttttaattttttcagtaatgcatgtgtgtttagccgcactctttttaattcattcaacatctagcatttagtgaccctgtctgatgtgaacagtgcttctcttccagggactaatgcagttgttttagattattgtttcttccctgcagcttccaaaataattaatagcaaatcactcatttcatttaagaaataggtatttcctcccttggaatccaaattatatttagatgtttttatttgtcctctattccataagatcactgaccacgtagagggtcagagaaggttataacttacgtagctctaattcgcatgtctctagagaagaacattctgtcgtcctaaattctgcagctagtgagactggcaaaccacttatttttaatgctagagactcctttctcccaccttgaagagttggcagctctggttagggaatgatgccagatctaagcaaagctgacttaaagtatgggtaatctgggacaccagtggtgctatgaatgcacacaggactcaactcccagctgggttcagatgaaaagagtctggctgatgaattctaccacaggtacaaggaggagctggtaccattcattctgaaactattccaatcaatagaaaaagagggaatcctccctaactcattttatgaggccagcatcatcctgataccaaagcctggcagagacacaaccaaaaaagagaattttagaccaatatccctgatgaacatcgatgcaaaaatcctcaataaaatactggcaaactgaatccagcagcacatcaaaaagcttattcaccatgatcaagagggcttcatccctggtttgcaaggctggttcaacatatgccaatcaataaacaatccagcatataaacagaaccaagacaaaaaccacatgattatctcagtagatgcagaaaaggcctttgaaaaatttcaacaacccttcatgctgaaaactctcaataaattaggtattgacgggacgtatctcaaaataataagagctatctatgacaaacccacagccaatatcatactgaatgggcaaaaactgggagcactccctttcaaaactggcacaagacagatgccctccctcaccactcctattcaacatagtgttggaagttctggccagggcaaataggcagaagaaggaaataaagggtattcaattaggaaaagaggaagtcaaattgtccctgtttgcggatgaaatgattgtatatctggaaaaccccattgtctcagtccaaaatctccttaagctgacaggcaacttcagcaaagtctcaggatacaaaatcaatgtgcaaaaatcacaagcattcttatacaccaataacagacaaacagagagccaaatcatgagtgaactcccattcacaattgcttcaaagagaataaaatacctaggaatccagcttacaagggaagtgaaggacctcttcaaggagaactacaaaccactgctcaaggaaataaaagaggatacaaagaaatggaagaacattccatgctcatgggtaggaagaatcaatatcatgaaaatggccattctgcccagggtaatttatagattcaatgccatccccatcaagctaccaatgactttcttcacagaattggaaaaaactactttcaagttcatgtggaaccaaaaaggagcctgcattgctaagtcaatcctaagccaaaagaacaaagctggaggcatcatgctacctgacttcaaactatactacaaggccacagtaaccaaaacagcatggtactggtaccaaaacagaggtattgaccaatgtaacagaacagagccctcagaaataatgccgcatatctacaaccacctgatctttgacaaacctgacaaaaacaagaaatgaggaaaggattctctatttaataaatggtgctgggaaaactggctagccatatgtagaaagctgaaactggatcccttccttacatcttatacaaaaattaattcaagatggattaaagacttcaatgttagacctaaaaccataaaaaccctagaagaaaacctaggcaataccattcaggatataggcatgggcgaggacttcatgtctaaaacatcaaaagcaatggcaacaaaagccaaaattgacaaatgggatctaattaaactaaagagcttctgcacagcaaaagaaactaccatcagagtgaacaggcaacctacagagtggaagaaaatttttgcaacctactcatctgacaaagggctaatatccagaatctacaatgaactctaacaaatttacaagaaaaaaaaacaaccccatcaacaagtgggtgaagggtatgaacagacacttctcaaaagaagacatctatgcagccaaaatacagtgaaaaaatgctcatcatcactggccatcagagaaacgcaaatcagaaccacaatgagatatcatctcagaccagttagaatggtgatcattaaaaagtcaggaaacaacaggtgctggagaggatgtggagaaatagggacgcttttacactgttggtgggactgtaaactaattcaaccattgtggaagttggtgtggcgattcctcagggatctagaactagaaatgccatttgacccagccatcccattactgggtatatacccaaaggattataaatcatactgctataaagacacaagcacacgtatgtttattgcggcactattcacaatagcaaagacttggaaccaagccaaatgtccaacaatgatagactggattaagaaaatgtggcacatatacaccatggaatactatgcagccataaaaaagatgagttcatgtcctttgtagggacatggatgaagctggaaaccgtcattctcagcaaactatcacaaggacaaaaaaccaaacaccgcatgttctcactcataggtgggaattgaacaatgagaacacatggagacaggaaggggaacatcacacaccagggcctgttgtggggtggggggaagggggaggggtagcattagaagatatacctaatgttaaatgacgagttaatgggtgcagcacaccaacatggcacatgtatacatatgtaactaacctgcacgttgtgcacatgtaccctaaaagttaaagcataataataaaaaaaaaaaaagaaaagagtctggctgaggtccagatgagatgaaatttactgcttcactttggtgagtcttggctttcattaatatgcatcagtgtatcttatagaattagaaatatttgaagcaaggaataaaaatgaaaacacagtatatactgaagaaaagagtattcctgttcatttggcatagatcaaatcagttgaacttaaaactgtagaataaaattacagatacagaggtcaagaaaggaatatttggagaaaataaaaatgaaaacaacaatgataaatttggataccatttgataacatatagaatttcatttcaacaaaacatacttctacaatgctatagtaacgacattaagttctgtgttttcattcaaattaagtaatagaagattcttgatgctaagaattctaccttcttagtggaaatcatataaatattttaccataagccccaattttttatgtcgttagaatgttaggctgtttcctctttgaattcattaagagtattcatcatttcaagttttcacttttttatactaggaagtatgctgttttccaaagagaatgaatgtaagttacaaaatttcaaatcatccagcttccttattttcctatctggaagcacatgccacaactccattagcaaaacatagtaacgatagcccgataaaattaattcccaaaaattaccttagagttttaatcttttccaaatggaggccaataaaataccacagccacaataatattccattgatgagcgccaataccttcctagccctccatgttgtagcgggtgccttcatatattttatttgcttctttggacttctcaaatattccatgagataaagagttaaagcatgaataaaacatctgttttccagaaaaggaatctatatgcccaagggcacatagttaacatatgatgaaatcatcttcaggtctttcacttcaagttccttgctctttcaactatttctcaagatgaatgcaaaagggattatttttcttttggtgtcataagagagccctggcctggcctaggaattggaagaacatagtcctcacgtgccagatcagtgatttgtataggctgtgtgactttgtggttccctacatcaactgtaaaatgaaggccctgaactagatcattttaagtacttacagctataaaatccaacgactctatttaaaataatgtaagaagcttaagaaaaattgcatctataataagttttattgctgaaagtttcccagaatgtatcctgcaaactacagtgccacatatgttaatatatatattatggcataaaagaatcttgtgggtaattggttttgggaaatgtagagtaaaacaaaattaggcataatccctttatggcagaacttctctgtgactaacattccaattgcggagtgaaactagagaaagaacatggagagtgcacaggtccaggcagggtccatggacacgtccatggaaatgatagtccaggaaaggttctctgagaaaagctgtcatgtccaaactgtcagtgatggttctcaatgggcgaatcatggctctcttccaaatggacctagaggtggctatgggctgtgtacttaaagacatatttggcggaataaaattaaaagaaatttcttaataaatataactgcaaactaaacttttagactgccttaattcataatcacctcaactgccgagattatttagcaatattcaagagattttttcattcttctttacctatagtagtgctggataaaaggatttctggaatttcttagaatttcatattaagaatacccgattatctttgccttagtatgcttgttgatgttggtgatatgatacaaagctattcaaggaagcttcctaaggttcatgtttcgattaatcgccacaacatgcacagcagcgcttgccttcaagatcattggagctgtgcagggttgtcaaattgacatgcagtctccacaatctgataatttttttttcttattactgttttcaggatgagaatatgaagctgatctgaatgcttttgacatccataggacttgcaagatagctctccaataactataacagacaggttctctatacacataaatcataggtagtccacaagaaggggactcttattttcagtccgaggaaagatttctcctgttttaaaacaatatgactgtgtgcctgcaagactcacaaaacatatatatatatatgtgtgtgtgtgtgtgtgtgtgtaaaggctccattcttgatatataattttaacagtttttgtcttagagataaattaatgggattgagaatttgttaaattgacttttcttcaacattttttcctacttatttgtttattttcatgttggtggtgaattacatgaaattgtctttcatttattttttcagtgaacagctagttttacaaactacatttgctccctgagttagttattcttatttttatttcaaaaactgtgatagagaaagaattggaaagaagacctactgtcattcttggcaactattactaattttgagatgcatgtctcaatttaccccagaagcaatattcatccagaggtaccttgcaatcagtgatacatttaattagatcctatatcttctttgagaaaagcaaggcctgatgtgaaggctcagtgtgtgtatatttgtgtggaaaatggaaagaaataggaaaataagttttttttgtttcataaagtgatatttatatgaaattatattagttaagtgcctcagacacaaacagaaaggattggatggcaagtcatccacttattctctgtgtttttgcatttttgtatttcttctaaaaatgtacatattgcctgatttctgccaggttgtggggctgaataagcagatagttccctagtttcatgaaactttcattggagtgtttgtgtttgggaggataggaggaacaggaaataagaaacagaaatagcctgtggagtgttcctgagtgtttggcacagaatatttaaatgtcatgccaaaagaaaagtgtcttaaatttgtccagggaagcctactctgaggagtgaattttaaactgagatgtaattgacagagcaaaaccaaccataccaggattagaagagttaacagcagagcggaggcgcccaggtaggagtgagcccacaggttagaggaagcaagagaagggagctctgagtcctgatcatgcaggatactgtaaagccaaggagagaaattttgcttaaattctgggtacaatgggaagccaccaccatattttaagcaagactaaatggcatgctttctttgattttgaagagatcattctggctactatgtgcagaaacgaatcatagaggaaagcagctcagagactggaggtgggcttgtctcagtgaccatgggcagaggctgacaatttgcagcaggaagtgcttgtgagaaaaaaatggatatattttagactttgattccatgttttaataatgaggtgtgggaaggcacagtcattgcaactcaattcaaagagaagagcaaccagtctgagagggaaggtgggtgggaagtggagagcttagagaagtgtctgcaagatgaagtaaggatgaatgacaagtcctctcagcaagccaaagcagactcaatagataaaaatgggcatatgactgcaaagcatgtttaacttcttgtgctagacccataaataatttagactgtttttttttcagaaattaaaaaaacaacagacaaagcaattcagaaaatgtagggactgtgctttttttcattcccattttgaacgcagtgctttgtttgaaactaggaaggatatgaaaggttgttttgagagtgctccatcccagagacctgtgcaaggtcacctccatctctgaaacccagcccagtgctcttactagttagatctcatctttatatactgaattcattatttttatcttccaagatcagaacattttcaaaagaaaagttaagtaggaaaacagagcagcaaacagaaacatccgagggtaagaggctaggcatgtggcctgggcaaggatccctgaggggaaagatgctgatgaagatcctatttgtgttcacttatctttactcaaaggagacaataaataaataaataaataaagaccagatgcccttttcaccctatcttacattcattcctcttttccattgtcaatcctgtcataggcagaagatggaaaggcgaaggcttcatagcaagagctgatcaaagataaagttagaaggtcagaagacatgcagactctgtagtggagatgtggcaccacaaacactgcttgggcgttagacggtcttcagttggcttcccaagaaagctgtttactagatttgtgaccagggggatatccttggagcctcagttttcatatcttcataaggggaaataataataatacagatgcctggaggatcatttgtgaatacctgcaaaatatttcccacggggcctgttgccaacccagctcacaacggtccactcaacctaatggacgttgggatgttgaaatgtaggtcactcttttcttcaaagccctttctgcctttctacagtaaagagatgctgggatatgaaagagatttgaaacaactaattccccaacttagactagaatgcactgaaatagagagagcgggggagagagggagagagagagagagagacagaaggagacagaagaaagggggaagaggagaggagagggaagaagagaacagggctagaatggaatgagttagtcaggagctaattaatgaccaaagatgaagaaaagaaagcaatgcaaaaaaatgaaaatgcagccaaggcagagcacattggataggactatacttaacagagaaatgtcttgctgttgtgcaggcttcctcaatctaaaatagcatgggtggccttcattcatggccacgatcactgaagtggctctgaagtgtctttgtacctgtaaaaatgggcttgttttgattttttgaacatacaattaaaattgttgtctttattgtaaaggcccatgtttcatttaatagtctaccagaagtatgaggacatcacttaaaaacacttaaattagaatgaaatagtaatacaaataaaaataagaaaaacagccattttattgagagtttagctgagttgggcagttacttgtttccctcattatctaatgttgaattccaggtagcaggttctatatttctgttcattttagaaatgaggaaatggatgtttaagaagttgagtaacatccgaaatatcctccaattattagctgacttcgggattcagtcctgggtctgcctgaccctagacgtcagtgtcactaaccactatgttaggaagaaaatataggagatatggatgaataaaggtaatcttcttccacacttgggtaaaatcacaagcttgggagaattgacaccataatgtaggaattcttccttggacaagctgaaaatcattctatttcggtacattaaaagccttcacgctgttaagattttggagaagaatgagcgaatttggtagtgtaactagcaggcggggaaggactgtcccttatggcttagcaatgagcagcagggcagttcacaatggcgagacgcagacgcctttggggcggtgcagccagagcggagtgcgcctgggactgagtgtcctcctcggggactgcatgggccccgcaccgccgcctgccccgcgccacgacagcccagagcacggatgggcccagactgtcctacagccgtttcagcaggcgagggtctgtccagcagcacctaaacagcttttgtatgtcctgtctccaaagtgtgtggctttaagtcaggttctgtgcttttgatgacaatattttctttgggtcgggatcattttcatctgttgccccttctgcccaacctttgcacttccccccgatcctcctcaccccttcccttcctctgcctgtctgcacaccaacgtccttgggctccctcattctccagttcttggcttggtctgactggggacttctcacacctagcttgtcgtcgcgctctagggccattgcatcttggttaaaaggcctgtctctgcagactgaaggctctctgcgggcaggaccaggccagtttggcttctccctgcccgccctcggagcctgctccaggtatactggctgaatgttctgagagacccgcagcccaggattgctgagtcgcttgtgtgtccgctgtttacagctgtgcgtgcgtgtgtgtgcagggaaacagccaggcagatgcacatggttatttatatcttcagattatttctgtgaggaaaattctatcctggtgaaagagcttgctgttgaaaaacagtaactgtacccatatagacaccacagtattcgctcaatgtatttgacagacacactcatattgtcagggtaaaaggaggcagcagcttctttgaaatgcagggacagagcaagtgacaaggaaaaaaccacacagcaggtatgtccacattgttgtgcaaccaatctccagagctctttgatcttgcaaaactgagacagcgtacctattacacatcaaactcctcgttcccagttctcctccagcgcctggcagccactattctactttctttctctatgaattacattactctggatatctcttccaatttttattatagcctgcttgacgttgtaaagaaatcaaatgtttggcccagtagccattctcctctctgcttgctccatcacgctgaaaatcaactggtagcttcagctgtagcagacggagccctgagctctcctgacttgtacatgcgcttgtaagtacacaaaatgccctgctccctagtttctgcctgcacgagttcctccatatccctgccccagggcttcctgctttactttctcctcacatcccttcctgtagactccttcgcaaaaaaaaaaaaaaaaaaaaaaaaaaaaaattatgtttgcctcatgagctcccagggcacagctttgctgcctctcagctgcccagccgactccactcgcaagaacagtgtgttcctgaatttttttaataaaataaaataaattgtacttttatattatacattataattgagtgtggtagaaataaaatttaatttcaggtacttttgataatgtggctctggggtttttactgaaaaagtaaaaattcaataaaaagtattctttagggaaatgtgtttttaagccttttagacacttaaagctaacttttattaggggttcattcacagactgtacacttttatgatttctattcatatttttctcacttttgcttaaaaaaatcttttcttagagaagaactgtttttccaataaaaatggaatgaattcccatacattagtctcttctctgtaagtgcccttctgagccccatgcacacagaagagagtgaagaccagtgaagctctttagggagctaaataatagatgcagatgagtgtctaacatctatacagactaggttcctgataaacattgaattgaatctcctggcaggccagggtattaatctggggagaaggaaagccatgtgagttaaaaggggaagtatcacagaacagaagcaaacaatagtacctgaagtaaccttagcaataatagcctaatagcaaatgaagaaaaggagagacgggaaaaaataaactggcaccagagacccctgggaaagactcataatcagaggtaccaataaaggcaaatgtaaatacagagcctcagtcttctaaggcctcaggctcagaaattttacccatggttgctagaccatggaagtcactgtttcctttatcttggaggcaggctagactgaaatgataaagaaagaatctggactctgacatttagatttacagtagtgcactattgtttgtaagggcattattgattagagtagggcaaaaagatgggccaacataatttgttttagtctatcctgtattatggttacttgtttgtctgccaccaactatgaaatgtgactttaggaaagcaaatatggctatcattacatcttgttataataaatgaataaaagtgaatcattttatcattttcaggtggtcaataattgttgaaatactataatcttttatgcattttttaatttttatgaaatattttcctgttcctccccaaaggcatataaaatattttgctttcaattaaaaaattaaaaatattacaaacaaaacaatccttgccctctttgggctttcagagtatgtagactttctaaaaagtctttgtagtgaaataaaaaatattttaaaagttaaatgatgtctttagaatatcttaattttattttttgttgttgtgggtgtgaatattattaattttttaccgcaggtccttcttaaaaaaataactaatagataataaaatctatggagaaaacaatagctttaaaaataaaagtctttgaaaaaaatgagcatggttttcaaattgacttgatccaatcaaactcttatgtctcctttaagttaaagatgctttcctagttccacatgaaatcacttataaaaagaaaaagtacatctatgccctggagaattactcagtgagtatgtcagatccttcagttataatatgtatgggcacataaaaatttataagtctcagtggtatgcaactgctcaggtagttggcatctgaatccttcattttgagagctcaaaatattttgtgagttcaggtgactttgacttcttcagtaaatgtttttggcattttgggcccatctgctccttggtagacacagttctaaactctggaaatacaaaagaattctgatagctaattttgaatcttttctaattttgaatccataactatatatattcattatatatagtgcaaaatatcacatatatgtatacatgtatacatacataatgtgtgtgagtttataaatatgaaattcatcaggtgctgtggctcgtgtttgtaatcccagctactcaggaggctgaagcaaaaaaaaaaaaaaaagtttgagcccaaaacagtgtgtgtgtgtgtgtgtgtgtgtaattatatttacttgaccaaggaccaaggatgctaccttaacttgcatttatctttacaaaaaaatagatggcttaacctagtatagtttagatcattcctagttttatttttagaaaactaatcaagtggatatttgtctattaacacttatgtccatgtttcctacaatactcatagaagatgtcagaatacttcagaattagtattaaattgtgagagatgggaactacagtaaaattgatgtaatccaattcaattgagttgtaaagttattgatttttaaaaagcattaaacattatgcactgtgtatacttttaatacagtttttcaaaggctacagtgcttgtctaaagttataccaatgaacctttataaatgcagtttcctctcatccctacccaaaggatgcttcaggaagagggggatttataccacagtcatttcatggaccgtaaaacctcaagtgttatgccatagttatgcaatcattttgatgcttgacaacttgtctttgttacataattatattatttgaaactcagctataactgaaaaaggaaaaacattaacataggaactttctgattaatcattgtaaacagcgagttgtctattcatcaagtaaaagtttagagaatttgaagcaaaaataaaatatttgcacatttttcaaaattcaggtaacatctttataaaattgtgcatttaatgtgctttatgtgtatatatcatttatactgcattcaataagaatatcaaattcagtctttaaacataaataatgtgaattttatatatttaaataatccttttgttttttggatttctaaatacaaataatctcgtttgctttttattattgagaaatttatgagatcacagcttacataaccaaatgagataatatgtataagagcactgagtgtggtgcctaaacacccaataattcactgctcttgccctggatagccctgacttaccagctgaaggccaacatgggtccttgtcagtcacagcaaccaacagaggcccccagagagggctgggatggtgctgtctacttcactgccctgatgcttttaaaaggtttgcagaacagtggtatagaataatcacagttattgaattcttgtcttgcccccgtttaaagtaagaagataatgttgctctactgaaaatttgaaactacgtttcattttattcatgagaaaattcattcccagtgagatgaatggggggtactgttatcctgtggccttggtaggatttaactttcatggatgtgccagttcagtttattactctgaggcacaattctgccttgttctcttctatagccactgtatttcttactatccattatactagttttcttttgtgacattttatctttcaaatattagattaaaaatcctgtttggaatgaagctcaaacatttggcattatagttcatgttgtgagaatttcttgtttttactatttctaaacaatatatttctcttggattggatagggtcaaatataatttttttatttttatttatttatttttttttggtgagacagagatttactcttgttgcccaggctggagtgcaatgacatgatctcggctcactgcatcttccgcctcccagattcaagcgattctcctgcctcagtctcccgagtagctgggattacaggcatgtgttaccactcccggataattttgtatttttagtagagacggggtttcaccatgttgcccaggctgatctcaaactcctgacctcaggtaatccgcccacctcggcctcccaaagtgctgggattataggcgtgagccactgcgcccagcctagatagggtcaaatataaattatttccagtatcaaatgaatgacttgagatataaaattttccttaatgttttacacctaaatgtataacttatatggttcaattacttgtattgtttgttgtaaaatcttatttaaaaaataaatgttgtttttaaattttatttaaaaaataagatcactacatttcatgcaaagtaagttgaagaatcgatactttatagtaggaagagaatcagcatgctaagtacagcatgctaagtatagtttaaggaattcttacatggctgatttcattaaaaggttgcccattccccaataatagcattaaaaatgtttggctggaggtgtgtcatggaaagtaagttgtctcggtaatcttaaaattgtaagcatctgtatcataaagcaatctgttcttctgttggagtatgttttttttacctctgccttaccaatttccagaaggaaaattgtctgaaagttgtttttggttgaattctaattaatcagctttccctctggtggccaggattagattcctaaggtactaaaatgtcataataatgaattgagaatgaaagtttcagaggcacaaagtgatggttgaaatatactgaacatgttttaaaagtggaagcagccacaatgtttttttgtttgtttgtttaatttttattgttttgagacagggtctcactctgtcgcccaggctggagtgtagtggcacgatctccactcactgccacctctgcctcctgagtagctgggactacaggtgcgcatcgccatgcctggctatttttaagagagatggagtttcaccgtgttggctaggctggtcccaaactcctgacctaaaatgatctgcccgtctcggcttcctaagtgctgggattacaggcatgagccaccgcaccgagcctacaatgttttaaatctattaaaatcaatattgaaatcacatttcttattatctctggagaggatattaacaatattaagttgtgataccattttgttaatatagattaggcttttagttatagatgacaatagaaatttttttatcattacaatatgaggggttaatgactaaaaatagttcatataaattatattacataaaataaatacagttaaataaggcgcataaacaatggcaatgcaagttttgataatcaaattcactactgcaaataactcagcagaagggatggttttcttcagttatttggtggcatattctctcatgataggtaataccaaattcatgtgattgttttttaaactttgattatatttatagacacctgtttggcattcattccatgatgataatgataatgatctctatttgacttagtaaatctgatatgacctttatattttataagtacatatttttcatgtatcaaaggtttcatagaagtctacttattaaaaatccaaataatttctttttataacaaagacctagtgagataggctttatagaaaagtgttagagttctacaaataaaagaattaggttcatttgaatttattgaagtgaacaatattttagtattagttctattataaaacatcctaaaaactttcaaagcaaaagttgtgctgatcagacctatcgaggtaagtttctggcattagggtaatgtataaaataaaaaaggggaaaaatatgcccagatcaacagaaaaactgcaataatctgaatttcttgtgccaagcagaactgtatatattttacttccactttcctgataaaggatctaattgggtcactgttcttcagataatgaagagtgttctacagtgtgggtggagcactcattatgaccccctctcatatgactggcctgaattggagtaagattctaattatcgattaagtcaattgtggttaagctggaggtatcacaccaggcaaatcattgggattgtgcaatattaatgacttttccaatttcttgtgttgccaattttatcagaatatgtgtacatgatactcagtatagcccagattaaataataaacatctgagtggccatgcctgtaatcccagcacttttggagtggttcatgcctgtaatgtggttcatgcctgtaatcccagcacttttggaggccaaggagggcagattgcttgagctcaggagttggagaccagcctgggaaacaccataagacctcatctctacaaaaagtacaaaaaaaaaaaaaatagccaggtgttgtggtgcatgcctgtagtcccagctgctcgggaggcagaggtgggagggtcacatgaacccaggaagtcaaggccatgatcgtgccactgcactccacttgggcgtcagagtgagccacggtctcaaaatagataaacaaataaataaataaatatgtaaatataaataaatatctgggtatggagaagaaaagtcttctgtaatagatgctgagattaaaatgcaagagtatcccaaaattcctagctagaatgagcaattccatttgcccttagcttatgttgggaaatgaaaagtaggttatgtttggaaaagtatgacaaattacattttggaaattctgagtttgaataacatgttggtttccatgaggagatacttccaattaagttgaagtgtcatactggaccccaggaggggggagtcatatctaagcagatggtgaatatgtagtgaaaacaatatatataagagtgtcaaatacaaaatcataggatgcctgaaaaattaagagtataaataaaacatacaagaataagaatgagttagaagaataatttccagaatggcaatgtgaaacaaccataaaaattaaaattataaaacaaaagtaaataaacaattatttaaagtctctggaaattatctcaaaggcatactgcaggataagatacacctaaaaagagtcttcttggggtcacaacaacctcaaaatctgtttccaaaatctattcttgaaatagggcccaaatttaattggatcagacagtggaacaatttatgcccagagcatttttgaatatagttgtgaaattatcctgaaattagtggacgctaacagcctgctataatattaggtcggtgcaaaagtaattgtggattttttcctttaattaaattaacctttttttttttttttttgaaacggagtctggcactgccacccaggctggagtgtggtggcgtgatctcggcttactgcaacctctgcctcccgggttcaagccattctcctgccccagcctcctgggtagctgggactacaggcgcccgccaccatgcccagctaattttttgtaatttcggtagagccggggtttcaccgtgttagccaggatggtcaaaatctcctgacctcgcgatctgcccacctcagcctcccaaagttaaattaaccttttattaaaggttatgccactacctttaatggcaaaaactgcaattacctttgcacgaacctaatattagcaatgaaggaaagaaagagtcaaaagagttctattaaaaccattgataacccagggtgactgtacacaggctcaaggctgtgacttgtgaggagtgacaccagagactgtacatggcaggaaaagagactccagagaaataatctaaccaagtagctagagaaacagacacaaaacaacaaaatgccttgggataaaggggataaaaatgggcgtgcagagttgttacaatatattatctaaaatgttcaattttcaacaaaaaaattaggacacaaaaacaaacagaaactgtgtcccatacatatgaaataaaccaagttacagtaacttctagatgccagatttagcagaagacttcaaagcagctattatcaatatgttagaagaattagtgcaaatgatacacagagtaaagaagtgtaggatgacaatgtctcatcaggtaggcaatataggtaaatagagaaaattattttgaaaagaatcaaatgaaaattttggagttaaaaagcacaatcaataattgaaatgaaaaatacactacatgaattcatcagtaggtttgagctggcagaataaataatcagaaaatttgaatgtatgttgctagagattatgcaatctgaagaacagagaaaaagaaacaaagaaaatttaatagaactttagagaataaccaatgtatgaataatgagaatgctttgcacaaaatactttgatataagtgaaaatgaagtcacaacacacaaaagcttattaatgcatagaacttaagcactacatagagataaatttatagattatatgcctatatttaaagaacatttcaaatgagtaacctagtctttttcattaaaaaatgaaaaagcagcaaaataaacagaaaaaaggaataaaaaagatgagagaaaaaatatagtaacagtaatttactgtatatttaaatacaactgaaagagttattggaatgtttctaacacaaaaatgtcataaattcttgaggtgatgcatacaattaccctaatttgatcattatagagagcatgcctatgtgaaaacatcacctgtaccctataaatatatataactattatgtatccagagtcactaaaaataaattttaaaaaatgtaaagtagaagatatagaaaattggggaaaccaaaagttggttctctgaaatcattttctaaaatcgacaaacttttagctggaatgaccatttaaaagagtgaagattcaaattactaaaatcaagaatgaaagaaagatcttaataatgaccttacaaaattaaagagaatgataaattagtaccctggaaaactgtatacaaataaattcaataacttaaatgcaacgaattaactcttaaaaatgatataaactatagaaattgactcaaaaaacagaaaatctgaatagatatataagcagttaacagattgaattattattttgaaaacttccaacaaattaaagtccaggttttactatacctttcccttctggtgaattttaccaaacatgcaataaatagtcaatataatttttagcaaaatctttctaaaaacatggtaagatgaaacacttcccaacttacattatgaggcgagtgttaccctaatgccaaaaaccaggcaaaaacattaaaagaaaactacatccccctgtctctagaaatatagacacaaaactccttggttaaatactaatgaatctaaatcagcaacctattaaaaggaatatgcatcatgaacatgtttgatttatctcatgaatacaaggtagttttaacatctaaaaaccaaacaatgtaatatattgatacagtaataaagaaaatctgtgtaattatagtaatatggaagtaatataaaagaaaagcatatcacaaaagtcaatatcctttcatggtagaaacactaaataaattaaaaacaaaagtaaactttctcaatttgataaaaagtatccatgaaaaacctatagctaacataacttattgtgtaaaacagagtatctttcctgtaagatcaagaacaaaacaaggatctgtgctcttgccacttctatgcaacattattagaagttctagcaagggtaattaaggggaagaaaaaagaaatgaaagaaagaaatacaactgtctctatttagaaatcatatgatcttgtacatagaaaatcataaattcaccaacatttattaaaacttataaatgaattcagtaaattatatttctatatactataatgaacaatctgaaaatggaactaagaaaaacaattacaacaccaacaaaaggaatgtaagactgaaactgtaaataattggatggcaacacgtcccatattgatcaaaagattttatacaatctttattagattctagcttggttacttatacaattttgcagaaattgacaatgtgatttgaacattcatatgaaatgcaatggatccagaataaccaaaaaaatcccctaaaagaacaatgttagaggcctcacaatttcttacttcttgtatatatgtattacaaaactacataaaatacataatgtattacaaaactacaaaaatcaaaatggtgtaatattggcgtaatgatagacatagaggttaatggaatagacttgagattccataaataaacacctatatttatggtaaatctattttcaatttgtgcacaggcattttaatggagaaagaagtgtcttgtaaataagcagtgccaagacacatgtaacatgattaagtttgactccttccccacataacaaacataactcaaaatggatcataagcataaataaggcctaaaactacaaatattattcttagaagaaaacatagaaggaagtcttcatgatggtgtgttatgggaagacttcttagatatggccaataagcttgagtagcaatagaaaaaatggacaaattgaacttatcaaaataaaaatcttgtattcttcaaaagacaccattaagagaatcaaagggcagcctagaaaactggaaaaagtgttggcaaattatgtatctgatgatagacttgtatacagaatacatgaagagcttttacaactcaataataaaaagacaataatttaacttaaaatggacaaagagtctgaacaggctctcctccacaggaggtatgcaaatcaacaataaacacatgaaaaagatgatcaacatctttttacctgccagttgcaaatcaaaaccacacaattaaatggcatttcatatacactaggatgcctgtgatcaaaaagaaaggtaatagaaagtgttgatggggatatgaaaaaattggagccccgatgcaaggctggtgggattgtaaaatggtgcagccatctgtgaaaacactctggccgttcattaaagtgttaaactgtgaccacacaacctaggaattctactcctagggttatacccaagagaaatgataacataacatttatccacacaaaaacgtgtacaatattattcataatagccagagggtgaaaataacctaaatatccatcaactgataaagagataaacaaaatatggtacatctctataatggaagaatatttgagaataagaataagaaataagaataagaaaaagaaagaagaaagtaatgatacatgctgtataactgagatgagctttgaaaacattacgctattgaaataatccagttacaaaagagcacatatgttgtgattccatttatatataatgtccagaataggcaaatccatagagacagaaaataggttcgtggttgccagcatatggggtagagaagaatggggtgtgaatgcttgtgagtacttctctttggtatggtggcatgttctaaaattagatagctgtgatgtttgcacaactgtataaatactacaaaccaatgaattatggcatttaaattggtgaatattagggtgtataaattctatcccattaaagctgttaaaaaataatgtctgaaaggagaattcttaatgatttctcctcctgagctatcattatactgtactgtttccacgcctcccttacaacatgtcttcctttgcgggaacagaactggaacacactggaaacttatacatatctgacccatatttttggagctatgtaacatagatttgtaaatagaaagagactttccaaattacattattgtattgtaatagttttcagaataagaatgtaagaagataaaaaatattcagaaatggtaccacgttgtataataggtcaaggtgtgtgggagaaaaaagtaagagagttgtgaataagcaagttctacagggactaactgtacctccatttgtagcaggtccaccaccgggcactaacttggcaattttgcatattaagagtccattttacatattaggatttgatatatttcttaaatttggggaaaattttttatttcaaatgtacagaaatttgcacacttgatttgaagcaagttaacttttctattattagagacacttcatagttaactaaaccttggtgggtataagccttaagtgcatacagggagcctcagcaaccttgttacctggaaacaaactcccacacatctgcattgacaaatgggtggtgttggaagaaacttaaattgcctttcatgatagtgcctaccatcagcagaaagggggaattctaagcagcatgcttgtcctgattaaatgctttgccatcgctgtatgggtggaagtgggttttatttagtaatggacctcttgagaacaattatgttttatgtattgctttaagtattaatttataaaaatagttcaaaatataatgctgaaagcttattcttagtaaagtgctcacacatactaaaatcacctttattagaataacactagtgataattatattttgattttgcatttgttcactttcttggctagagattaaatacatatagatagaggaagttgaaagcaaagtattatttctgcagaaatgtgtaattaataaataccatttacatgttttaaatcttttttttgtggaaaaaacactagtcattgcatgcatgcttatatgtatacttaaaattatcatatctttaagaagttcaaggagaatgatacataagggttttattcacccaaaaggtgggaataagacttttctctgggcttatttttcccaccacatgcatgggagtactggcaggtgcaaagcccagagtgaggtcagggccaaagcgggaggggggcactttacaaggttctctaagtatgattctttgacactcactctatttatttctttattttcagtaatagcttttatttaaaaatttttcttcctctgttgtaaatttttctgaggttttttttttgtcgtcgttgttgttttattttcattttactctaagttctgggatacatgtgcagaaagtgcaggtttgttacgtaggtatacatgtgccatggtggtttgctgcacctatcaacccatcatctaggttttaaacctcacacacattaggtatttgtactaatgctctcctctccttccctcccacaccccgaaaggccaagtgtgtgtgatattcccctccctgtgtccatgtgttctcatttttcaactcccacttatgagtgagaacatatagtgtttggttttctgttcctgtgttagtatgccaagaatgatggcttccagcttcatccatgtccttgcaaaagacatgaactcattcttttttatggctgcataatattccatgtgtatatgtgccacattttctttatgcagtctatcattgatgggattttgggttggtcccaagtctttgttattgtgttctctgggatttatgttgaagagtggtgttgattattgaacgaatgaaacattagaaccattatattcctgttgaaaatacctttgaattcttaagcatgtaaacatatggggaaagttctcttcctctcaaatcctttctaccctctacctttaaccttctagtccctcaggatatccattatatagtctgtagtttattgaattttactacaagccttttcagtgtttttaaattgtgatgggtgtatatgtgtacatacaagtatatggatatacctataaaacttatttcctgtagtataatatgcttcgtcttagtataattgagacatgaaaaaataaattcttctttcctattatccacatgatattgggtataatattcaagattattatttttattcttctttttttttttttttttgagatggagtctcactctgtcacccaggctagagtgcaatggcccaatctcggctcactgcaacctctgcctcttggattcaagtgattctccagtctcagcttccatagtagctggggttacaggcacccgccaccatgcccggctatttttttttttttttgtatttttagtagagacggggtttcaccatgttggccaggctggtctcaaactcttgacctcaggtgatccacctgccttggcctcccaaagtgttgggattacaggagtgagccaccgtgcctggccaagatcattattcttataatggaactttataaagagctatgtgctgaattgtagtaacccaagaaatacggattcatggctaaaaaaaactgttaaatattatgtaatataatctcctcactttgactatagctactcattttttttttctctgaacctaagaaacatcctcatataatgagatgaaagatgacaatgttttatggaggaaaagtcaggaacttagtaagacactgaatgggctaaagggtacctcaaaggtagagaattaaagataatggctactttttcatttcatttagaatcatcccagatcttaaaatgtagtaaaggacactttattatttcaatgccctcatgggtcttataattaacagaatgtaagtgctaggaaaaaggtgtagtaattgcatagccaaatcacctcataatttaaataagaatgttgagtccaatggtaagatgatgtgaacttggccttttcttttaacatgtgagaatcgagagattgtgaaagactaatggaaatgaagataataatgaaataagagaagaagaaataatcagtgaacagaggtttcaaaaattctggagtgaataaaatcctgaactctggtgaagagttcaacattaagattggcaaggccactcaatggagtgtgaaacagaaaatgaaaaaaagaaaggacagttgcagctatatgaatatttgtgggagtttagattaatgttgatgttatttttaggtggctttttaaaagaaaaatacaaaataaggctatttgctgaaaataaatcaggtggccagaaggttatgtttgagaatagagaaattgttctgaattcttgtctactgagaactggagagagtattgacatagaaggattagtgggaagagctaagaacccagtggagtctggcatccacaagacaatggtagcactgatgtgtgcatttgtttaatttttctccaatagcattcagcagttcagggtttttgcagagctggcagagaattcggatttattcaggtgaggtcccctcacacacaaagtagcaggtcagtgtaaaagaatactgcagtgaaaatgttcaggatattgacagagtaggcattggaatctctgctcattagagagagaatgagaagtcagctctagaggagcacaccctctgcggtgtctgtgtgggtcaccctccatgccttatgctcaggcagggctcattgccttgtcaataaatcctcattttactctgtcacttacataccatttattcagctttgtattagctgatcgcaagatactcttatgccctaaagttttttctcatttgatgcctatgcatccatatctttaagcataaaaactgggtatgttttaatgaatctataacttcatgctgatagccagggagtagaactagaaggaaaaactgcaagtagaactctcaattttacagaaaaagatgaaaccttagaaattagttactgtaaactagaaaatatatgatatttacttttattattaaaattgaattttttggtttgtcttttttattgccattttagaaaactttcttcatccttccattttctcagatttatatataaagctaaataagatagaaggtttaactaataatactgcttgttttcttctgagatgatatgatttttgtaagagaggagaaaaggccaaatcaccaaataacttgcattacaattcttggaaataaggattgtaccactccttattattcaataagtgtatcaaggtaaaaaattaaagaagaaacagtaagaagctttttttttttacctccacaatgtttgttgaaacattctttaaagaaagagcacttcattctccatgtccttgccttctccttttccttcagttctaattttatccaaaagcctcatactgcatcttggagagaaatattttgtcaccataaagcttggaataaggacaagcttaaaatacagaatatactttctaataggacttcttaaaatactacacattaaaataaattttatttgaataaatgaccaattgccagtccaaatgtttatttacattatctagattgtctggcaattatctagatagatatgccaacacttttcactactttgtcccatcaaaagggttattgttctaatatctatcatttcacagaccttgaatttttaacatcccggaccttcatattaacaaggaactaagaaagtttcttgctttctgatataaattccaagatagaagctcataattacatagtttttagattgtggcaatcctggaataattataattgcatagccaaatcacttcataacttaaagaagaatcttgaggtccaatagtaagacgatttgaacttgttttatgctatttaatagacttattttatccaatgtctgtgtaatgagtggcacacctagaatataattagctttttaaaagggagccttctgtgagctacttacttactttgtcctttgagaatataaaatttaagctgtatttacctaaactaggcaactctgtgactccacgaagctgttctctgtctaaatgaacactgaggaatcagaattgtacacattttattgtgataattatatgcatacaattgtcttgggtctatccaaagctgcaccatccacttttgtatctcaccccattccctctggcctattcaagagcatcgctttccataaattctttcctttttctattatatctttagtccccatgccttcatagattattcccataagtatataaatatattgttattttttcaatcaaaaaagctaaaaattaattttctgtaattaccaccttatttctctgctcccttaactcagaggagtcatgtacttcctgtatctaaatccttccctcctttatttcactatgaattccttcaagtcctatttctcccacctggatcactgaaaatttttaaggttaccaccaagccttatgttgctaaaacaataaacactcatcttagtgagacctagtggattagcaatgagtatatttgtcacaactgatcattcccataccctagaaatattttatcacttgacttccagaaaaaacttgtgtcctggttttcctacaatctcacaagttactccttcttagactttttttctgttattgttgtttttttagcatcttgatcttgagatcttgtagtgtctcagtcattagaaatctattgtttcatctggtttcatgtctttagagattatgctaagaatacaatttcctagtcaaccaagacttctcacctgaagtctagacgcatatacagtcatcacttttcactaaataatgggaatactttctgagaaatgtgttgttaggcaattttgtcatgtgaacataatagaggatacttatacaaattgagatggtagagcctactgtacacctggtctatatggtatagcctattgctcttaggctacaaacccatacagcatgtttctgtccttggcaattgtaacagcatggtaagcatttgtgtatctacacatacataaacatacacatacataacataggtaaagtacagcaaaaatacagtatataagatcaataacggtatgcttatattgggaacttaccacaaatggaacttgcaggacttgccgtggctctggataagtgagtgagtgagtggtgactgaatgtgaaggcctatgactttacttactatacattgttgtagactttataaacactggacagccaggctagactaagtttataaaacatatttttctttcttcaataataaaccttagcctgctgtaacttttttactttataaacttaatttttttaactttttgactctgtaagaacaaagcttaacacacagacacattataaaactgtacaaaatattttttaatatctttactatactatatgttttattttatttttaatttttttctttactacttaagcattttgttaaaaattaagacacacacacacacacacacacacacacacacacacacagtatcctaggcctacataggttcaggatcatcaatgtcactgtcttctgcctccacatcttgtccccctggaaggtcttcagggacaataacaggcatggagctgtcatctcctgtgataatgatgccttcatctggatacttcctgaaggacctaactggggccattttttagttaactattttttgtatatgtagaagtaataatgatagataatgataaaaattgtagtatagtaaatatataaaccagtagcatagtcatttattatcattatccagtattatgtactggataactgtgtgtgcagacttctatagactggcaacacagtctataaaatggatttgttgacattcacttgtgtaatgcattgcttgacactgtgatggctaccatgtcaccaggcgaatggaagtgttcaactcctttataatcttacagaactgctttcatatatggtgtttctttaaccgaaccatcattgtgggatgcatgactgtacatgtagttcaacgtagatcctcagaggtctaaaaagaatatgaagttaagatatccaaacctaatacttgatttttcctctcaaacttttctacttttctttaacggtgcccagtttcacagttgctgaagtcaaaatttttcttctctttttctccctctacatttacatcattaagagtgtagcagctcattgtctcactgcctctctgctgcaatctcctctgagcagcctgggtgagtacggtcttctgcctggaagcagagtgtttcctcatctgtcattattcactctcctccagtctattcttgacacaacagccacagtgatcttgttataataaagtcaattcaagtctgattagtatctctcagtgacttacatctcactctccatggcctatgatgagtctgaccattcgtccctattctttttgaacattctctaggcctacatgggcctctttatacagtgctttgcacctgcgattccatgtgccagaacactcttcccccaatgtctgcatggctctccccatttcttcctggggcttagctctgatgtcaccttcactgccagggctttttgcccgtttcctgaatccagggctcggctctcccaccgagccagtgcttcctgtttccaccttctgctttattttcctctgtggtacttgatattggctggtataataattacactgaatatttcacctaacttcatttgcctctgtccactagaatggaacctctttttaggaacttgaatgattttttgtcccctctattttgtttcctgttgtattcccagggcctcgatcagttcctggcttaatacatattgttgaattgaataattgtatctggtattgacttgcaatccttcttcactacaagagaaataaatcattagtttggtaaggccaagagaaagtctgttcattcatttaacttttgtttttcatttagtgctgaccatgatgactggcaccgtgccacactggtccagatgtcatcttttcatactgcaagttcctgccatatgatctgcttctgtttttcctgcttgtcattgtgttgaaatgattgattgcttacttccgggcttttaatatccatagcaaagacatttccatctctttctgactgacattattccagttcagattttaagcagaagtatcatctagtatatttctaaaaatctatcaagctctattcctccgagttttaaaatcacagaatgctagaagtgcctgtgtgtattttgcaaactgctgctcctccgagttgttctggaatgggtcttatttttttatgttgtgctttagttatgtttttctccttctctactcccctttcagattctttgtacaatgtaaagggtgtttaaagacttacatttttgtgaaaagaattaaacttcagtgcataacctgacttaagaaaagcttgcctgtagtgcaaatatcacagactctgtgctacttctcataagcaatataaaatagtctccttggctgcaataattgaagcttttacgctctcgtgcccctaaatgtcacataaatgtataagaaatgtatctgtgctttacaaatgtagtcaaaaataactgctccctgctagttacttaatgtacttccttttattcttgctagagtcctatagatctggacaagaggttatccttcctgtcagtagcagacaaatttgtttattttaggagaacaagtgaaactgtttcaccatatctgaactcttggccctctgaaaacatcagagcacatttgccaagagatagagttgtcaaagcctttcttttgccttcaattttctttccagaaacttatgttaaagataaacaaagcaggacaatagttgacatggtaaggacagattttaatcagtcatacgccactgcattagggaaaagagtccagggtgagctgagctcaactgtgacttgtgcagaaatgactgtgtgttacacaagaagaacaagtgagtggggagtgggtgtgcaggggcttagtattcagagaaatggaaaattacagaaagtagaaatgagggttcggtctgtgtgaaacctatctgggttttttaattggtgcttattgaagttggattcccaccctcccacagagactgagagatgaggatcctgtcttcaggtgtcggctgaaacaaacagtaaactctttgggcagccttgagttttctcaggacagcacttttagggggcttatggtgagcctaggaaggtggccttgaactgctagaaactatattagtgtttactgaagtctttataggacaagagtgaggccttgtcaaaagagggcccagaggagcctggctagagttcagtcaaggagagaacactcatcatctattgtcttacatacctctggctcattggaactgtggaggcaccaacaactttcagagtttcgtggattttcaactcctctgtatacatcagactgtatattgttgtgaaattaaagcattaagttatcttgcagttctaaacttctgtgaattggttactgcttggtgaagtgcaccaataacttccctctgagaatcaggaagtagcactctgctaaagtgtgccatgtcatacccagagacctcatagcttgttcaaggttaaacagcgagtttgcagcaaaacttatggtttgtagagtaattccacaaatatcagtgtatttgatttatacaaccttcttaggaagaagacagggaactgagctatgttttgtagataagaacaataagcttagagaaagaaagtgcttgtggaaggtgacccagacagtaaagctgacgaatcaggctgggaaggaggttttggggcttgtagactaccgctgtttctgagcggcacttcacctaatcaggtttgtcatgcacttagcaccaccaacactagacatatttcataatatttaaaagtcttattactgaatctctagaaactatgaagaaacaaaggtaaattgaaatgatgagaataagatgttgcaggaaggtaatatatcacaaagtgggtatttttttaaaaggcccaactccaaatgttttcctccttcttcagatacaggacctcgtgcttttgtttagccatcggcatagtccactgtatttttttctttctgattttccttaatccatgttgtcttcccaagtaccttgtgatcttctagaagataagagtggtatctcttattcatatgtatgtagaaaaaaagatttcaaaaactcaatattgcctgtttttctgtgagttggtttatatattttcagtaataaaagtgcaatattttataatatgaacagtcatttaaggtcaacaataaaaacaataagcacaattttaatattttattacttttttctttattttagaaagaaatataaaactatattgggtggattacttgatttttctgtttgtttccagtgagttttgctcaggtttcaattcttaaatttatttaagagattacacataacacctcctccaaatcaggttgatatgaatgttgcataataacagaataaaagttaccctatgatgatatgacccagcaattttgttacaaatatatacccaagaaaaataaaaacatatgcccatacaaaaacgtggaaaaatgtgaatagcaacagaatttgtaatagccaaaaaacagaacaaacaaatgtccatccacagatacagggataaacaaacagtggtatttccatacagtggaatattatacagctgtgagaagggaaaggtactgatacatgctacaacatagaaatgaactctgacaacattatgctaagtgaaagaagcaagtcacaaagtcccacatattatatgattccacttatatgaagtgtgaagaataggcaaatctatagagacagaatgtagattagtggttgtgaggagcttaagagataataggcagtcatatctactgggcacaagcatttcttttggggtgataaaaatgttctggaattagattgtggcaatcattgtacaacttatgactgtattaaaaaccactgagttgtacacttaaaaggtgaagctgatgatataaaaattgtctcactataactgttataaaaatataatggcattttatatttgttcaaagtaaagggcaaggaagatatttattcttatcacttaaaataaaaatgaaatttgtaactgtcagtgctttttttgccaaacaattacagtggtcttatgtgaaaaacagatgctttagaaaaatcttcacggaaactggcaacaatgatcacttttaattaaattcttgaactgaaaacattctactttatttaatttaaaagataaatttaaatttaagaatagaaggcaatgcattttaaatgttgatgtaattatggaattttttgtcttactttaattaaaaagcaagattacagtgcgaaatttactttttccctgaagaaccttttagaaggaaactctatttagaagatagacattttttctgttgtaattacttggtatttactttttgttctctcaagaggatctgctctcgtatatattaaaataatgtgttaatgcctctagggggaataaaaatgatttggtcattttctttctggaaaacacccaaatgaaaactgtttgctcacttggcatgatcagttagaattaagtaacttccaggtgtctctctcctgttttctggagtctgttactggcccaaaacaatctgggggaagtgaatttcattgtagctgacctaggtttattattctagttaaaagaatttgccaatgatccaaagttttgttagggcttttactcctgttttgatcgtcaggacttgcaaagggtgcagagtatggcagtatgagtagcatgtatatacggggatcaggaaaagctaataccctgaggccatcatctagtgtccttgtgcctgagttatatgaacctaccattaatgatttttgtaaggagtcagtatgaaaacgtacacaaacctttagcataactacctcacatagttgtaataatgaaaataaaactacttaaattccatcctctcttccggcccagggatgtttaacatacattattccaactcacttcacataaattgaggatcactgagttttaaaatatgtttattcctagttaatttggaaaacatgatcactttaagcttttataacaaaagctggtggtttcccaaatctaagtaggagagagaggacaatggtaagtcctagttgctgggaattaaatattttccagaatctagaggatcctcacttactgcaactctgcacccagcgttgtgcttgctcactccaaacctcattctcctcttagtaactccccaacacgtcctttgccattttacttttggtaaggctgactccatcttctcatctttttctccatagaaaaagaaaaattgcttcagtagcactccacccactgacaatatttgctattgtagtgattggcacgtgaaccaatgtggtccaacaatttctatgcggagatttctggagcctttagagaaagaagtaaacttcctttgtctcctgaaataacttccagaagaaatcttctaccctttgagagagaagaagcaccaggtagccctatggctacttagaactaaaagggcaaccagcattagaatgaacccgacacacaaaccaaaccaaaagcacacaaaccaaagcagagaaaatgaacaaagttggtgtttgtaagattattgcactgctgaattaaactgcgcatgaaacctccctgactgttgatttccattagttaaaccaataaatggccttttccgcgagccagatacattttatttttgttgtttctataaatataataaaataccagaaaaagtcatgtatgtttttgtattatttctgttactaatatttataaaaagatacagactaataaagatctaaaatctatttcttgatactgtaaatgataatttacataaatttacataaaagcatacctaaagaagaaaaatatacattctaaactagaaaacaaggaaaacagagcataacagacatatcatcaagagtgttatacaaataaaaactattattttatttttcaaaatgcaggaattttttaaggtaataaatataaattatctttacagaaagattatttacctttaattgaacatatacatcttaaataaacccaaaaatttccttttatgtttctcatattgtaaaaaggaacagtggagattatttcaatacaatgacatagtctacaggtattactgcaaaaaaaaaataattgatcatttagttgcgtatttcaatatggtatatatttgttaaatagaatttaaatagaattttattgaaaataaactaaaaatatgcaataagggttactatatacatacaaatacataattacatttaccttattgcattattttgaagtacaatgaaaatgttgatttacatatacagatccttagttcaggtagtgtaggatgaatagttgaaattcagatataaaaccctccatgtgataaaattagatttgctgatgtgaatattgcctattttgtgactgtaaaaggtcccctaggctatactattttttttcagtatttttctctctactgtttccaatgggtcagttctgtggacctgtcatctagctcaccgtctctgtcatctcagctccaaaactgagcccatgtagcttgctgtatttatttctgttactttacttttcatttccattacttgcacttttttttttttttttttttttttttttgagatggagtctcgctctgttgccaagctggagtgcagtggccatctgggctcactgcaacctccgactcctgggttcaagcgattctcctgcctcagcctccaaagtagctgggattacaggtgcatgccaccatgcccagctaatttttgtattttcagtaatgacggggtttcatcgtgttggccaggatggtctcaatctcctgaccttgtgatccaccggcctcagcctcccaaagtgctgggattacaggcgtgagccaccgtgcccggcctagtagcactttttgataacttctattcctttgttaaaattttctatattttcatttgtttccagagaatttgaaattgctgttgaaacttttttttatgatgactgctttaaaattcttgtcagataattgtaatttgtgatttgtttaattattggtgttctgtgattgtcttttatctttcaagttgtgatcttcctagttctcagtataacacatactttttaattgtgttctgccttttggcttattatgtttcaaggctgggtactatttaagattttttttaaaagagggcatttaccttgtttggatttagcacataggtcctggcctagttttagagactgattgtctggctctattagctgtctcacttttgagcctgtgaggtgctatttattctgaatggtttatcttgtgccaatggggcttcctctggtccctactgatgctgctttgggtgagcagacgaaactatgcaggccaggttgctggtgccactaattaggaaagggatcctttctcacaaggtgactaagaacatttccagcctcgtgcttgtcaagctacgtctgccagttgaaaaagtggaatgatgaggagaacctctcaggctgctcatgggctcaaggtcacctttgcaggtgtttcccacagtgtgatatccctgcctagggtaggggagtcttaggccctaggggactaagtggcttcccaggttgagcattttgtttgtagcagttgcccctgctgctgtctctggtaaatggaatcactcagtgggaggaggagtcccaggacagggaaggagagcaccacttattgccacagggcttctgatcagtcccctctactggtttgcctcaacttgcttggtatggtgggactctatttccacacacatgtggtatgagactagctgatcttccctctttgaggctgcgggtcaggaaatgttaggcttggatgtccttccactgttgcatgggataatatgacatcctacttctgggctgctcctccagttctggcccctacctggcctgctttctctttgaacatttcagaactctccttgggtcgtctttcatttttctccaacatgtctatagttgagcttgtggggaggaggagggagagatagttttcaccatattgtctggactggaaatctctttcattttaaaacgtaggcatttttcttacccttcagtgatatttcattaactggaggggaaaataaagattagcaagatttagggattcaatgtgctgagagttgattagacaaattttaaaggtcagaaaggtaaaaaccatataatgtagttgtatgcgttggtttcagatatgctacatggcaggtcatgagtgattcctgaatgataagagattccataggatttcagagaagagtcacagtgagctaagagggtggggagatttctttgaagagagttgcagctttcttgggaatgaatttagaggaaagagaatgtgttagtcaattttcacaccgctataaagaactacttgagattgggtaatttatttaaaaaaaaggtttaattgactcacaattcctcatggctagagagacctcaggaaacttacaatcatggtgggaggcaaaggagaagtaagcacctacttcacaaggtggcaggagagagagatagcaaagggggaactgcaacacacttttaaaaccatcagattttgaactcactatcatgagagcggcatgggggatactgcccccatgatccaatcaccccctcaccgggtccctccctcaacacatggtaattacaattcaagatgagatttgagtggggacacagagccaaatcatatcagagaatttaaaagaatttatggaaaaaaacccacatgtttctatgtaggaagcaatacttagttattaagagctctagagtgacaaattttggacaggaatattcactctttccggtagctgacatcacaaacattatcagaccctctgtactgcacttttcttgtatgaaaatgagccagtattagtacctgcctcaaagggctgtttccaggactaaatgagctaatatgtacacatttcttagtgcagtgtctggataagcacctgattattgttgttctattattaaacacatcctgtggaaattattgctcttcttagaaattgggtctagtcttccttattatgtaaagtttattacggagatttttttaatcattaggaatgtgatatgtgggcacatggatggatagatggatggatggatcaatggacaagtggatgaatgaatgaacggatgatagatgtatgatggatagacaaatggatggataggaaactgggtggataagaaacaaagaaaaattccatcaacctgatagtggataataccagataatgttatgctgatttaatccttcctacagcttgtctcagttaatcaaattatatgtcagccacctgttttgtcatattgctgatttattagaacaagtaaattagattcctcataagatttttaaatgattatattaagatttgtatagatgcattacttaaatgcatgctatatctagcttgttcatagttgcaaaatcaaatcaatatattaaagaggcatcttgacatttttgcccaacatgtaagtagctatcttgagtaattttcaagtaattttagttttcattcttcaatcccacagtttgcctcttatagggaatcaatatcccagtcagtgctttatttatttatttatgagaagttaatttattttttattgaattttggattcccatgcttatttgtaaggataatatctataactatttcagactttgctaaagtaccagattgtcatttctggagtcctctgcatccttattctatatggcctgcatgctatttgactggggactgatttttatatagcatgttgatctcacttagattgtataatttaattttagttgtcatgcttttgtcaactttaatttaaattttggatatttgtggagtttaatgttcttattgtgcatgatatagggattgttatataagtactactcttacgggaattatttgggtagactggactaccttttctctgggtctaaagggcatggaaatgtaatttggtctatgtttttcacctttcgtgtaaatgtatcctaaaggaagtttgtctatcatctaagcattaggctaagcatttttgcatgggggttttgtggtgccgtttagtttcatacattctagggtctgagaacaagttcttgtcatagccattgtttctatatttgtctgtagcaaattatctgaaacctttttcattgttgccaatcttccaaaatcaagaggttcttttgcggtattataaagaaaaatgttgcaaagtgtcaagtattatttagtcaaataatagtatgtacaaggctgcctgtggtggctcacgcctataatccaagcactgtggaaggccgaggtgggtggatcatctgagatcaggagtttgagaccagcctgggaaacatggcaaaaccccatctctactaaaaatacagaaaattctctgggcacggtgatgcatgcctgtagccccagctactcaggaggctgacgcagaattccttgaaaccaggaggtggaggttttagtaagccgagatcgtgccattgcactctagcttgggtgacagagtgagactctgtctaaaaaaacccaattatttatttcttgattctcctttttgtttttcctttttatcaagtctcaagtcttcttaattaactttactttcttaatgattttcttgtaatcagtttgttttaaaagaaagccactaacatgtatacaattaaggattttgctcttagtagtctcctctaatactagtttgggattgtgtccactcaatatcaacatctaataataattgtgttcaattataccaggcagtattcaaggtgtattactcagagtaactcacttaatcctcacaaactccaatgagacctttccttgtctcattttacagatttggaaactgaagcacagagagcttcaggaacttgcctataattacacagttaggaaggagtgctctttgacaatttaataattttaacaatgagatgcaattaattcttgtcatagccatttttcattcactaatgtttagaatgaattaatcaaatgtctgacttcataaaacaaaatctgaatgtatgataggattactaacacatatggatgaaaaaaaatcatataccctaaagaatcaccagtatagtcattttctaaagaatgacaaattcactaggtgcacctgacaaataccaatgcagttatcttaaattttgataaactctcttaaatggtagattaaaaaaaaattcttactaaaaacatccccgtaggtatactcagaatatttaagaggaattctgatgtttctgaactgggtgactatttacctgacatatccaaggacacaggcctctctttttttttttttttttttttttggtgaggtggagggggaagaggaggaagttagttactgttgtttcagattcctttgtttacttcaacaaatagagttgtgttattttctctatattttacgtcttcatatcatcacaccattgctcattcattttaatggtagtgaaataatttccctaaattgaaaatatatataccacttgacttactgtgaatgaataaaatgagactgatttaaatgatttatttcatatatctgggttttccattaaatgcaagactacatatatgcttgtgacttcacatggccctgctttgaaatgacacaagctctgtaataaatattgaggatgacagaatccatctcctcatctcattgagaaatcttttaaagaactagaacatgacaaacattattctgaatttcagctctgactcttactagcttctaaccttaaagaagttaggaaatgtacctgaaatctctattagcaaataaaattttaaaataccccgttaaagattcttgaaggatgaaaataatgtttgtaagagctagacacttagtgcatgatacttattgttagcccaatgcagggaggtgccatgaactcttccatatttttaagcacaaatatttttaacttttatcaagatgtgtgacaactcagaatttgagggagtttgatgaagttatttatcattacatggtgtttttaacctcttaagtatttctttattactagctaaatattaaattgatgggttgcaatccagtgctgccaaattctaataatttttatacgtgattccaggtcactatcccaaggtgaaattaaaaaaaaaaaaagatcttttgagccttcctggttccttctgtttcctttggggattatggaattatttcaattttattcaaagattatcactgttttaatgtcaatggggaggaatatattttgttaaaccatcctttatttctcatagtgaacactggacacgttggtgggagttgttctgtgctgagagcatagcaatgaatacagagacagcagacctgccttcacaggttgtatgttctgatgcaagtggcaacaacttgaatgtcaatgaactttagtgctttctttgatgggcaaagggcagagctataaatgctatcacctttttttcctttatatttggaaacatcccatggcccacaaaacattcctcaagtttgtctttgggtagagtgaattcagctttttgcacatttagaagccacattaaatatgtctgtggcaaaaagtttggtgaagttggcaagagatgagtaattattttcacacacatgttaatttcaattttaaaaagtgttttatttctttaaatttaaaaaaaatgagcacttacaccacatgagcacattggctttttttgtggacgttgcctgcatcttctttcctgtttttctatcttcatgaagtcaagtgcaactgaggtggtttattttactacttgcatgtcaatggaatgtggatatcggggctgttgtatgttctggatggaaatgtggtcctgctgcaatacaataaatctcatcattaccctatgtgaccacaaaaagggtgaaccagaaaaatgctaggaagtatggagtcttcataatactaatcacttacatttgtacaaacttaaaaatttcagaggttagatattggctgtaatttccaaaggctctgaggttaggaattcaggtttttaaattcactggagagttaggccttgttttaaaatgtagttttattattcagatgtagtgaggctgacagatcaggagattactgccattgaaaagacagtttgttactcacagttccctagaagaggtgcctgctatgccatgggggtcacatgggggagcacttgggtgagtctggagacagagacaaaaggggagctgtgggcaagagtctttattgtggtttgtctgtgaaggaatgggtgaggcaaagtaaatgggtttaggatggactagattgagtaatttcattgggttttgagacagcagctgcagctgtccctacttgtctggtacctcatcctggggtaactagggaaagtaaatggtgtcccagagcataaaagcccagtaaggaatatggttggaatgtgggctctggatttgttggtttgcaaatggaaggctgcacactcacagctgaatcctacttctaagagttggtgaaaactagaaagagaagggaagtccctactgtgttagcaaagccctggatatgaaagcattagaataaaaggacacatttaacacaggcccaggcactttattcaataaatatttgttaaatgaatcaataaataacggatttgcaaatctttatactgtagtcttgctagtgtttaatcttcatagaaacagtactattctttgagtgacagagtgataaaaagtttattaaatgtgtagaagactgcaaagattaagaaggatatcttaaaaaatagcaactggcaaaatagcacctcgtcatagacttttatttgcatttgaatttctgaaattcaattctctgtgaaagatttgcttgacaactttctttaattattgattcctcctttattttgtaaaactttcttttcattaaatctataacctccagaatggggatagagagatagatagatagatagatagatagatagatagatagatagagatatatatgtatgtgcacatatatacatatatatatacatatatatggctctctgtgacagtaactatctggaaaagtaggaaaaagtactgtgtttaaaattttttaaactaacacataataattttacatatctgtgggatacatagtgatgtggtgatgcatataattacggtaatgagatcagaataattagcatgttgtgcttttttaaaatggcaattttatataattgtataaaacttcacatatatttaacatttttcctgggggaaataataaaggaatatataagcataatcatgggctcagggattttataaatacccatgttaagggaggacttggaacctgaaaagtttacattggagaaaacattgcagaatggcagagtgaagatcttggttaactcagttttcctctaactcaatgttaatgtgaaacatcaaaaatacaacaagacaactaaataacccatttttgatctcagaaaaataaccaaagccacagaatgtactgaggagaacctattcaaaagaaagtactaaactacagtatgacagcaggcccggtgatgttttaagttggtgctatccccatcctttccaccacacacagcagctcagtggcacagtagccaaaggctaagagcattgcagacagcagacagatgtgaccatttttggagcttcactaaaaatactatccccagagcacagtcaatattttgtccaaatctgtagctccctgtgaaatctctgagtgtgttagctatttgatttgacccacagctcaactcaggcaggacaaatacaaaatgtgcaccccacattattacagaaacaatagaaaactgctgataacattttagtcacctagggctgtgattttagttgggaaaacggagcctggctgagaatttaaaaggaaattctaagatctacacaatgataaggactaccaaaaagctctgaaatactcttgggtatctaaactgatgcaaagccatgtgcatgactaagaaagatcttagaagaagccaccagctactcactgaccttacggtcctccctaagcaggaagtgaaggctagtctgtcttgtaatacgctgcctgaagttggaagacatggactcacatacagatccccacggcaaaggatagaggatctataggcaagcaatgtagggaaaacttctaaacaatagttatacactaaattataatgtttaaggtgtgactcctaggaaagcagactttaaaatagtaaaaagaactttaaaaaaatgtcagaagagatctcagtggccacacacagcaggaaatacgtaatctatagaattattccagtaaagcttctaaacaaataaggaatataaaagaaaaaacagctacaagacacgttaaggggaaaggtatggaagaaattatattatctaaattgtccagttttcaacaaaaactcatgagcatgcaaagaagtagaaaagtataccacatgcacagaaaaaaaaaaagccaacaaaaaatgtcctacagaagcccagattttgaatttagtaggggaacaatttaagtcagtgaacctacatgcatacaaaactgagggaaaccatgttgaaataattaaagcaaaatataaaaacaatgtctcacacaacagagaatatcaagaaagagatcaaaataataattttggaaagatcacagaaattttggtgatgtaaagcaaaatatttggaataagaaatccaccagaggatttaaacaacagatttgaataggaggaagagagaatcaggtaacttgatgataggtcaatagagattatgtagtttcagaaagagagtggaaaaacaatgaagaaacatgaacaaagcctcagagaaaagtgagacactatcaagcataataggtgtatacagacattcacagaaggagaagagaaagagaaacagacaaattatttgaggaaataatggctaacaattttccaaatttgtgtaaaaaaatgttaatgtacacattcaagatactcaacaatctccaagtagaataagctcaaagagatccagccctagacacatcaaaagtgacttacgcacaagggagccttaatatcagtttagtgcaaaagtaattgtggtttcagatggtgaattttaaattactataactaggctcaaacacatctttattaatcaaaataggaaccattacaatcaacacattgttgccaatgacaagtcagtttgtttattcctgtagcataaaaatctgtgctttggaatttgatgaactcttggaaaacattctctgcaaaaaaatggttgggctgcttgaagaagttgtagtcggttggcaagaggtcaggtgaatatggcagatgaagcaaaacttcatagcctaattcattcaacttttgaagcattggttgtgcgacatgcagttgggtgttgttgtggagaagaattgggccctttctgttgatgaatgtcagctgcaggccttgcagttttcagtgcatcacattgatttgctgggcatactactcagatgtaatggtttcacagggattcagaaagctgtagtggatcagaccgtcagcagactaccaaacagtgaccatgatcttcttttcgtgcaagtttggccttggggagtgctttgaagcttcttctcaatgcaaccactgagctggtagtcaccagttttcatataaaatccacttttcatcacatgtcacaatctgatagagaaatggtttgttgttgttgcatagaataagacaagatgccatttcaaaatgatattttttaaaatttttcactcagctcatgaggcacccacttatcaagctttttcacctttccaatttgcttcaaatgccaaaggaccatagagtggtcaacgttgagttccttggcaacttcttgtatagttgtaaggggacaacttagatgattgctctcatttagtcattgtcaacttctgatggccagccactatgttcatcaccttcaaggctcttgtctcctttgcaaagcttcttgaaccaccactgcactgtatgttcattagcagtttctcagccaaatgcattgttgatgatgcaagttgtctctcctgatttataacccattttgaacttgaataagaaaattgcttgaatttgctttttgtctaacataatttctgtagtctaaaataaacataaaataaacagaaagtaataagtcattagcaaaataacataaagtgagaaatgtccattaaaatgatgtataacaaaccacatttatttaagaatgtattccaatatcaaacagcaaattccaccaatacaaaaaaaatgcaatgagtttgcaccaactaataagactaacaactgacttcacgtcagaaaccaaggaagctggaaagcagtgagatgacatagttaaagttgtggcagaaaagggctgtcaactgagaactccatctacctcaactcatattcaacaacaaaaagaaaattaaacattccagaaaacaaaaactgagagactaatacaattaatattaaagtgaatctttcaaactgaaatgcaaggacagtatatggtttctcaaatacaaactaagaaataaagaacaccaggaaatgttactacattgtccttaggtcaatatctttctgtttgttactcatttcttgttctatctcttttaaatacaattgtataagcaataattataaaattatttgatagcttaacaaaaaatatagaaagagaaaaagggaattttaaaactatgttagaaaataatctatttaacaatcacaaaagacaggaatggatgaataaagaaatttttaaaaataaggcacatagaaaacaaatagcaaataacagatgcaaatcctacttcatctgtaaataaactaaattgaataattaaacatcccaaattgaaggtggatattgaaagaatggataaaaaataaatatgatccaataatatgctgtttacaaggacacatttttcatggaaagacacaaataagttgaaaataaacaaatggaaaagatatacaaggcaagattgaatcaagatggagatggaatagcaatatcaggcaacatagactttaagataaaatgttataagagtcaaaaaaagcatacgttataatgatgagtcaaaaaatggaagatatatgattataaacatatatgcacctacaaataaggcctcaaatttaatgaagcaaaaactgacagaattaaagacagagagaaagacagagagaactaaacaatttatttgacgattcaatacccactttcaataatggataaaacatctacgcagaagataaaaaagaaaacagaagacttgaacaacactatgaaaaaaggtctagcagatatctaaataactcagcacttaatcacagcagaatgtagcattttctcaagtgcacatggaacaataaaaaatacaaaaatttgaaagaaattaaatgatttctaaataaatagacagaaaatccatgtccatcaatcataagacttaacattactaagctggcaatataccttgcattaatctacagatcctacataatccctgtaaaaatcctagcaagtgttttgcataaatttttatgatgcttataaaatttgtatggaaagataatgattcagaatagtaaaaacaagcttgaggaagaatatttatggaggtctcacctttcccaatgtcaaaacctattttaagcttcagtaataaagacactgaggtattggcatatggatagaagtatagatcacttcagaagtaagactttacatttacactcaactaatttatgacaacagtgccaagatcattcaatggagagggaaaattcttgttaacaaatgttcctgggacaactggatatgcaaagaatgagttttgacctctacctcacaccttactcaaaaatccacacaaaatggactgtagacatgaatgtaagatctaaagtaataaaactagaaaaagacataagagtaaacgttcttgactatgtgttaggcaatgtttttgctgttgttgtttcgctttttacttatgatatcaaaagcaaaaaagatagataaaatggacattatcaaattaaaaacttgtgtatcaaagagcaccaagaaagtgagaaaacaatgcatagaacataagaatatgttaatacatcatatatatggatctagataaattagataaatgcaaattaaagccacagttttgcttcacactcactaagatggttataaacaaagaaacaaaaaataacaagtgttggccaagatgtggagacattggatcctttgtacattgctgctgaaaactggtgcaagccactgtgaaaacaatttggcagttcctcaaaaaattaaacatagaattgttatatgatccagcaaatctactcctaggtatatacccaagggaaataaaataatatcctagcaaaaatagagatagaaagtagactagaagttgacaaagctgggtctggggaagggtcaaggaaaagaagagaagatgaatgattgctaatacgtgtgggaattattttgtaattgatgagaaaggtcccaaaattctattacaataaaggctgaacaacactgtaaatatactaagatggaagtgaatattttaaatggatggattttatagtatgtgaaatgtgtctcagtaaagctgcagaaaaattttcattgtctttctgatagatttgaagaaaatgatgtaagttcttttacttggtaagacgttcagtcttgagagtggttttcagggacagacttataaacagaaaatacaaacgagtgtgcataggttcctgcaatgtattaaattaccttaagatggataaagaacagtgtattagttgagtgaaatccaaagaagctctttttacacttcccccttgttcttaataaagtctcttagtttatcttgctttctgtatctatctatgaaaaatttatctgaactattaatgcatctgttcatcatacactcatgtgcccattcattcatgtatccatgcatgggttctttcaattcactttaagaacctcttaattcaaagaaagagacctgataaaactgattcatacattctgtgaaaacataaacaaaatcaaataaccccccaaagacacaaggaaatgttaagagtagagagtaatatgataatgaggaaatgactgtaggcatatgagattgaaatacaattgtacaaactagtgtttgcatagctgttgtctatgctgaggtcctgctgggtgtgaaacatcataagcagtgctatcatgcatgtcaagagacataagagtgtcctctaaacagaggtgttattttatcccacttgtcaaactgagaggctgtgaaaatattgtaatctttccaaagttattaagacactaaaacagatggcaatttgacagcagaatccatgaccacttctattgttaacctttagaaaaaaaatcaggaactaattgagccttttgtgccactatactctatcttcagcatgggattccccatttacattgtgtattaaacagcacctggaatggttatttcttactgagcattgacaaatctggaatcctaaaggaaaatgttttgctttgatgtaaagctcttcccctcctcctcttttatcttgtattacttgttttttcatttaattagagaagataacgcttccctcagtacagagtgaataataagcctttactttcttgggattggttttgacatatttacacaaggtcttagatgggagacacagacaaggcttcctacacagctgccaggctgctattcatctctctttaaaatcattggttttaatgcaagcacagccaagccaagtttattaattacctttgtgaatagtaaactttatatgtacaatgcaatcatttaggagataataaagtttcaattgcattctctttgaaatatattttatctgtaaaatattttcttcttataataatgattgtctaattcatttaggcacatcattaatctgcatggattttattgttgtttgattggttttgatacacacacatctttttacaaaggggctatttattggagagcagatggtgaaaatgcatagactacacccctgcatagattgatgatttgtaatctgagaagctatgatagggaggagagtgaaaatgcttttattctcaggttataaatggacgatccaatgcaccttggattttttactttatgtaggacaaaaaggcattatttacttatgtagttgatatgcccatggattctaagaaatctgatgggaaaatgaaaaactccattataaatggattcttcatcctaatctaacattttagatatgggcaatctagagtttctcaaattgcaatctacaggcctgctacctcagaatccttttagccattgatatgactaggggctactcttaatctactgtgatgaatatctttggttgggcagaggaggtggcatttgaaccacagttccaggtattgcttttgcccacaaaagcctgagtactcctaaggtttttctgtgggtgttcaccagagctaatcccactcaataaaactggctctggcaaatttccatgattccagagttgattttcaaatgaaagagctataagttatatctataatcttccaacatgacttcctcaattgtatctacattgtcattgtttctcaccacctttatttgaatcctgtcaattttactcttgtttgttttgctgtctgttgtcacagctggtacagattctagtttatcctttccagatttgaaacttctcttactttctcccactaataccatatatatggtcaatggctcatttcctcaaatccttgttagattataatatttaatttgatgaattcatttctcccatgagttaattaagctaatgaaattttctgtatgtattaactaacatgagaactctgggaactctagtgggtctggagggtcaatcctgtatcatggtgctgatcagttatgtggtttcatgatcacaaataacccttatcaagcatcttctgctggacactgtatgtggggcatggtgccccaagcccaaaatcccagcatgttgggagcccaaagtgggaggatcacttgatccccaagagtttgagaccagcctgggcaacacagggaatccccatctctacagaaaatatcttataaaaattagccaggcatggtggcttgtgcttgtagccccagctaattgcaatactgaggcaggaggcttgcttgagcctgggagattgaggctgctgtgagccaggatcacaccactgcactccagcctgggtgacacagtgagaccctctcaaaaaaaaaataaaaataaaaataaaaataaaaagaagaagaagaagaaaaagaaggaaaaatgcatagttatttctttaaagacatttcattctaaatagcaacacagtaattcaaaaattcagcatacacctaagaatacatcataatgtaaagaacacattggtatagcaagtatatgagaccaagctccatcactttcttgttgtgtcatttttaacaagacatagaatgaatgggattcagaaatgggggaaataacatccctgtgatggagacaataacaatgtctcgagactgctctgtagataaatgagataataatgcctataaatgctgtaatagatatttgtgcaaaatgctttgtgttatgggggtaaaatgatcactgatgccttgagatggagtggagaaggatccagcaaggcttgagaaggcagctagactggagtccgatgctgccagtgaagtaatgtcaacacactagtaggacagatgatggaaagcaagtgctatctaatcctgggattccagggaaagtagaagaggcagattattaaaccaatgagagcttcagatcctccctagcactgataaatttccttgaaggagacctgaaccttggtcaatgtcttaaatttgtaataaattaaattggatgaaagtggatttaattaagtggaatacagtggtagcctagcagtttgtttgttttgttctttcgttcatctgcctgctcaggactgcttactgtctgtgttttcaggaggcactgagctgccagagcatacatggattaggaaatagtgtccatgttgcctctgttcccactgggctcaaacccaaaatgcacagttcttggttaagtgaagggttgagggtgtggaccttgactttttatttaatctcatacagtacacatgttggtttggggcaaagaagtttctggttctccatgttaggagagtgtttcaaaattatcctaataggagttaaatagacaattagagttatttcagtggcaaacaaacaaaaacaaaaacaaaaaatgtacaaacaactaagttagttaatgttttctgtgaatatacgataggaaaactatgtcaacaccagtctgagaaatccggtccccaaggggagatcaacaaggttggcagtggatggatggtgaagtggaagtcctttcaggctctggaagaacagagtttgtttgatatccatcgacagggagcctgtggagagggacagatggaagagacgggaaggaagcagtgcatgttttgagttaaagcggtgatattaacaatcagaattggagtaagctagtattccattacctcatcattttctccagaagagcacattggttacatggcccaagtttggggagactcatagctatggatttgaataaagaggcatgcagagaagagatattttaatcctcatcaagaagggcagatttataaatttaaaagaagtcaactggcacttaaaatggcattattttattgataactttccaatcacagtagaacttattctccttaaggcgatcagtatgaggttcagagggtaaaagctaaagcctgttgtccttaaaaagtttattcatgtatgcaaatatgagtttctgaaaatttcatgccattcctgaaattttagtaggctgctaaggatgattttcttagctttttgacagtaaaacacttgggaacctctttcctggtcttttacaacaaccaccacatctttcaaagactcctgctgccccagtatgaagcaaatgcagtttcccttttttccaatatatttagtaagtcaatcttcactaaaagaaaggaatgaatggcaattataataacaaaaatgtctcaggtttcatgaaatgtaaataatgattgacatgaaacaggagcctccatcaagggtctttgtgcctgaggccttctgaccatcaaccatgagcattgttgtgagtccatagggttttggcctcataaccatgggatttcaggctctgggcccagaatcacatggagagttcactaaaataaaccattgctaggctttactgtcagagtttctgattcagtagctccaggatgggaaccaaatttgattttctagtaagttcccaggtgatggcaatgcagttggttgagggatcatacacagagaacaggtgggataaaaaatgagaatgcccttctttttgccaatgtctactctatatcccaactattaagagaaaccttatcatggaatcagtttggaatttaagtacattctctcaccatacacattgacctgtccatgacttaactctccaggtgattctgatgcacaatcaagtttgagaaccagagttttaggcaaacagaatccagaactacaaaaaggaataattatataacttcagagcaagacggcattagtcacttactaaaggaaacctgcaaaatcatgcagactggatttcttttaggaaacttatttttaaacaaatgaaaataacttatttcatgtcagttgtgtttcattactctcaatacattttctgtccaaaagccagtcaagcagttccctttatcaaagggaaacacgttccaggacttccagtgggtgcctgaaaccttggacactgccaaatgctctacatgccatatttttcccttctacatgtatatctgtgataaagtttaattcataaattaggcacagtcagagattaacaataacaaaatgaaatgattaaaacagtatactataataaaagttagtgaacgttgtctctctctcgagatattttattgtaccgtactcaccctcctcctacttgcgatgatggaagagtatgaaaaagatggctactaagggattagtgggtgggcaagtagtgtagacagcacagatatgctggacaaatgaatgattcatgtcccgtggcaagacggactggatggcatgagatctcatcacgttactcagtatgcatgcaatttaaaattctacaagtcgtttatttctgaaatttcctatttaatattattttacctcaggtaactaaaaccttagcaagtgaaactgtggataagggcaggcaaggggctgaaggctaccagttgtatttactgaaatgtagtcttttacaccttattcttgctaatatttcttcacagcaaacaccctgaaagatatacaaaaccaagaaaatacttctaaaataaacatttttaaatattataaaaacgttaactctggaacttctctggcacaaaataccatataatttcacatttgaaaagtatatattcattaattttagatatctataataacccactttctcattaatcttaatcttaattcatccaccattctaattattaggtgtattttcctctaccaattttaacatgcattcaattgtgtctgccaaattattaattaacttagaatgttaaattcacccttccaaaaattaatggaagctaagaagtctagtactatgagatgatgtgatagccaccaggcaaaaagtatattttctttttataattatactcagagacatataataaatcaaagagaagagctaataaatgagaacatttgaagaagatagatagggaaagaaatggccatggtaactcctgtagttggaaaacctatgtcggtatttttaagcctttcgatggcaattcaagatttcaaatgttgaggaaaatctcatatttttataaacatttctgtctcagaaaaaagtgtggatatctcagtaaggtaaaaacagtagaaccactctgaaactattattttactttgttattgctttagaaaataactttcctaattgatacattgtaactcttttcttctctcatggttatgtgttggtatgcagaatgcatcctactgattgtagtgaagaaaatacttctgtttctcacattgataaaatgctagactatggttacataaatgagcttgcatgcagccagcaatcctccctggagctctgtatttaggtctgtggcccagattttcttaaacttttaggctgctatatatttagagtagaatacaaatgagtttcagaggaacataaattatctaaaattgttccatactgcaaaacgttcaaatgtttgtctataaagattttctttgatcacttgtatgccattttcaatcaacacgcattctgtttatgtataaaagctatattgttaccaagctcagtttctagattgagtccatgtataccttgccaataatgattttactgtatttgtatggtttttaaaaatgtctttagaaatgtgcagagggtagtggttgactatttagttcagggttcttgttctgaaaaatctttgctttttgaattctatgttgttttgaactagttaagtgaatgtgcacaagagcctaatgtatttttcctgttctaattgtaatacatgtccagcgagttggctcatttggctaaagggagttgataatgagataagggttgaaggttcaaactccctgttgaccaattaaattcataagagttttccatactcctgtccctaagactaccacatcacaaatacaaaatgttgcacgagagacatttatgagtttaaggatggttcaacagaaacccaaaaccaaccatacatttaaaaatagaccatatttagaactctcaaacagaagggtattaatatcttcattcaaaagttatatttatggcatttgtgtgtacgtgtgtgtgtgtgtgtgtatcctaaaaattatcttgcccccttgaaaggaacaaattttaaataaaaacatcaggaagagatgggttgtagatttttaaatttatagattttgcattgtttaaaacctatattttttcactattaagaaaatgtgttttaagtgttgatggtaaaagaacaattaaacatgtagataagtcaaggtcaaatgcacaagccccaaatgtgcttgcttgacagtgctgcttgttcctgcctctggtttccattccctctgggcaaagcccatgtcactcatttgcaggattgctatgtccttccttctagctggccacccacttctagcctcctttcttttgagtacatcctacacaccattagggattgaccattcgacacattatttctaaccatgttatttctgtgtttaaaacaagcaaaagtgggggtgaaagcgggtgctttgatggtcaaagggggaattaagttcatttttagagcaaaatgtagcattacctctcaaggctgcttgctctctatgcctcactgtttgcccaaggttttgttatatttctctggccttggcttctctgatctctcatcagctggtaaccaggtgttgttgacaccagccttatccagacacgtcctatgccattttggtgtccatctgtactgcgttgaacaatgtcttccaaaaatctctgtctacccagaacatcagaatgtaaggatatttgggtaaagggtctttgtagacatagttaagatgagattatatggattagggtggctcctatggacctgtggagacagacatacagaggaagggtgccatatgacgacagaggcagaaacaggagtgatgctgctgccagccaggggctgctgaccacaggaagctagaaaaggcaagggggcattcttcgttaggagagcataggcctgctgatgccttgattctagacttttagccttccttactgtggaagaataactttctgtcattttaatctactcagtttgtggaactttgtaccaacacccaaggacactaatgcttcatccaacacaattcattgtaaatagcacctgttcagactatataagaagtacattgatttttgttcaccttctctactctctcaattcatcccatcccttaaatgattaatcatttttaatcttttcattttggactaactcacagaaagctgcagaaatagtacagaatatccagcatacccttcacccaatttttcccagtggttacattttagagtacaaaaagtaggaaactgacattgttacattgtgtgtgtgtagttctatgtcacattaccacatgttcttgaaaccaccactggcatcaatatatgggactattccattactaacaaagagtgtatatacacagtcacacccacccacataccctagcaaccactaatgtgttctccatctctataattctgtcattccaagaatgttgtatgaatggaatcatacagaatgtgacttttgaggttgactttccatattcagcttaatgaccttgagatggtaaaaactattgtgcatatcaatattcagtttgtttttatttttgagtaatatttcatggtatggatggttaaacagtctgtttaaccactgtttttttcccaaatatattagtttacaggttttggttattgaaaataaagctattatgaataattgtgtatagatatttgtgtggacatgtttccatttccatgaaataaatggccagctgtgccattgctaggtgatatggccgttgcaggtgtatctttaaaaaaaaactgccaatgtattttcagactgaatgcaccgttttactcctctaccaacaacgtttaagagatacagttttgggaggggggagggatagcattgggagatatacctaatgctagatgacgagttagtgggtgcagcgcaccagcatggcacatgtatacatatgtaattaacctgcatattgtgcacatgtaccctaaaacttaaagtataaaaaaaaagagatatagtttttctaacttattgccagaatttaacattttcaatatatttttaattgtttagctcttccaatacattgcgtcataagattccattattgtcttaatttgtatttccctaatggctagagatgtcaagcaacatttttgtgtgcttattttccatctgtatattctcttcataaaatgtcagatcatgtcttttgtccattttcaaattggatattttggtttttaatgttgagttttaataattctttatgtgttgtaggtacaaacactgtggcagatataagatttgaatttttttccaaatcttttgtttgtattttcatcttattaacaagatttattgaaaaaaaaagatggagtccatttttcaatgtttttcttgtgttgtgcatgtggtttcatatctaagaagtctttttacatttgttttatatttttaattattataggctcataataggtgtataaatttacagggttacatgtgatgttttgatacaggcatacaatgtgtaataatctcaatgggtaataatcacagtggagtatccatcacttcaaacatttatcatttctttgtgttagaatcatttcaattccatcctctttgttattttaaaatatgcaactaattattatcaactaaagtcactctgctgtgctattagatactagatcttactcattctatctaactgtatttttgcatacattaaccatccccacattatcctccacctccccacttctcttcctgccctctggtaaccatcattctattctttatgttcatgagttcaactgttttaattttcagctcccacatatgagtgagaacatgtgaaacttgtctttctgtgccttgctcatttcacctaacataacatctagttccctacatgttgcaaatgacatgattccattcttttattatggctgaatatgactccattgtgtatatgtaccacatttcctttattcattagtctgttgatggaaacttaggttgattccagatcttgactattgtcaatagtgctgcaataaacacaggagcgtagatatctctatgatatgctgatttttttcttttgtgtatatacccagcagtgggattgctggctcatatggtagttctatgttccattttctgaggaatctccaaactattctccatagtggctgtactaatctacattcccatcaacagtgtatgagggttccccattcttgacatcctcaccagcattttttattgcttaccgtttagataaaagccatttttactggtgtgagatgatatctcactgtagttttcttttgcatttctctaataaccaatgatgttgaacaatttttcatatatctgctggccagttgtatgtcttcttttgagaaatgtctattcacatcttttgcccaatttttaactggattatttgatttttttgtctgatagagttttttgagctccgtatatattctactagtctcttgttagatgcatagtttgcaaatattttgtcccattctgtaggttgtctcttcactttattgtttcctttgttggcagaagctttttagctttatgtgatcctatttgtccatttttgccttggtcgctgtgcttttgaggtattactctctaagaactctatacctagctataggtcccaaagatttcctgtgttttattccaaaataatgtatagttgaaaattttacattttaatttataatccattttgagtggttttttaatatatggtataaggtttaattataaatttatatttttgtctatggatagccaattgttctaacaccatttatggaacagactatcatttctccacttattattgtttttcctctcttgctaggcattagatgtcagtacttatgtgtgtctatttcaagattccccattttgtttcattgatctattgtcaatgcctccaccaacaccacaaaatcctgattagtgcataatatttttttaattgaatgaaatgttttcttccaccttattcttcttttcaaaattgctttagctattcttaaatcattgcctgtccatatatattttagaataattctgattatatctactaaaaatgtggtaggattttggtaagaattatgttaaacctgtatacacatttgtagagaattgacatatttactatgttgagtattctaatccatggatgtggcattttttaatttagttcttatttgattttggtgtcagcagtcctttatgatttcaacatgaaactcttatagaattttattagatgtatacttaaatattattttactcattgtaatattatactttaaatttctacttccatgtgcttcttactaatacatataaatacaattgagtttttttcttacagattttttaattatacagttgatttttgtgtgttgatcttgttggattctgtgatcattttaggtccttaagcatacaattctcagggttatttctatagatcaccatgtcatctacaaataagttctattttattttttctttccagatttgtatgtcttttatttccattacttgccttactggactgtctataacttgcagtattatgttgaaaagtagttgtaagagtggatatccttgccttggtctaaagcttaaggggaaaacatttagtcttttaccatatgaactgtatgttttcgtagattctctttatcacattgagaaagttttctctcaattcctagtttaccaaagtttttattatgaatggtgctgaattttggcaaatacttttttccacataaatgtatatgattatttgatattccttctttaggttgtgaagttgtatatcatatagatttgttttcaaatgttaaactagacttgcgacactagaataaactacccttggatgtagtgtataattccctttatgtattggtaaatcctttacattaatattttgttaacaattttttatctatatttatgaataatattgtccgaagtttgtatgtactttcttcggttttggtacaagagtaatactggctgtatacaatgaatagggaagtgttgctgcctccattttctagaaaagaatgtgtagaatttacgtcttatacaattccccaataaaccactaagcttatagatttcatttttgagaaggttttaattataaatttaatttccttaacagttgtgaggttaaagttatctttttcatttcagttgaattttgttagtgtacttttccaagaatgtatccattttgtctagtttataaaatttgtgtgtagagttgtttatagtaattctttttatccttttgatggctatggtgactgtagtgatgttccttccttcatttctattttttagtaaattgtatcttctcaattcgttttttctttttcagtcttgctacagatgtgtccattctattgatatttctggaagaatcaacttttgttttattgcttttttcttttctttctattcttcaattcattattttatgcttattattgtttatttcttttttctttacttgggagttaattttgctcttttattctaattttttgagatggcagattagatttttagtttgaaatttttctttttcttttaatataaacatttagagtgctatagtttagaaaacagcactcatggtctaaagttttctgtcttgctaggctgctttttttgtggttctttggctagaaagtgcaaatttctctagggaccattgttgcttttgtttttgtttgtctgcacccgtaggcatttccaagtcactgacttctccagtaaccaatgttccagtcgtgcccaggcccatagctgctctgctgtcttctttccagtttgctgtgtcttcttagtttgtttcgtagatacaatgtcgacacttttcagttgtactttgaagacaatagagaagtaactctccttcacttccaggaagcagaagtcaaaatttggctaatcttttaacactatacatatattttttttcatgttgctcacctgctaaaagtcccaggaaccatcaaattagccaattagctaaaggatataatcaaattttttatcctggtttctaaactcacaataatctggtcccatccccaataatcatgcatcagatttgtccattcttctttagataactactcaaaatttcctacatagacattttattggacctcattttcctctttcagttttttttttaaatcttgggtttgttttagaaaacaaaataagatgttatagataatactgctttgaaaactgccttgcacagtgctaaggaactatgcaataaaaagtgtttttttttttttgagacggagtttcgctcttgttgcccgggttggagtgcaatggtgcaatggcactatgtcagctcaccacaacctctgcctcctgagttcaagcgattctcctgcctcagcctcctgagtagctgggattacaggcatgcgccaccacacctggctaaattttgtacttttactagagacggggtttctccatgttggtcaggctggtctcgaactcgcaacctcaggtgatctgcctgccttggcctccgaaagttctgggattacaggggtgagccactgcgcccagccaatttattattcttaataataataattgatatatacctaatgtctttgtattagtttgctagggctgccataacaaacaccacggactgagcagattaaacaatggaaatttattttctctcacttctggaggctacaaatccaagactaaggtagcaggatggatttcctctgaagcctttcttcttggattgtagatggctgctttctccctgtattctcatgtgattttttttctctgtgaatgtagctccctggtatctctgtgtgtcctagtgtcatcttattattgtaagaacgccagtcagattgaattaggaccacaacaacgacctcattttaactccatcacctttttaatggccccatcttcaatacagccacattctgaggtattgggggttagggatttaacatataaattgcagggtaagacttatttcataaatgttcctattatttggaataagaaggtgttctgtaatctcttgaactgatttgttaaaagtcacagatgggaaaagataagcagtaagagaagagattgtacttttagcagtcactcttctgattgtgatacaaagattatttaattaattgcttttttgatggcagaaggtcacaactcaatgaaaaagaaggtagcagaaatgaaatattttcttctaactgttaagtagctaacataaaagtctggaacaatcaggcacatttctctcaggatctggactttggaaaaaatgagggtgctcttccttctcaatccaaataaattcagcaattggatcatcaaattttttgccagaatggttacaaagcattagaagaaagctttaaaacatgcaagaaggataatacaaatcacactcctatattcattttattgaaagaaataagagatgatgcaacattggtgaaacttttcttagacttgttaactggtgtagttagaaaacaagcaaggttgtctgagctcctagaaatgctaattgttttcactgtttaagaagtttatatacaaggctaatgccagcatttaaaaatcaaagctaattcctttgtttgaaattcctacagcagtgagagcagaggttgctcaccagggtgggattggggtgggggagtctcagctttcacttggtgtgagcccctgccccaaacctgggatttcatgtcaacctggagagtctagtgcaagggtgtccaatattttggcttccctgggccacactggagaaagaattgtcttgggccacacataaaatacactaacactaatgacagctgatgagctaaagaaaaaaatcacaaaattatctcataatttttaaataaagtttacaaatttgtgttgggctacattgaaagctgtcctgggccacatgcagcctgtgggccacaggtttgagaagcttcgtctagtgttttagcaattcacctcattttctgaaagcagtatttgttagtcctggattgtcatgatgcagattgagaccaattacccaccagtgcctagcactcctcaacccaatttccagcagcgggatgaacagaggttccttgcacagaacaatctgcactccaagttgtctttctggctgggtgatgccccacatagttcccactagatgtcactttgttctttcctacttagctaatgtgggatttccttctggttggttcttttcttagcatgcagtgcaccaaacttcttcctgaaatcaccctcattggaagcctcactcactcttctaaggaggctgagctttttgcagtgtttcctcctgggtgtctctcttagagttgatggtatttcttgaataaaagaatccaagtgcccccactccatgtctgcacttatctgcgaacaatcttttactcacacatctcacctctgtgggggctccctctgttcttttccaacttctcatgccatgtcctctccaagtcaaagctacttacctctcccctcatctggcttgtgaacactccctgtgtttcaggaagtaaggtttgagcccacatatccttattttctgggtgtacattttttcccagagatggcacatgagcaaaaatgtgaagattttagaaacatagaagtcaaatattttgtgcgttgttaaacttctcaccttagtgtgaaaatgaggactgtgccttcaggaaatgtttcagtgtgtcctctgtggtcagttcaatccaactttcaatcccatttatcagttgagattccaaattcaggcaaagaaaagactccccaaaactcccagcatcacagttcttcgctgaggactaacacagaccatcacgaaggacccagacaagactgtttaaggaacagagagacttgaagagagcatctgggactggaccggaacacacaaatccgacagcatggagggccagatggtgttcctctgaacaagatctgggttaagctctcggacagatgtccaagcacagactgcacctgccatcaccagactgaaggacagcttggtgaaggccaggtttgggttcatttctcagatcatgtgagaaaaaaagcaagggaaaatataggccataaggaatcaatcctgcaaaattaaaaaaaaattggtctctttatgcatcactttctcttcacaactccatttgggatggtttaggatggtcgaaattggtgtaaaatgtgcaactataagaatataaattaattagacttgtttcatgtgaatgcacaagaatatgcattgaatgtgtttcatttcacagataggctttgacatacattatctctcttaaacacacacaaaaaaagctacaaaacagttcaacaccattttattgataagaaaatgacaactatgacgtctctatgcagctcctgcatagtctttctgttctttaatgtactgtgcccagtgtcaaccacaattctgggtatgctctcttttctctgcttaaaacatattatctttcccacccaactttcactcagttcctgcttggttattcactaagcttcagcatagatagccttcttccaggaagccaccacagtctggaataagttatcctcagaaatagtttttctatcatcatgcttactgcactctatcatcccagctgttttcttgttcatctcctcactagacgagacctcctgatggacaggcagaaagtctcattgttaaggcattcccagctcttagaacggtgtctagtccatgtaaacagacaataatacgtgtcaaatgaatgggtggcatagctgaagatttattatgtataaatgtatatttatttcttatgcataaacaggctaaaaaccaaactcctcttcttcggctgaagtaagcattctctgtaagtttagaactatgatttcattttctaagaaatattataccatcttttattttcccttaaattgtattctaacagtaggcattgttcactagctgacactcttttgggattacacacttaagaaatatacaagaccttatgtaagaattaaaaagttaaggttatataatctgcaatctctggaagtgaatgtctctgtaaatttcaataatatgagttcatcatatttaatgcttcttcatttacaccatagatacataactttccaagctcttgcttttcagcactgggtggtccttcctcccttcctaattaagtttgtgtgacaactggcttgcacagtcagtgaatttattctctaagtttagaaaatcataaacattgtatgtattttcacaatttaattagttggcagttttgttaaagtgcagatcattaaaaaatattattttaatgtaggttatcttaaaggttttttgctgagtctatagtaaaccagtgcttctcaacctttatcaggaatgatctgaagattttcttaaaatggtgattcaggtccagcaggtctaacgtggggcctgagattctgcattctaaccagctctgtgagatggccaatgatgccagcctgtgaaccaggacctcaaaataagagttgtcatctggttcactcgtgctccctaatgctgaaaatgaaatttatagtaaggttgctaataaaatgcaatagataatagataaatagttagaaggtaaatgcttcagattattttgttaatgtgaatttaaaattatcctgcttctcctaatatatgttgtgtattttaaaagaagcaatgatgtaacataagttttaaagccagatttgacttctggattgtccctttagtagccagttgtccttggacaaattcattaattatcttgtcaagttacaaacattgggctagttatcaaatctcaggtctcttggtttgaataaaatgggtaaatttatataatagcaataagccagggatatggtaaatacgtaataaatcataattaaagtaataataacaatctccctttagaaactgatgagagagtgtggaagaattactcaatgttagccatgaaagggactttgtgggtgctctaacccaaaccttcctctgacactgaaatcccttctggcatgccatcttgcctgaaaagctgagcctccttgccctcgcttttaattaaatcatcagaaactccttccacactccaactacgatacgctttcctaagacttccacctcagccttgttctttcttatgaattcatacaggaatggctccatcattttgtcctgttctggtcctcctgtgcttgacaattgcccataggtggtctccttgccttctgtacacgtggaaaacaatcactcttttccacccttccctctggctgatctatgtacccctgaaaatagagcatccagacaaaaggcaagaatcgggtggactaatcgtagatgtgtactgcagaatgggctcctccaagtttctggttctgggaactgtagttctcttagtgcaatccaagatcacattggcactgtggtcacatcacagtaaggacccagtggaaattatgactgagtgtcgtcacaagcaactctatcactcctctctccaaccctcctgtgcagtgggtttaagggatgcacagaccttatcactattcctgtcaaaggtattactatattgcattccttttatattactctcatggcaggccacattgatttagatcatttttctttccatcaatgaatttgctgttcctccccatttgatgtgaagggtaaaagaaaaaaaattcatcactctgatttcaaagttcttgtctaagtcatgaataaaaatcctaaaaaggataattctagacacaaaaatcctaatgaccaaaagaagtgtctcccacctgtgagtcagatctactgacacagatataaagacagtgctgatcgcacatttgatgctctcttataatagtgaatgacataccaggactctatggactcttggtttggctcacactgagtaagcagagtgtcttccgtacatttcactttggttaatcaggtgttggtgtgtgtttcacatcagctgatcatgccccatcaggttgcatataagacttcatccgtggtggtgtaccctgcaggagccctttggggaactccgatgacacataaggatgccttgtgcttctcatagcttcccattatccctggtttcagaaattaaaatggggtcgtttgcttaagatggccatagtaggtccttgcatttatcttagtctccacctgggtgtgatgattgtatctgataagtaacttgtggaataagagttcaaattaggctgggcgtggtggctcatgcctgtaatcccagcactttaggaggccgaggagggcagatcacaaggtcaggagatcgagaccatcctggctaacacggtgaaatactgtgtctactaaaaatgcaaaaaagtagcggggcatggtggcgggcgcctgtagtcccagctactcaggaggctgaggcaggagaatggcatgaacctgggaggcggagcttgcagtgagccgagatcgcgccacggcactccagcctgggtgacagagcaagactccgtctcaaaaaaaaaaaaaaaaaaaaaaaaaaaaactcaagttaattcctaggccatgtctttatctaaaatgggtatcagcacaggcgaggcctctcattgggatgcatcaactgatccattttattttaatcagaatcaccatattatcttcctttaatctttccctatacatttctctaattaatgatttacattttttttgcctatagagtatattccctatttcccatatcaaatcttgccattattagattcctctgagtgctttaatggatgtgaattttactagtttgtatgctttcgttttatttctaattggtcaaatcggtgttatattttttctagtaatttgggaggcagaaacttaaacctcagacccgtaagtcatgattcagaagacactgaacttgctaatgattgactgcccggggtgtggagggtgaaggaggcctttgcctgctacggaagctgcacggaccacagccctagtgcacatgatgtcgagctctctgtgtgccttcgaggaaggtgtccaaggggcagtgcacacactgactcttggacgccacagagttgatgaaatgagaactaagatgagtcatgttgaatccaagacttgtgcaatttataaaacagagaagtggacaggcaagctaagagcaggagtttagaacaccactgactaagcacctgaagcccacctgtgctgctctggcggtcgctggttgttggcactgatgtctctgccttgcctgatgattaagaaaacacctcactttttgcttcaggtagaaatatttgcaccacacactaaaacctactgcatttaactccatatctttttataaaaattatatatgtaaaaaaaatttagaaataaatgagacacagactttttgttataaaacttatagcgtgcttattttttctatctcattttgaggcatttgttatctttctttttaagcatttctagtcattgtaagttacttaaactgtatatcttaatttgttagtggccacttggaatgtgtgcaaactacaccattaaaaacttattggagaagagtgacatgattaagccaatgcagggattattaagtattgcaggtaaattcacaagtaagatattctgtaggacaagcaatcctatttcttcaactaataaatggcaagaaagacaaagggaaggagatgcttataaatgtaagacatttaaaaccaaagcaaagaaagacgttatgtgaacctcatttagacctgggtttaaaaaatacattgatgagaaatctatgagaattttaggagaaatttaaaaatgacttgggtattagatggtattaaataatagttattaatttcattagggattttcatgacatttttgttgtttaaaagtgcccttatctgctagagaagcacaaaggggcattttttaaattaattattattattattttttgagacggagttttgctcttgttacccaggctggagtgtaatggcatgatcttggcttactgcaacccccgcctcccaggttcaagtgattctcctgcctcagcctcccaagtaactgggattacaggcatgttccaccatgcccggctaattttgtatttttagtagagacagggtttctccatgttgcccagtctggtctcgagctcccgacctcagatgatccatctgcctcggcctcccaaagtgctgggattacaggcgtgagccaccacacctggccaaggagcatttgtagttaaaataaaatagtattattgagtcgctttgaaattcaacaaacaaaagcagaagacatgttcaaatgtcaattgctgttggagatgaatggtgggtacaggcagagtcactacaccattctctcccagttgatgagtttttgaaatttttcataataaaacatatttaataaattaactaaaataacactaataaagactctaaacatttaatgttgcaacattaatgacagtgtaaatcactgtgaagctggagagattattgacaacactaagcattgtattcaatgtaaaaataagtcttgggattaaacggaattgagctcagtagaacttacgattgtaaatattttttttcttctaaatcatcctcttttatccagtttgtacaactttcacaatttataccttcttttattcaggcatcacagctgcaggaaatctgttaagggactgtggaaccatatttgtgtcccagttgaaaagcgacaacatccccttttgattcatgcctctctgttgtggaactagtttctagatgtggtatttcataatcattctaatctagactctatgaattgatctttcctcttaatgagtttgttcaagagcaaaggaaaaatattggttactgttctttcctgtagacatggcctttgctcctagcagaggtggctacaaaattcacagctgcacctggatcccatcctttcatactccacacttttgaatatctctatcttgtcttatatagatgttcctcaacttacaatggggttacatccttataaaaccatcataatttgaaaatgcattcaacaccctgataaaccaattataaagctaaaaaactgtgagtgaaaccgtggtatattggggactgtttgtatttctaaccttttcttctcatttttttggtcatcagcctttatacatgagacaatttactcaatctttgattttctttgctttcaataagcaacaattaaatataattttaccaccatctctctctgggatctgttcccatctcttcattcctacagcaatctatctagtcccctccaccaattcccatccccacagcccacccccagggtgctgctgatgtgttgtaggtcctacccctaatccattcttcacagaggaggttgaagaaacttttaaaaatgcaaatcttaaaataattctcatgaactgaaaacttccgcgggctgggagctcctgtagtctcagctacagttgagactgaggtaggaggaaagctttggcctaggaatttgaggttgcagtgaaccatgatagcatcattgctttccagccagggtgacagacagagacggtctttaaaaaagaaaaagataaagaaaaaaacctggtggaacccattgatgaagtgcagtggtgtgatcatagctctttgcagcctcaaactcctgggctcaagtgatcctcctagcccagcctctcaagtagctgggactacaggcacatgctgacatgcctggctaattgacttttttttttttttggtagaggtaaggtcttgcattgttccccagactagtctaaattcttggattccagtgttgcccaggctaatctaaattattggattctagtgatcctcccaccttagcctctcaaagcagtgggattatagccatgagctatggctcgttgccaattttaccaataattgtctatttagcaattaaagcaatgtaaagattttggcttgtgtccacacaggcatgagccattgagtaataaaaaactaaaagttatgattttttaaaattatgtgtatttaaatttatgattactagttttatttatttcccttcctttcttcccttccctctgttattttccttctactctgaaagaatgaagataacacaattttatgcactttctcaaactttaagatgcaaaataatcatttagggagaacatgtaaaaatacaaattttctttatcagtagagaatctatattagcgagtctatattagcaagtctaaattgaagccaggaatatgactttttataagtaaagcaaatgattttgatagatgatgtccacatacagagaacccaaatgcttctggaattatttcttgcatagcaggaaattaaattaggattttttgactaaggcacaaatgtatgctatatatggcataccagcaggaacaagatgaaaattttaaaaagaagtaactggaaaccatttacatgacctttcattccttattcacattgaatttatgaaagcagtctgctttataaaataatttgtgaaggggatgtctttgcacagagttgcaggagtaaactgtgagttccttcacactcctggcctcacactcttgaagctgactatgcgttcctgcaattaagggacccagtggacagatgtttgactcgcacccaggccatccagaagttgagagagtgggtggctccagctttaacagtaaaattaaagatgctttggtattcaacagtattcctaatttgtcagaaagtgttgcttgtggaacagtgagattacaacatagggagataagcactcttgtgcgtgcacacacatacacacacacaccaaaaacagcaatgtaggctgaggtgggaaactgccacctgaggaaaatgcattacgcatgtcatagcagcctagggagatgtccttagtgaggacatttaagaaccaacagaaaatcaagaagctttaaacatctctctggtttagggaaaaataaatcatctatgataacactaatcacataaaactttattatcattctgacatctctctgaatagtcacctttatgtaatactaaaaaaaatttctgaaaaactacaagttgcaaagaagagaagggccatatccccctctttttcgccaggggttaaactcacagaagtccctagttatggaagaaagaagatacaattttaagcaagttaaatgctttgaatgtaacataagtcagacatattttaccagtaagttaagaatgtgtttctaagttgccatcacattttttaaccaagaattatcagataagtaaggggacgaccaacctttttacctaagagcaggagagaaatttacattttagagggaatcacaagacctgcttgtaagaatcctgagtgtcttttaaatttctttcttttgggccaaaattaaaccggatttcaaaagcacattaaaataacatagttgtgatattaatgtcttctaatggtgaaattagcttaaaaatggcttttcatttgatcattctctactggggcatatgagggtcaccattactttgaacatgatattttgtgtccttacttcaggaggtgtggcatggagcctagaacctggacttcttaatcgctctgtaaaataatctggaataaactctgcaagagaactataggttcatataaaggtctaaagctatagccttggaatttcttcttgttttctcataaaataacatctataaactgctgtatataaaatttgtaacagaattaccacattgtttcatcatatttgccattgaaaacttttgatctcacaaggacagaaaaatgtattgattcttcaagaacttccagatataaggacttaagagatgattttatggttataaggaaattttcaatttgttcagtgaattaaaatagatgatatttgcgaaccatttaaaatagtgtctaaaatataggaaggactctgttggtttagatagatagatgatagctagatagataaagagattgagacagactgagagagcaagtctacatgatgtagagccttttcctatggcagtggtgagaaacagctcccagtgttaggagacagtagggtgcagggccagagcacatgtgctggaagtcagaaaacgtgggttgacatccgagcccagtcccttaactcgcttggtgtattaggctgttctttgccttactataaagaaatacttgtggctgggtaatatatataaagaaaggaggtttaattggctcattttttctgcaggttgtacaagcatggctccagcatctgcttctagtgagagcctcaggaaacttacaatcatggcagaaagtagagcatgagcaggcacatcacgtgctcagagtagcagcaagagccagaaggaaagatgcaacacatttttaaacaaccaatctcatgaagacttagacattattgtgaggacagctaagccattaatgacaatttcacccccatgatccaatcacctcccaccagaccgcatctccaacattggagattacaattcaacataagatttaggggggacaacatctaaactttattacttaggatttacttcttttggggagggggtcctcagtttcttcatttctaaatcagagataataaaaactatcaaaaatatgtgttgttgtaatcaaaatagtaaaccaacataccccacaaaaatgattacatatagtaagacaaatagtgggtaattttctaactttcaaactcttctagcaccagatcctatggatatgtgattctgttaggataaaagagacacaaagatgtagtgtattcagcccatctgggttctgattttagttctgttgagaacaatttgtaagacattgttcagttgtactggccaccaaagctctaagaacttcctagctgtgtgaagaagctcaacgagatcaggggttagcaaatttttctttaaatggccaaagagtagagttcaggctttgaagagccacagggtgtgtgtagcaaatactcaactccatgattttagtgaggaagcagtcttagacaatacataaacaaattatcttgtgcttgtgatctaataaaattgtatttatgggcactgaaatttgagtttcacatttcaacttgtcattaaataatatccttctttcgacatttttcaacctttaaatatgtaaaggtcattcttagctacaggccataagtaataggtgacagactagatttggtgccaggactggagttttctgatctccaaactagattgtttccaagagctagcatactctcaaaaccttgattctgttgttgtaattggtgctctttgatctattttctcattctcatccccacactcccatttctgcatatctacttggtattctttctgaaaattacctcatggttgcaagctcataatttgtaaagggctgttatcaagaaagataacatattattttaaatatttaaatgtttaactcactatcattcatcaaatggtaagttaattctactcttttttaaatattctgaaatcaagaatcataaccaccccattctagcgtgaatttatattaccaagacttgggccaagagtaatcattcattaacctgaattcaattaaatgaacctaaaacaaaggagttcatagaaaaaacaaagagaatcccagcatttctctgttatttgtatgtgtttgtttatttaaacaaaagaagtgattttcctctgccacaaatgctgactgttcaatttttgcatcttgtcaaattttcccaggtatctgattttttgatatgttatgtcttagcctcctttacttttacctactagaagttgatgtttcttcataaccaaattattagcctttatacaaataagtttttgcattatttacaaatattagttttgttccagttacactttactgttccaaagatatttaaaatgtcatttatgttattaagttagtttctttgagttttctacattccaaaattcttactctccttttcatttttaggagtattaaattttcttagaatatacggtgaaggtctaaaagaaatttatttttaaattccagcactttgggaggctgagtagggcagatcacttgagctcaggagaccaacctggacaacatggtaaaaccccatgtctacaaaaaacacaaatgttagccaggtatggtggtgcatgcctgtggtctcagctgcttgggaggctgaggtgaaaggaatgcttgagcccaggcagtcaatgctgcagtgagccatgatggtgccaccatgctctagccttggtgacacagagatgctgccaaaaaaaaaaatttttagttcaacatacaatcaatcattaatattatcatttacctatatgcagacctacttaacatttataaacttatattttttcatataaaagaaggctctatgtaaaatgtgagagataaaagttagatccaaggaaggactcaaaattaagagatactaggtaatcataaaaagctattttaattacatgaacagaatacattcatgaccagaatgtttcatggaacaaattgatgggggaaatagttgccattttagaaaactttctagttgtaagacttaaacaaaataactgtcattaagtaagtatatgtaataggataaacataaaatgtcctcccagtcaccttctgcaaagtaaggtgaagggaaagcttatcctgtgtttctcaaacttgactgtcataacaacctgggggtgtcacatgctaagttaaatattctccatgccttagagattctagatgaagatgcgccaaagaatctgtattttaccaagttgctaagatgatttttgaaaattatgcaaatttggtgaatcctgagttagtggttaagacttaaggatcaaaattttaagttttttctgctttaaaattcgataatcatactaatttcaaggtatttttcagagtattaaatgagagggcatatggaatggacttatttgagaacctggcacaaataaaacaattaataaatcatccttgcaggtgtaatacattgtaaatacattttttgtgttggcatccatgaaaaaaaataaagtaatttaaatttatttatcagattaaataacttcctttaaacaatcaggcaaatttattaaatcttctgaattttagtttatcctcctcaaaaataaggggttaaagtgggttttaaaaatattgggattgagggaaatttgaattcttgaagataaaccaagagaaaaaaagagaaagaaaaaaataaagtcatgcccagcattcacagtaaaatagttgtatatatgaaataagaaatctgacaacttgtctttacatttactgctgctagccctgaaaaatggcagagtgtggggtgaatgcatgatcctcatgtgcagcattacctgcacctccaaatgtgctccttcactttagtattatctctttgttttctttccatcttttacaatagtcattaacttaaatactttgatttttaattacattctttcattttcagcactatatttatcaaaacatagaaaaggtgtcagctcctaatgaacaaaacaaatattaaatgaaggtgagaaaactctagttttttcacttaatttattagttctgttttgtagaatgtcgctcatattttttaatactaattagtaaattatggcaatatcataaacctattttttatgtgtttgaccttatcattaatattttggctgatttcttaatattttacctctgacctgaaattagtttagcattgatgtgaataatggcagttgccaagtaagttttgcctaataggactggggtttggtttttaattttgtaattctttacattgaaatttgctacctaattttaacagtatgtcatttacgattgatgcaggcaagaactctgttatattaataaatagtgcatcaatattctaaaccactcaaaaaagttaaaaaaactataattggttgctgagagaattaaaaataaaattatataaaatgctcaattaaagctaaagaaggcaggatagagtgaaaacaaaaaaaaagaaaaatggaaaagagccatgaattgtaaagattagcaaatacgctatacattaagtcaactatgtcaataatcactttaatttaaaatgttctaaatacgtcatttaaaagacaggctaacagaatgcgcaaggaaacaagatccaactgcattatctacaagaaacttaccttaaatataaagaaacagatagacaacttgtaaatatatagagaaatatatgccatgttaacactaaccaaaagaaagctaaagtagctaaattatatcaaataggtcattatatataaaggaggtcattattatatttatgcatggattgattcatcagaagtcataatagtcattaacatgtttgcacttaaaaacagacgatctttatttgtgagaggaaaagctgacagaattgttaggataactggatgaattaaccattatatttgagcactcatctcccctccatcagaaacagatagatccagcaggtagaaaatgagtgcatagtggaactaagcagcacctcaatcaactaaatctagttggcacatatagaatactttatccaacaatggcagaatccacaatagactacattcggggccataaagtacatcttaacaaatttaaaataatagaaacatacaaagtataattttagaccatagtgggattaaaatagaaatcaataatagaaagatagctggaaaactctaaaatgcttacaggttaatcaacttttcaataacacatggatcaaaggagaagtctcaggagaaatttaaaaatattttgaatgaaatgaaaatgagaatactataatacatgtcaaaattcgtggaattcagcaaaagcaatgtttagaggaaaatttatagcacagaatgtatatattataaaataaatattgaaatcaacaatctaatctttcaccttaggaaacgagaaaaataagagtaaagaaaatcccaaataaacagaagaaaaaataataaagttaaagcagaaatcaataaaattaaatacaggaaatcaacagaatcagtgaaagcaaaggctggctctttgaaaaaaaatcaataaaatcaaaacacccttagcgagttaattatgtaaaaaagagagaagacacaaattattaatatcagaaatgaaagagaggccatcattattgatctcatggacattcatagagtagtaagggaatattatgaacaagcctgtgcttacaaatttgataacctagacaaaatggaccatcttcttgaaagacatgatctgccaaaactcatacaagcagaaacagagaacctgaataggttctatatctattaatgaaatttaatcaataattaataaccttccaaaacaaaaagcaccaggctagatgtgtttacttgtgtattcttccccaaattcaaggagtaaacagattgaattataagtaaaaacttcccaaataaaatcctaagtacagatgcttaattgataaatacaaccaacagcttattgaagaaataatacaaattcttcacaaaatctttgaaaatacaagaggagggagcacataaaaactcattctatgaggacaatattaccttgctataaaaaccaggcaaatatatcacatgaaaagaaaactacaggtcaacatcccatatcaatgtaaacacacaaatcttcaaagtaatacaaggaatccagaaacttatttatcccagtattgtaaattgtatttatccaggagtgtaatattggaaaataaattaatttaattttccatattaatagaaaaaataaaccttaatataagcataaattatagctgatgaaatccaacccctttcatgataaaaatacccaacaaactaaaagtagaagagaaattcttcaacttgataaaaggcatctatgaaaaatccacatctaattcatccttattggtgaaagattgaatactttccccctaagactgggaacaagacaaggatatgtgctcttgccacttatattaaacattgtaatagaaggtctagccaggttagtacggcaagaaaaagaaataaaacatacttattttggaaagtaaaaaataaaattacaccagaggacattatctttagatagaaaatcttgacacacacacacacacacacacacacacacaaacaaacaagaagaaaacatttaaattaaaaacgtagcaagataacagcatataagatcgaagtttaaatataaattgtattttgtacactagcaatatgcaatccaaataaaattgagaactgttccattgacagcagcataaaaataataaaatgcttatgaataaatttaatgaaaaagtgcaaacatgtatgcattgtttcctagggctgccatattaaagtgccacaaatgaggtggcttaaaataaccaaaatttattgtctcacagttgtgtaagtttgaagtctgaaatgaagttgtcaagagagccatgctctgaaacacatacaaagatccttccttacctcttcctagctgtcagtggtttcccagcaatcttcagcattcctcggcttatagctacgtaactccatcctctgccgttctgccacccagtattcttgtgtgcctctgtcttcacatggctgtcttcctatagaaacaccagtcatattggactaggaagtgaccctacctttaaatatgttcacattcagaagtactagagattaggacttcaacctacttttttgggggcagacataatccaaaccataacaatttgtattctgggaaccacaagatacttttgaacaaaattaaagatgatctaaatttttaaaaatatttcatggtgatggattttaatattgttaagatgtttatacctccaaaactgacctaaagaaacaatgctttccttatcaaaatttcagcttttttgcagaaattgagaatcagatgataaaattcatatgcaagagacctagaataattgaaacaattccaaaaagatagaacaaagttggaggattcatactatatttcctgatttcaaaactgactaaaaggatagagtaatcagataatataatataatctgattactgtaatgtaatataaagatacacatgtaaattaatagagtaaacttgggagtttagaaatacagttttacactaaaattcattgttacaacattttatcaatgtggccaagacaattcattaagtaatagtatttttatccaacggcacaaggacttctggatatccacatgcaaaaagaattaagttggatgcctaatttacaccatataataattaacttaaaatgcattatgcacttaaatggaagagctaaaattacaacactcttataggaaaatgtaagaataaattcttgtgccctaaagttaggcaattgtttcttggctatgccaacaaaatcacaaggaaaaaatttaaaagtagataagttggatttcattaaaattaaaaaagagtttttaccccagtggacactattaatagatcaatttacaaaattagataaactatttgtcaattacatttctaataagggcctagtatccggaaaacataaacatttcttttaactgacagtaaaaagacaacccaaatttaaatatttaaggaattaaagagatatttctccaaaagaagaaacacatatgcaccatatgcaaatgaaagtatgcttaatatcattaatcatcattgaaattaaaatcaaaaccacattgagctatcactttatgtccactaggatggccattgccagaaaacagacagtaataaatgctggcccagatgcagaggaattggaacactcttatattgctggggcatctgaaatggcacagctgccttacaaaacctttgctaataccttaaaatatttagcctagagttctcatgtgacccagtaactccactgccatgataaatgaaaccacgtcccatattcacccaagataaatgaacacacattaacagaaatgcttttacaaaaagggtcatagtggaattacgcaccatagttacaaagtggaaatgatccaaatgaccattaactgatgaatggatgaacaaaatgtggaatgcttttacaagggaatagtctttgtcaataaaaagaaggaaatgcagatacatgctataacatggtgaaacctcattgaaaacatgaaaacattaagctaagtgaaataagtaaaaaagatcacatattgtatgatttcatttatatgtaatgtccagaataagctaacccatagaaatataaatagactggtggtttccagggattagggagaggaatgattagggaatgatatttttctttgtgtaagtaaaatattttaaaagtagacagtagtgatgattttgctatcctggaatataataaacgtcactgaattatagacttcaaaagtgaacttcatggtttacaatgaatgaattatattttgattataaatatgcatatatataaatatatataattgtgtgtgtgtgtgtgtgtgtgtgtgtgtgtgtgtataatccaggatagtatcctggatagaatcctggattgtttaagctgccaaaacttccaaattagtaacacatgaacttgttcaatgactcctctgtcacctcttgaaattaattccagccatttatttatctacaacacaaaccccaccacaacacatacacattgtgagctaaacttcatttttctgatgacttctctcatattctaaatccatatttcctttttcaagcaatttttgaaacaccaaaactattgattgagctcccatcaggtggagaacaagatacttctcattactagcagggactgtgtcaggcatctcaagcaatccagaaaaatttatgcatcatattcctgcctgtaagaagtggcatttaaattctggctttgatcctcttacttactataatattgattctcaataaagaagacaaagttactatcacccttatgtgaatattcccaaatctccaatttcagcattgggtctctgatgagttgatgattattatttaatggactccaactgtgacaacacgactcatctttcccaaatgggctcccttctgggcagctcccttctcagcaaatgatgtcatcatttacccacttgcccttgccagaaacctgggcattgtttgtaaatgtttcttctcacttacttatattctatattcaaccaatcaccaagttctatgtactttaccttctaaagagattttacttctctccaattatctccttacccactacttatttccttaaccattacttatctccttatctgttactgctatccttggccaaggtatcatcttttcatacttatattactgaacaaaccataaactctttccatctttgttccatatcatttttcatactgttgccaaaatgttccttctcatgagagcatttctcagtggcttccattgttcaaggtaaggtatacaatttttaacctggtgatcgaataacctgctccttgcctactgttccagcctcagttcttattatttatttatttttgagttggggttttactccgttccccaagctagagtgcagtggtgcaatcatggctcaccgcaaccttgaactcttgggtccaagccattttctgacctcagcctctagagaaactaagaatccaggtgtgcaccaccatgcccagctaatttcttattgttatttattgtagaaatggggtcttgctatgttgctcaggctagtctcaaactgctgggctcaagtgttcctctgacctcggcctctcaaggtacatcccaccttggcctctcaaggcataagccagtgaactaggccttcaattttttttaaacttctctcactcatatggctgaaccaccctgccctttcttaaattcttcaaatggactgcaattgtctcatcattccgacttgcctgtaattcagactcactctttcccacactaacctcaactgcttcaatggctccacctagctaacatctgctgaatgttcggaactcactaagctgatactgcttctaggactttttccctgatcacccccaagttggtgagagaatacttggtattaacctcccttaagactttatagtatttatatgttccattttctctactcctgtatacattgctacctctgggaaagcaagaagcactcccattttattatatcttgctttgaaaaaaatccggtgatcagtaaatatttttgaatgaagaaatatgatttgaaaggtgtttaccaggttttcaatgaactttaaaaaacatgttaatgctcctgtttctttaaattgaagaagtccctctcatgaggctccatggtgctggaatgcgtggggcagggaggaaaacagatgtcttcttattcctgtgtgggcgagtttattaacatccctgaatctcaatttcctcatttgtaaaaggcattagaacacatgaggactgtttgtgggtaaaaagaaatgttgtctgtaaagcatgccaattgaggaagcagcgcttgtctttcccatcttttctcagtacctctcccctcgccagtcagtcctgagaaaaggtacctcgaagttggtcctaactcataacccattctttttttctctcattagaaaacaagtcatttgcattacttctaagcaagagttggaaaaacaaacacattaatgtattttataattttaaaaaattgtttgatagacttaataggccctgtttttcttaagaaaatatatgttgctgtctttttattggaaacaatggataatgtaccaggccaggtaattctatttgaccccatttttctatcctttctgttttgaagggcttggaagcagttccaaacggagggaaaaatgaatcatcacctttccgtacatgcattttggattgtcagattggatttgaaaatagcctcatattgtttcactccacaatagataaaacatgaatttctatcagcctcatgaccttcttgtttccccggtactcctgctttaatctaaggattctctgttcttgagcttgcatagttgagttagagcaaattaatgaaagacaatatgtcctactatgttccacagataaaataccaggatcatccataaaggtcaaaactgagtgagcccagaggagattttggacctaggattggccttaggcactttgtctgaaagagaagagcctgaaccttactcaaggctacaatatcttcctcctccgattgctatggaaacatttcttttattttttaaagcaaacatccatgccagacatatgacacagcagaaaagctgtggagaaggatgaagtcaggagtttggaatcatctttcaagatatatagcccagtggttaaattttcaggccctggagtgtgtccaacttcttgggttccaatctgttcacaaaccacacaaagcaggtttcttaatcacttcatgcaagcagtcacatcattagtaaagtaagaaagatgacgacatttccttcctgtggtgccgtgtggtttactgtatgtaaagtcttttagaacattgtctggtgcaaagcaccatcagtgttagctgtaattatcaagtttcagcttccaacaatgtcaagcaagatagatgagtgaataggccccatggaggcaattggggattgctggaacagcaggacactgggctgcatttgttaggatcaagggcaggcatgttttatttcaaaataaacaagcaagccagcaaatcctcactgagcctccaggtttaggtttatagagtgtaaccatgtcatctaccctgtgttttgagatttaacttataatttattatatcaaacctaagtatattgttgcaagagataagacaatgagtcatatttcatcatgcacttctttagtgattcagcaaaacacaatttcgaggaaatatttaaaattgttatagttactaagaaataaattacgtggacagcctctctctatcatttctttcatttttaagggaagaattgttttactcagaacgtggtgttctcctagccagagaaacagtcagtttgtcatatgcgttcatcttttgtcatatttgttaaagggctatgctgagtggaaatgcagctgcacaggtaacttaagctcacaggtggaagccagatgcatgaagacacaatgggttagggtgattataccttatcgggagcaatgccttggctgagcctgtacattcttttttttcttctttagaagctttacacttttttgtttttgtttttcatctttctaactttatttgaaatgccacagtggagcagaaagtgtgtaggctgtaaaatgaaagagaacaaggtcaaagtcaaatccaagatctggtactaacctgggaaaattacataatctccccaagcactggtgtcaaaatctgtaaaatggaggtgatatgtcatggttaaggactgctttaaggattaaattcataagatatatagtaaggcctatagcactatgtacacagaatgaagtgtcatcggaagcttcttcctcctctgtctttagagtctacaagacctgcaacctgggactgtgtccatccctgtttgagttgctcaacaggacttggttaggccctttcatgtcagcacttggatgtcgttataggaatgaacctattttagggttgttaatgatcccaggacccatgatcatttcagtttagggaataatatgcacacagtttttgaatgatatgtttttcagacagtgatagtctatgtgcactttttaatttattgaatattatttgcatgtaatttgataaagcatttacacatgttggaaaatatgactcatacacagtcagtggttgatggtaagtcaaaaacttttgtaaatttctatgggtgaaaaatctaaagctccacctcaaaatcccaagtctgaaagagatctttgagatttctaaagccactttttaaaatttgcacactatcaactgcagactctgagaggttggggggttaccaccagaggcacttgtaccacacaggctgcaagcatgatctatggaatagataaataatattttcaaaacaaatactatgctttttcaaatgtatatagatgtttatatgattaataagagcagaaacagacagatgagattgtttttaatgtagaaatcccgatcagtggtttctaaatacactcatatagtaaatattttcttcaggctagaaaccacacaccttatctaagtctctatttcctataaggaagctgaaacttagaaaggccaagtgatttttggagtggcacagctgaaagtggtagagcagaatttagaaaacataccttcaaacaatgtccaactttccacaactatcttgaatcttttaattaaagttttaactttgaggattgacatgcagttgtgaagttatatgcgatgatcctgagtacactttaaacaatttccctcaatagtttacattttcaaatgatggcacaataaagcaacgaggatactgacattgataaaataaactgatgtttttcagatccacaattttacttacatttgtgtgtgtgtgtgtgtgtgtgtgtgtgtatgtgtgtttagtgccatgcaattttatcacaggtaaaatgtcttaagtacatcacctgcatcaagatacaagcagtcatcgccacaagaattcctgctgttgtgctttaataacaataacctctctctcttaccctctccacctgacttccttaacccctagtaagcaataaattgttctccattttccaaactttgtcatttcaagaatgttgtataaattcaatcatacagtgtgcaggcatttgggattgccttttttcactcagtaatattccttcaagattcatccaagttgttgctcatatcaacagttcattcattttttatttctgagtagtattccatagtacccatgtgccagtttatttagccattcttccattgaaggacatttgggttgtttctactttttggcttttatgaataaagctgatataaacatgcatttcaattttttatataaaataagttttcatttcactgagataaatgttcatcattaagattgccagattgcatagcagttgcatgtttaacttaggtcaattttgttgttgttttaacagatttattgagctataattcacacagcttataactcactcgtttgaagcatacaatttaatggcttttagtatatctacagaggtgtacacccatcaacataatcaatattagaatattttcattacccttaaaagaaacactatacctctaaacattaccctcccatttatccaattcctcaagccttggtataccactaacctactttctgttcctatagatgtgcctattgtaaacaattcatataaatggaatcatgcaatatgcgacttttgtgattcacttctttcacttagcataatgtttcccaggttcatccatttcgtagtgtgtatcacctagattttcaaattgttgaataggatttcactatatgactatatcatattttacttatacatttatcagtgaatggacaattggattaactataccttttgggtatcatgaataatgcttttcttaatatttgtgtataattttttgtgtggacatagtgttgtcatttctcttaagtatatacctagaagtaaaattgctggaccatatggtaactctatctttaactacttgaagaactaccagcccgtttttcaaagcaggtgcattatttcattttacattcctacctgcagtagatgagtgttccagtttctcaccatgtttgccaacacttgctattttctgtcttgatacagatatcatagtgggtgtgaagtggtaacttacagtaaaggtggttttgattggcattttcctgatggctaatgatgggaagcatctttgtatgtgcttttttggtcatttgtatagattctttggagacatatctattcagatcatttgaccattttaaaaaattgggtcgtttgtctgcttatcaccaagtagtaattaactattctttatatattctagatacaagtgccttatcagataaagcaccatatcagatttgcatttttttctcattctatggcttgtctttcactcccttgatggtgtgttttgaagagcaaaagtttttaacttttgatgaagtccagcttttttgtcatttgttgcttatgcttcttgagtcacatctaagctttattccaaatcacaaacacttgtacctatgttttcttctagtatttttattacattacctcttacatttaggtcttaactaattctgaggttttttagatggtgtgatttatggggatttcttccctttttttttcttatccagaggcttaacttggaacttcttgcactatgttgaatcaaagcggtgacagcagacatctctccctgcctctgatcttagggtttctcactattaggcctttcacttgttaaaacacctacagctttttaaaatgctatttctctagttgaggtatttttccattattttcggcttgcctggagtctaccctacccctatggatatgttttgagatttgtttaatgctttttttatgtcagtttatctgatcatatttttcttctgtagcctgttgatatggtatattacattgatcgatttttgcatgtcaaaccagcaatccctggaataaatcccacttagtcagtgtaaatatctctttatatactgttggattcagttggctaatattttgttgagacttttaatgtttaagctcaagaggaagatttgaatatagtttatttgtttttgttctgtctttggtgttgctacctgggtactggccttaaaaatgagttggaaaatgatctcttctttaattttatgaaaggggctgtgtaaaattattgttaaaagccttattcaaatgttgtgtagaattcaaaagcaaaaccatttaagcctaaagactttactgggggaaagattttaaattatgacttcaatctatttaatgattatagaataatttagattaattatcctttttgattgagtttttacagtttgtagttttctgtcgaacttctgaacataaagttgtttatagtgttccacaattacctttttaatggtttcaggatttgtattaatacagcctcttttattcctaatattggtcattcgtgtcttctaatttttttgtcatttgtgctaacagtttaattttattgattcttttagaaaaccagtttctttcatttttaattgttttcctgcttttacttttacttatttcttctcctcttctgttttatttcttctacttgatttggtttccctccccactactttttaggtaggaatttagattattgatttgagattgttctgtttctaatgtaaacatttagtgttatacatttctgtcttattactgtttagctgcatcccacatgtttaatattctatatcttcatattaattgagttttatatatttttagatttcctttatcatcttgcattattttgcagtatatggcttaatttttaaggtttcagttattttcttattgtcttgttattgatatctagcttgatgcacttattgtcagagaatttcaattctttcaaatttgttgagatttatttcacggctgtggatgtggtcattcttggtgaatgcttcttgtctatttttttaaaatatgtattctgctactaatgggtaaaatatggttggttgattgtgttcttcacatcttccatatccttgctgattttctctttatcaattatatcagatattgaaagtaagatgatggaatttttgtgtttttttgtttttgagacagggtctcgttctgttacccagactggagtacagtggtgctatctcgcctcattgcaacctgcacttcctgggttcaagcgattctcctgcctcagcctcctgagtagctgggagtataggtgcatgtcaccactcctggctaatttttgtatttttttaaatagagacaaggtttcgccatgttggccaggctgatctctaactcctgacctcaggtgatatgcctgcctcggcctcccaaagtgctgggattacaagcatgagccatggcgccagaccagatgttggaatttctaactccaattatggatttgtctatttttttttcaactcttatcagtttttgcttctttagggttctgttgtttggtgaatacacatttaagattgttatgtctttctgctaaattgatgctttcatcattacacactgttgctttctgtttctagcaattttctttgttttgaaactattttttctatcactaatgctgccaattctgccatattttattaatgttcacaagctaaatattttttattttttttactcacaacctacttgtgtctttgaatagaaataagtttcttacagtcagcaaaatctgatttatctcagtagaatttactttttcttggtcagcattgaattttgagaactttgaaagataatttgcccacaaacaatggtttaatgtatacatttacatattgtaagactgagtgaattttccaaatattttaagcatttcatatattttgtattttatttccatacataatatgtgcatatttacccaaaattttatatccttgcattgtgaatctagtcaaattaaggaaagtgatgattaaatacatacagagacttgattgaccacagacatattaaagagctaatgactgcagacttagatttaatcctcctatcaaactagttaaatttacaagatgtttaagatatattcagacccataatgacacaagtgcatatttttgtttctttagggaaaggattgtcacattgccttgcaagaggcattaaggtgaaacaccactaatactgtgaatttattcaagtctggagttcttgcatcagatacgtaatctcagatatccaattttattagcaaaataaaagtggatacactttttagaagttggaacacaataacaaaacttcagagatgaattcatagaaacaggaattgaaaagactgagaatttccagagtatcaagaattctcacgtttgcatcaccatgcatttgtatatgtcacaatggcaatttactgtcatgtatcttctatcaaaagacacatgcttatgaggacaattatgaagagaataaaacacaaagaaatgagatgactcaagtgttaaatgtcatcaggccatgaaatgagaacagcattgccagtaggatcaggatactttggctatcttgtcactgaccactgaaatcaaagcattggcttatccccctgaggaagcactgacagttcattgtcatctcttcttttgtccctacatttatgaccaaaccacttctgatcaatgcattctttgtaaatagaaatagtttccatcaggtcatactattgttgtatcacccttttctcctggaaaccattgctttttttttttaaatataaaatgacttaatagcttttttttaaaaatataaaatgacttaatagcttaacactaactaaagcaatttaactttcacaaagtaaaggtaaacttaactgtagattcaaaatgctgaaaatatatgccaaagttgttatagatgtcagtgatgcccacatttacatatctcaagctctaatctcctgcagaacgtgtgttataggatgaggattcacaacacaaactctagccagactacttgagttcattttccatctatagcaacttactaattgcataactctgggaaatttagtaaccttgtcatgactctgtcttctcatatgtaaaatggtgacaatcgtggtaccagctaactctggggctattataagattaaatatggaaatacacataaagtaacctacacagtgcttggcaccaattaagaactcaatacatgttagctatttgtagaaattgtcagcatcatcacgtgtaagatgactaaaacagaagctttgattcccatattcatacttaaagatagttttgcctcatctttggaaatggcatcagctcagtttctcaggaccatgaatttgacattgatgtatctttctatacttcactcctcctttccagcagaaagctcttcattctctctctccagatcataactaaacccatctccttctgcttaccttgatggctcccaccatcactcctacatagatttgtacattcatctcctaatgaactttcccgtttgcactttttacctttgcacttccaccacaccacaatccttcatctgaaagttagaaaaagtcatctttttagacccaaatatttgctgtcaccctcaatgctgatcactgaaaacttccactgtggcctgtgtggtcatccacaatctggccctgcctacacctccaacctcatttctcctgaatatgggttcctgtggctcttgaacacatccagctctttcctatctcagggccactgcttgctctgttttttctgcctacgggctctgaccggacgtttacctcctggctccttcttataattctggttgcagctcccctgctagcttctcaaggagctgactctttacaaccatgtctgaaataccctgcaacccttgatgctcttgtccacatcaccatgttttattgtcttcagagcagttgtaaatttcatacagtatcttacatttattatttacttccctctcactggcatgttaaaatatggattcccttgtaatgttaagtgcttaggaccgtgattggcatacagtgattcctcagtaaatgtagaagaaaaaatttaagaaatataaagccataaagtgagtaattaaatatgattgagagaattccataagatttaggttttacatcaccagcttaaaatagttattcaaatatcatgagtcaataaaataatcaatttacttattggcaggtgattttcaaatgaatgaattggattatgttgcatagttaataaaatgtgatacattgaatttactgtaattaggaaatgtctttcactaatgcctggaaaaagataacgtaaagcatcatgttttttatcttatttttgtttagctgtttgcagaataaaaacaattttaattttacataacaaatatcctgaggcaagcaaatgaacaaataaaaagatgcataaataaatagaataaataaaatcgcattttaatttcaaatccaatttagtgatactgagttgctaggcatttctttggttataacctatcaaaaacattaaattctaattacatactacccttaagaaaaatatttgactctattatattttgcttttattgcatcttatagaatactataaaattcttattaaacaacttgtttcaggaaatattatagacgttttcaggatcatttcagaacatttaaccactgatccaacagaatgttatgcattttgttataagtactctggtagtttaataaaaatataggagcttaagttcttaaatatgctgtttaaccaatatggagggtatttgccaaggagggagtacatttgatgaagtatatacatacaacataaatccactaccttcctaatttactcaaggtgtagatatcttcctaggatgttttgtctagaagactaagtctatggcacctcctttcccgtgatagtttctcagcttaaaataaaccccacatcagctgggcactgtggctcacgcctgtaatcccaccactttgggaggccgaggcaggcggatcacaaggtcaggagttcgagaccagcctggccaacatggtgaaaccccgtctctactaaaaatacaaaaattagctggccatggtggcacacgcctttaatcccagctactcaggaggctgaggcaggagaatcgcttgaacctgggaggcggaggttgcggtgagctcagattgtgccattgtactccagcctgggtaacaaaagcaaaagctccatctcaaaaaaaaaaaattaagtaaaccccacatcataatagctttttcattttcttggctcttcctcccaactttactgcggtatacttgacaaataaaaattatatacatttaagatgtactgtgtggtattttgatatatatatatataaacaattaccatagtcaagctaattaacatactcatcatctcacatagtttttaaaatttgctttatttttgtagtgagaactggagtagcaactttctggaaatactgtcaatagtaatacttaggataacaacacgatgtcaagtttaaaaataattaattaaattcctttccttttctcccccctccatttttgtgcgtttgtatatctatgctatagcaatgaaaatgtttccaggcagaaatgaacgcagacattgaagtaaaaacatgtgagctcataattccttttccatgttccatgttgtaaatctgcagtgaagaataaatagaaactattttcacttcagtgtttaaaataatacaggatttaatgggaatattctaattgcatgatcttcatttatcttcacagacaattccctctgcacgttgactttgtaccgttatatctgtcgaactagctagtcaccagtggtttctaacacctactaaatgatttattgaaaaatcctcaaatggaaataaaaaacagtaaagaaaatattgtagtcttatgtggaaaactccactggaaaaaagaaggacgatgaatttgattatagcaataaatgcacaccatgaatatcattaaccatcacttattctttcgtcagttcttttcttttctttttttttgaaagacatataaagccattctgctgtcaccaacagtcatcttacatttgtcttaaatgtgccttctcttatgaaagacatcaaaggtctatgtgattttgcatttagtattgctgctgtctctctttcatttgtttgttacttttctgtgcaagcaattccaatgaacttttacaaacttgaaaacattcttatttcctacatatgtggctttttttttaccagtttatttcaaaatccaaactaataccattactttaaaaattgaactattaatttacacaccatttaactttcaattgcattctgaacctaatttaactttagatttacctttaagccattaagaagataagattagtcgaaatacaattgtaggccatatggttgtttcaggtctctccatttctgatgtgggattttattttgaatgggcttgtttacttagctcagtgtgaaattaatcggtttctcaaactacccttctagctcttacattttgttaaaccttttttagtcttccctttgacaatctgtaagttgctttcttttgaattcttttcaaaatatagttaggtagttatgactcatgtattatttttgttaggtacaaacccacagttgaccaactttctctttttgttggagtttgaggatccacaccctgattttggttgccttggctgatgtcttcagcatgagctcttgtagatgctgcttccagattcatggattgcttagggtcacccacagatgacctggaatgatgcagtgcacacagacccctgtgtctgcagtactcgggcacacagcctgctggggcctgttgcagggtctccatcaaccgttgctgcatgaatgattgcagatatctttcatgcaaattcagatttttttcttccctaaagattcctctacgtgtatttcatcatcttttcacgtccaggcacacccaaacattccagtaacaacaaaaatcagacaaaatacctaggaaagctttcaaaataaatctgagggtctcctatgaagaaaagtacaaatctttgttgaaggacataatagatgtaaaggaacagaacgcaatcagttttggtccttgatcaatgatctacatgagaatatttccatcttctcacattgcaggtttgatgcaatcctaattacaacctctgtgggattagcgggccggactgagagaggctctgggaatgttactgtcacattcatcaggcattatcctcaggcagattacccgtgcgtggtatccttgttaattgtagcttttcttgccaccggacttgtactttcttctcttcctcagtgaggagtcaaaccacagtagtcactttcctgagtgaaaaatcatttccaaggtgtttgacacaaagagatcctgaggacatttgctgtcgtctttgtttgagtactccagactcagggagctgggcttgcgctgcgggaggtaaagctggggccacacccccacccctgccagccaggacagttcctagacccttcccctgagctaggttttccagtcgcatggagcactttctcacatattccacgctactgatttatctcgcttattttctacctcttctacacaaatggatgcccaattgtggtaggattctttttctttctttctttcttttttttctgttgattcactacagtatctgtagtgcctgaaacaatccatgatatactctgtggctgctgttgaatgttgagtagatggctttgattttgcttttgctcagctgatgttaacagtccttttcccctgctgctgctgtcttgtcagtcagctccctgtgcgtcttcctaatctattcacagttacaattacttaaaacattatttttaaattgcaggttttataaagctatcatgtctgatctcttcattgcagtacattgttcttgacaaaattgaaaacaagcaaaaaatcatatcttatttatgatttacaatttatctgttttctccagacagttgataattgtcactaccacttataaacttgtatccagtaccttcctttcaaagctagatgctagggtgacagaaaaggtttataaaggaaaatgtatataaattaagtatccaagaacagaaaaagggaaatgaagtttgggctacttataggagtgaaaataaactctgtgatgtgccagcaccagcacaggctcttgtagtttcctcccaactttgggctcagtggtatcatgttggtggccagtttaggagtatttatatcacaaaatccacaagtgctgcaaatcaaggcttttctattctagaatgctggttgataaataatagcctcaacatttaccagaacactataaaacaattcagtgatcataaagttattatccacagaatatttactggcatggaaaaatgttcacaataaaaattggtgtttaaaattgtttattgcaaaaaattgtgtaatgaaatcatcttgaaaatacttgcattactaagatataaatggttctctctgggcagtgagattgggaggaatttttttttttttttttttttttttttttttttttttttgctttctctccagcagcttgacaatacagcttcacaagaagataccttttccttttaaaacccccactgtgttctccttcctcctgacttctccccagagtacccatgttgaatccctggtgtggatcccatgcttcattcctgccctgctacttgctctgctctcagcttgctgcacaatcccccacccttcctgctgggttcactaagggctctctaggcaaagcttgcccaagctgctctcctcctgcaggtctgtgctaaggccatcggactcccctggggctggttctgcatctgcagcctgtgggtgcttctgtgagcgcaagtcaggctgtgcagcaggtggtctgttcttgtcagtttcttgtcttctgaccgtttgtggggctgtattggcagtaaaacacccacgacacagagaacattcaatgtatgtttggtaaagtagtaaagaatggatgcatgtgatactaaaaatataatcattacaatagttaataaggtattttaatgcaaatcaatctttttataatattttgagaagaagaacatgttcactggggaatattaaaaacagatcttagctcagacgtgttattcaaatattgaggaaaaaataaacattatgtgagttctttccgtctttttgaaaatcgagattaaaaaaattgttcattattgtggctcccataatttaaaaaaatagcttttcttttgttattttaacttttaaaaaacgttttggaaaatgtagtgaaaacgtatcatccactaaaaactaaaagcattttgtttattcttgtgaacagatgcaatcataaattcaatctgattttttttcctcttagaaataaaaccattaaatcagatgacataaatacccatgcacctgtgaattactggtcaggccaaatgactagtttcagcatccaaattccataaaagcaagctgaatagggcttctgtgttagagatttgaaattgaaatgaaaaatcaaagcaaaaacaaaaacaaaaagaaatgatttcaattccattctgcaaagcaaaattgagtttcctggtcaggttctctattgctgcataacacagtacccacgaaagtgagtggtttaaaacagccatcattttattttatccaatcaatgtgtgggttaagaactcaggcaaggcattctcagtcaggtttctaccccatgggttgccattcttggtcaaaatgtgtccagttagtattctcacttgcaaggtgccctgttggggacggctggaggctgagcccttctcgtctccttcttcatggagggtcggacttgccacagtcatttagctgcatggttgttattcttacctggaaagttagggctccaaaggagagtgttccaggaggcagaaagtggaaactatccgtgttctaaggcctggacccataagcaggtacaatctatttactctgcactctgttggccaaggtggtcacagagattggtcagattcaagtggagatcccaactcctaagggaagaatacaaaagaatctgtggacctcattagtccatcacatatacatgaacttatttttcctgtttttgagacagagtcttgctctgtcacccaggtcggagttcagtggcatgatcatagctcactgctgccttgaaagcctaggctcaagctattctcttgcttcaacctcctaaagtagctaagactaagtctttttaattttgttcagagatggggtcttgttatttttcccagactcacaaacttgttctaagatataacaagattaaatatatatatgcatatatatgtgtgtgtgtgtattatatacgtatacatatacatatacatatttatttatttttgagtggaattttgctttttttgcccaggctggagtgcaatggcgcaatcttggctcactgaaacctccacttcccaggttcaagagattctcctgcctcggcctcacgagtagctgggattataggctcacaccaccatgcccagctaattttgtatttttagtagagacagggtttcaccatgttggccaggctgatctcaaattcctgacctcagatgatccgcctgcctcggcctcccaaagtgctggggttacaggcatgagccaccactcccagcttaaaatatgtatattttgatagagaacatactagtactaaaaaaaaaaaaacctaagattaattatgcaacaataaaaagtttcagttgatacatttttgccatccaatagagataagcatcaggaataaaatataaaaatgttaagagctgattcatattttgttcttttccattaaagaatactattttcttgctattatattgttcctagaaatttaaattatcaaaatacagcaaaatgaaccccccagtgtgattggtaccaactcattcttgaatgcatttttgaaagtcaaatatcagaaaattaaatagcagattacaatttagtattatggctaagaccttgagcttttaattcagacagacatggatctatttgccttggacaagtaatatgtttcttggacaagtaatatatgaagtatgatggttcactgtgatagctagaggaaaaatagtaactgctatagagagttgtttattattaaatgagaatacatatgaatgacttaacatagtgctgagacatataggtatccaataagtaatattatttttatgagtgatacagagtggttctattccattttacacgttataaaattgaatatgagttattctttaggaggaagacactaaataaacattaaaaaattctaaattatggcttatacagttaatacttgcctgagctcaggcgttttaaccagaaacataataatagaaatccaagcatcttccctttcatgagttaactgcctacattagttttgtagagctgctgtaacaaagtaaatataatactttattgttaataaagttaattcagtgagaaacatcatacttttatcttgaagtacttgaagatgatgtacactcttagaagagttatgtgggaggaaatctgatcatctctaaaactaaaatagcaaagctaacattaatacaggcatacctcagggatatcatgggttcagttctagaccacagcaataaggtgaatattgtaataaagtgaatcacacaaatattttagtttcctagtgcatattccggtttaactgcagtgtactaagtgtacaataaaattatgtctaaaaacaatgtacataatttaaaattatttataactaaaaaatgctcacagtcatttgagccttcagtgagttataacatttataccagtggagggtcaggcctccatattgatggctgctgactagtcaggatggtggttcctaaaggctggggtgggtggggcaattttctaaaatgagacaacactgaagcttgctgcatcagttgattgttcctttcatgaaagattactctgtagcatgcaattctgtttgatggcactttaccatcagcagaacttttaaagttggaaacaccctctcaaaccctgtcactaattatcaaacaagttgatacaatattctaaaccacttgttgtcattttaaccatgttctattcaccaggaatagattccatcttgagaaaccacacttttttgctcatccataagaagcaactcctcatacattcaagttttatcatgagctcaataattcagcaattcatacatcttcatgctctacttctaattctagttctcttgttatttccatcacatttacacttacttcctccattgaagtctttaacccctcaaagtcatcatgaggcttggaatctacttcttccaaactcctgacattgttgaaattttgacctcctctcatgagttctgaatgttattaatgacatttggaatgatgcatttttccaggttttcaatttactttgccaaaatccagcagaagaatcactatagccttagaaattgtattttggaaattataataccagcaactcaaaattactctttgatccatgagctgagaaatggatgttgtgttaacaggtatggaaaaaacattaatctccttgtatgtctgcctcacagctcttgggtattcacgtgcattatcaatagcagtctgcttttgaaagaaattttttgaaagagattttttaattttaatttttttctgagaagcaggtcttaacagtgggcttaaaatatttagtggaccatactgtcaactgatatggtgttgtccggctttgttgttccatttctagagcacaagcatactagatttcgcatccttcttaagggccctaggattttcagaatggtaagtgaacgttagcttcaacttaaagtcattagctgaatgagcccctaacaatagagtcagttagagactactcatctctagttatgaaagtcctagatgacttcttcttccaatataaggctgttttgtctacatcaaaaatctgttgtttagtgtaaccaccttcatcacttaccttagctagatcttctagataacttgttactttttctccatcagtacttttatgttatgatgatgacttcttttcttaaacctcatgaatcagcacctgctagcttcaaattttcttctgtagcttcctcacctcactcagccttcatagaattgagagttatggccttgctgtggattaggcattggtttaagaagagttgtggctggtttgatcttctaactatctagatcactaaaactttcttcatatcagcaactgtagagttactaacttacctaatttcaatattgttgtggctttggatcagggaggtccgagtagagtgagagagatagagaaacagctagttgttggaacagtcaaaacatacacatttatcaattaagtttgaagttgtatatggtcgtgatttgtgccaccccaaaataattattatagtaacattaaagataactggtaacagatcaccacaacataataataatgaaaaagttaatattgctagaattaccaaaatactgagaggtgaccgtgctggcagcccttgctcactctcagtgcctccttggcctaggtgcccactctggccgcacttgaggagcccttcagcccactgctgcactgtgggagccactctctgggctggccaaagccagagccaactccctctgcttgcgagggagtggggaaggacaggtacctgagggaaccggggctgtgccccggccgcactcgcggcgcacgcgagttcggggtgggcatcctctccacagaccccacacttggagcggcctgccggcgccactggccccaggcagtgaggggcttagcacctaggccagcagctgcagagggtacactgggtcccccagcactgccggccgcccacactgcccccatattttcaccaggcctcagccgcctccctgaaaagtaggactcagggcctgcagcctgccatgcccgagcctctccgcctcccccctgtgggctcctgggcagccggagcctccccaatgggagctgtcccctgctctgtggtgcccagtcccatcgaccgcccaggggctgagcagtgcaggcctgcccgtgggactgactgactggcggcccctgggtgggatccactaggcaaagccagcaaggctcctgagtcgggaggagacttggagaacttttatgtctggctggaggattgtatatgcaccaatcagcactctgtgtctagctctgggttcatgtatgcaccaatcagcactctgtgtctagctaatctggtggagacttggagaacttttgtgtctaactcagggattgtaaacgcattaatcagcaccccgtcaaaacggaccaatcagctttctgtaaaatggaccaatcagcaggatgtgggtggggccagataagggaataaaagcaggctgccagagccagcagtggcaacacgttggggcctgcttcctacgctgtggagctttgttctttcagtaaatcttgctgctgctcactctttgggtccgtactgcctttatgagctgtaacactcactgggaaggtctgcagcttttctcctgaggccagcaagaccacgaaccccctgggaggaatgaacaactccagacgcgccgccttaagagctataacactcaacacgaaggtctgcaacttcattcttgaagccagcgagaccaggaacccaccagaaggaagaaactccgaacacgtcagaacatcagaaggaacaaactccggacatgccacctttaagaactgtaacactcaccacaagggtctgcagcttcattcttgaagtcagtgagaccaagaaaccaccccttccagacacaacataacagatcatacaaggtgcaaattgaccacaaatcttcaatttgtaaaaaatccaatatctgtaaagtgcaatcaagcgaagtgtagtaaaatgaggtaaacctgtggaagcttgatggatagagccttagaaattttccattaagccaaaaggttggcattgatgtgagcttgagccagcaaattccacatgctaatttagttgaggtcaagccctttttctcagtcatacatctggcaaggattgttctttaggtaacatactgaaagaaacaaaaacaaaaaaaaacctgaattcttttgtgagttggtttatgagtattaatagtatgttagtatactattaatgtttaaggttggacaatgtaggttctataaaaatgtatgaattccaatgcaatgaattggtccagaataaaattgtttctttccaagaagaaccattttgagtggactataaaatatgaccacaaaattatattaccttgattactattaaaatgaaaaactgcttaggataaatacaaatcaagagatagaagctaatatatatttaggcctaaatattccgtcgtaaaaatatgaaaattctcaggtgtctaaataggtatttcagatctttctcttggtttttatcttatatatgtaggcaccttatttttctatgtaaattatagtaattaagctttcatatactcctaaggtacaaaatgttgagttccttggaaaaaaataactttgcaataatcattataaattataccactgcattatttataatgtataccgtatttagaagtttaaatgagtggtaactcaggagatatccagaactttattttagtgtgtttttaaaaaacatttaagtagatttaagttaaaattatgactagccaaagccaatctaaatgggtaaaatacaaaacaggaagtatagttgtcagtgacacaaacttttcaatttcagtacaatggatactatttttcaaagtgcaaagaaacatcaaaattaggtgactgtcttttctgcctctggcttaacgttctatatttactcctggatgtttggtttggtggcttttgtagattgacagactgcaaatgcacaacacaacatccaactgcatattttggctacaaagtagttagatacagaaatgatgaattcgatattcaatttggcagttttgtgtagaattattcttacattttttctttattccttccaaatctggttggcagatattttgactatcatgaagggcaggataactaaagaaacattttctggcacatatctggcatgtagatcattttaccccttcataattttctagtattattatacaggatattactaagagctaaatactttatcttcttcagagcaataattttttctgtttttctctttgaggataacactgaattcaaatcagtttagttttctgacacataatcactcatattatggttattaagcattatttaatagaacattctgagatatatatagtcaatatttgtctaatttgtgcattttaaaagctttaagctataatttgtgtaagataaaattcacccattgcaacagataagttgtaattttttagcaatttatactattgtccaaccatcatcaaccatcattagaactaaattttagatcacttccatcatcctaaagtgcttgcttgtacccctttggagacaattactgcttccaacaccagttattttggtgtgtgtccaagaatctttgcctaaatgaatatcataaagactttcttgtgtgtgtaagcacatgtatgcatgtgtgtctgtgtgtgtatgcatatgttttaaagttttatagttccaactcttacctttaggtctttgattaaattgagttggtatttttatggtgtgaaataatggcctaaatgtgtgatgtgtgtatttatgtatgtgtgtgtgtgcatttgtaattacatctatatgtacatatatggatatagatatagtatccaattaagggactttcccaatttaattgtcatgtcatgtttgttgaaaatcacctaaaaataaatgtgaaaccttactgctgaactaccagttcagttccattggtttatatgttgtctttagagaatacaacactatcttgatttctgtaagataataagtttcaacactgtataaggtacatcttccaccttttcttttcatttcaaaattattttggcaattctagttcctttgcatttacactttatgttcagtttgtcaatttctatgataaatgacagttaggcttttatagagattccattgaatctatatatacatttgcagagaattgccttcttcccggcattccatgaccatggaatatttctgtatttcttttgatcttctgtactccttcttagcaatgtttggtacatttcagtatataagtttgcatccattttgttaattttattcttagatacattataattttgtttgctgttgtgaatgagatttttttctttttttacatttatttttattttactttaagttctgggatacacctgctgagcatgcaggtttattacataggtaaacatgtgccatggtggtttgctgcacttatcaatctgtcatcttggttttaagccctgcgtgcattaggtatttgtcctaatgctctcctttctctagccccccaaccctcgacaggccccagcgtgtgatattcccttccctgtgtccatgtgttctcattgctcaactcccacttgggagtgagaaaatgcagtttttggttttctgttcctgtgttagtttgctaaggatgatggtttccagcttcttccatgtccctgcaaaggacatgaactcattttttatggctgcatagtattccatggtgtatatgtgccacatttctttatcccatctatcattgatgagcatttgggttggttccaagtctttgctattgtaaatagtgctgcaataaacatacatgtgcatgtgtctttatagtagattgatttataatcctttgggtatacacccagtaatgggattggtgggtctaatagtatttctggttttagaaccttgaggaatcgccacactatgttccacaatggttgaactaatttacactcccaccaacaatgtaaaagcattcctgttcctgcacagcctcaccagcatctgttgtttccagactttttaacgatcgccattctaactggtgtgagacagtatctcattgcggtcttgatttgcatttctctaatgaccagtgataatcagctttttttcaaatgtttgttggccacataaatatcttcttttgggaaatgtctgttcatatcctttgcccactttttgatggggttgtttgtttttttttttcttgtaaatttgtttaagttccttgtagattctggatattagacctttgtcagatgggtagattgcaaacattttctctccttctgtaggttgcctgttcactctgatgctagtttcttttgctgagcagaagctctttagtttaattagatcccatttgtcaattttggcttttgttccaattgcttttgagattttagtcctgaagtctttgctcatgcctatgtcctaagtggtattgcctaggttttcttctacagtttttatggttttaggttttgcatttcagtctttaatcaatcttgggttaatttttgtataagtataagaaaggggtccagtttctgttttctccatatggctagccagttttcccagcatgatttattaaatagggaatccttttcccattgcttgttgaagatcagatggttgtagatgtgtggtgttatttctgaggcttctgttctattccattggtctatatatctgttttggtattagtactatgctgttttggttactgtagccttgtagtatagtttgaagtcaggtagtgtgatacctccaactttgttctttttgcttaggattgtcttggccacatgggcttgtttttctaatttcattttctaatggcctttgctgtaatataaaaacacaatgtatatttatggtgatctttaacttgtgactttacaaaacttgtttatgaattataaaagttttattgtggttccatactattttctatgtttttatgatatacagacacatttatcattatgagatgtccttctcatcgctgtactatttcttgtcttaaaatctattttgtctgttattgataaaactaggcaaattctctgatggatacagttttagagtataccatatgctatccttttaatttcaatctttttatgtccttgagtataagatgtgttttttgttgatgatataaaattgtatcttacatttttatcaagactgatgatatatgccccattaatagaaggtttagcacattcacatttaaacttgttattattatgtgttgtctgtcatttgctactttttaaacagttgtgtcttttcagttcctgtttctcctttactggctccttttgtaccaaataagtattttcagtgtgccattttaatttctgtttatttttgctgtattattttgagttattttattagtgttggtttatgttaggggttggcaaacatttttgtaaagatagcaaatattttaaactttttgggttacatgatctttgctgcaactgatcaatttgttattgtagtatgaaagctgacacagccaatatgcaaatgaggaactaagtctgtttttcaataaaaatgtacctgcaatcagttagcagcccagttttatctatgagtgatagcttatccactcaagttctgggcattacattgggtatattaacttgttcaatttacttcagaattataattgcttattctaataaaatatatcaattttgctccaacttattttcttttcttcctacctcttttgtgctaatattgtcatatatatctatatgttataaactccaattacagtgtcatgattatctatgtataatatctatatttaataagttaataaaagatagagaaaacatttatagaatctttcatgtatgcccacatatttaccatttgtgacacttttaattttttctgtcaacttgaattcagggctgctagcaacagtttttttccaaaaatatttatattttgccttcatttttaagttttgctggttataaaattctttgttgacaaatattttctgccataatttttttgtctgttatttctaataagtcaagcaataatcatgttgtatatgattggtcatttatctctagcctttaccaagtttactcactttttggctttcagtagttagactactatgtgtagatgtgttatctctttgtctttattccgtttggcatttatcaggtctcttaaatctataggttaaaattttccataaaattgagacattttcaattattattttttcctgtactatttttctgtccctttcactttctcctcttcttcctgtggtgtcatttcatgtatgttgctatgcatcatatatggtgtcttcccacaggtgtctgaaggcctgttcacttcgttttttttgtttttgtttttgtttttgtttggtattttttagatggagtctctctctgtcacccaggctggagtgcagtggtgctatcttggctcactgcaacctctgcctcccgagttcaagtgattcttctgcctcagccttctgaatagctgggactacaggctcatgccaccacatccgactaattttgtatttttagtagagaggaggtttcaccatgttggccaggatggtctcaatctcttgacctcgagatccactcacctcagcctgccaaagtgctaggattacaggcgtgagccattgcacccagcctattcactttgatttaatcttctttctccctgtgcattagactggaaaattaattttgttatatcatcaagttcattgattctttcttctcctatctcaaatcttatgctaaactcctctaaataattcatttttgttattgtccattttaactccagaatttaaatttgatttattttttcttaataatgcctatgaatattgagttcctctatgtggtgagaaattttcattgtactttccattaattatttagctatgattttctttagttatttgaatatatttataatagctgccttgaagtctttgctgaattccacatttgttgacagagacaaaaatctatagactttaaaaatttttgctaaatattggttacactcttgtttctttttacttttatgcacaataatgagcattttgataatgtatgttgtaattctagattctgacttttccacagtatgtttttgttgtcttgtttggttgtttatataacttgcctggacaaagtttgtgaagtctttcttcctgaaatatgtgcctgtttatttatctgctcctattttttcttcttgtttttatttttaagtctggcttcctacgtaactggtcatcttaagagtgggttcatcttaagagcggtaaaagaatgtgctcaaagactttgagccagtaaacttcctattccctgatgatgaatttatgaatgtcctggagaaagtttttaaatctcaggccattttaaagcttccctggcttttacctccaataggccctttcatgcctcctccacacatgcatttaggcttcttttgccaagaatgtttggatgccttagcacccctctactctctgctggacacacacagtgactcccatcaatcagggatatgtggctagcttaagtcttcctttgactatctgacttctacagctccctattacatcccgtgctactcctacagttcattgtttgccccaactacgacctcaatctcaggctaatggagccactgacctcttttttcaattgccactgagatttccagtttaatgtataatactcccaatgaagtgagtcctttctgacaataggtgtaaagctgctggttttcatatccttccaatttgggttaaactactatgccaacagaactgagggagtcctgggactagtgtggatgaagcaatcacagactgttaggcaagatttttaactattcttagctgaaattcagtagtctcaataaattaatgtttcttagttggttttatgacttttgttaaatcccagagctctaaaactgctgatttgaccgtttgttcaattttgcagttgatttttgaggggaagatttgtcaagctcctcaagccaagagtcagaacaacatttttatataaatgcttatataaaaagctaaagagacttagataattctttacaaatacattgctcaataattgaagtcaattttgcacccataaattatcttgtgatggatacatttaatcaaatgcagaaaatataagcaaagccttttaattaaagaaagggcttctagtaaaacagaaagcaactggaaatctgtgaacttcattatttacatgcacattcagtttttaagcttgtgaattttatataaagcaaaatattttttcactaacagaattctgttaatcagaaatagtgtatgatacatataagctataagataatgcaagcaactacttcaagcattcatttttttggaatgttaatatcccttgtggtggtgtgctaacacagatatgtatctgtgttgtgatatagtcctgtttcctgagaaaatattaactgctaaagtggtgggattatgtttgcttatacttttcatttgttcatttcatcatgccttctgactatccagtcagtaattttgcaacatttgagtattattcaaaattatgaatcttcagttatacaaataatatcaaatggttttcttattctgcaatttctaggaaaaccagaaaagccttaatttgttgatgtaactttaatttagaacctctttcaattctgagttcttcattcttttagcattaaacacacaaattattttattgctatagccattctaaatgtaatagatactccaaaagccatctctaaaagacacctctcacactaagtggttcatgtcgggggaaatgttgtgctaaatagtgtatgctagaaaatatttaagtaaactgtaaaactggccaggcgcagtggctcacgcctgtaatcccagctccttgggaagccgaggcaggaagatcacgaggtcaagagatcaaggccttcctggccaacatggtgaaaccccatctctaaaaaaaaacacaaagattagcctggcatggtagtgggcacctgtagtcccagctactggggaagctgaggcagagaattgcttgaatcctgaaggcggaggttgcagtgagcctaggtcacaccactgcactccagcctggtgacagagtgagactccatctcaaaaaaaataaaataaaaaaaagtagactgtaaaactaattttttgactaaaatttagatgaccaaaatctatatgacctcagataagtcatttgcaggtccttggtttatttcatgacttagatgagagtaaactattgtgctataacatctaaaatcacaaactgtaaacatctctctcattgcaatatgttacatgtgctatggcttaaatgtctctgaaaaaactcatgttgaaatttaattgccattgtaacaccataaagaggtggggtctttaagatgtgattaggtcacaagggctctgcccacatgaatggattaatgctgttattgtgggagtgtgttagttattgcaggagttcagcctcttttttctatctctagggcttgcttgcccttctgacattttatgacacagcaagaaggccttcaccagatgtggccacttgatcttgggctttccagacttcagaacttctgtttttcataaattatccagtctatggtattctgttatagcagcagacaagaaacaaaaacaacatgtttgtaactacaattaatgatgaacatgtttgtagtttaagtgcactcttaagttagatgatgcaagagcaggaagctggtatgctttgtcttctccaggtaatcctatctgtccatgttagaaagtaattatggaagaatttagataaagcctcttttatttacttttattttaaattctaggatattaagaatatagagaaaatgtgtgcaagtcagaacaaacaatttagagcaccaagtctttatagaaaaattcatcagtaactgacaactccatagcagcatctacactctcctttttaaatgtcacaattcacaaaactgacttccttctttcttctcttccttctatactatatagttagtaccagaatgcctttataggcatgggtaggcagtcctggataatgcaaacaaaatatttttctcatgtactttacattcttctgagcaagtcaagagcttaaggatttgaagatcaaagataaggctctatgcacagtgtaaccagcatcctcatagtatcatcaagccctcaggttctttctgtctctactcctctagtgttaatttcattcttaggctggtctcctcattgtcacatttagtagacaatctgtgctgcagtctgcactgcatgcctgttcatattcagcaggatataaagtaatcctgacctggagcctagaatgtaaatcattatttttcatctgattagctcattaattcatccaccaaaccctggaacagtaaacatctttgggaactccacatgctctcacaatttctctcatccatggctgtactttagggtttggaaaactcttataacacacactgatgcccaagccttgtgttggaccactgaaatcggaatctctgacactggggccttgtcaatggtatcttttataggttccacattttctgccggcctgaggactgctggcgtagcacaatgaggatttacttttttgtcttatgatgagttcatacccagattaaactggaattctctgagagaaagaaaaaaaaaaggatcgatttggggtagcaaccaactatgtccatacaagctttcatgattttcttgagggttaaaacaaatgtggaacactgtgcagcagaagaaaaattcagagagacaattgggccacataggggactacagagagctgcatctgatgtttgagttatatcttaaggaattaacaggaattccctacatgactgttaggcatcatcacaattttagtgttgttttttctctctgatggaagtgtggagacaaccatgggtacagaggaagaagttggaggcagggagaccatttggaagctataattgagtaaacttcattaggaaggattatggactgaattaatttagaaaaatggaatctaggcacaaggccacagaagggatatgtagaaaaagggtcaatatgatgtaataatcaattagtgttgccctgcatgatgagggagataattttttaggctgatggccagttttctgcttgaaaggtcagatgaatgtctgtatcatttatagagataggaaataccaggggaaggacaggcttgggagataatgtcatgggttatgtttgaagggcctgaggcatgggaggctgtgcctaagatacaagagaatggcaattttgggaatcaactgaatgttcataactagagacatggatttctgtgttgtttgcaagaggtggttgaaaatatggtcttagtgaccatcagtggaaggaaacaaaccaaaaactcaccttattttaaaaagattataagcctattatatattgtgtaaagtactgaagggttagaatatctgcttaaaaagcaccaatagcaaacttgtaggcagctgcagcagtgaaataaaggttttttaaacattggaaacggacattgttttcagaacattctttttgaagatcagcatgtattgtggtattcacacttctaaggcaaggtcattgttcttttatttgtttcacacagaagtcagcttcaaggtcttgtcaggattaagagtaccttcagcttgaggtattacaccattatgttccagatagtttttgtgaaataagtgagagattatcatgtctattttttaacagccctctgtgattgatcttttctgaataagacatggtttagaaagactcaagaatctctggtttgttttcagcttcttcttttagagatataataaggtctctcagttgtaatgtcgtcgggatttgaacttcccctgaaagggtcaagtttgtcttcgattgtaacaagactagtgctcaattacccctcggctttggtatctcaaatagagagcttccacagttccagagcagctgaaactcttagtcatgtggtttactattttatgatgccatgtataaatatttgtttcaataatgtcaagcctctttacacagtgtcaaaatcatgctaaaatgttccaccttttcttgcatacctcttcctacatttctcttttgtttctaaaatattttaggtgctttcatgggaaaaatatccttacatagccaaaccatataatagtctataaatatattctacttagttctgtgtgtatgcttaatcaaagcataaacttaataactttccttatttcaaagtatatgaggataatagtgttattaacctttaaatgtaaacaattagacagacaactatgggcagtcctgttatacttttaaaagtatttagaatttattttatttattttttatttatttattttttattatactttaagttttagggtacatgtgcacattgtgcaggttagttacatatgtatacatgtgccatgctggtgcgctgcacccactaactcgtcatctagcattaggtatatctcccaatgttatccctcccccctccccccaccccaccacagtccccagagtgtgatattccccttcctgtgtccatgtgatctcattgttcaattcccacctatgagtgagaatatgcggtgtttggttttttgttcttgtgatagtttactgagaatgatgatttccaatttcatccatgtccctacaaaggacacgaactcatcattttttatggctgcatagtattccatggcgtatatgtgccacattttcttaatccagtgtatcattgttggacatttgggttggttccaagtctttgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccattgtctcagcccaaaatctccttaagctgataagcaacttcagcaaagtctcaggatacaaaatcaatgcacaaaaatcacaagcattcttatacaccaacaacagagaaacagagagccaaatcatgagtgaactcccattcacaattgcttcaaagagaataaaatacctaggaatccaacttacaagggatgtgaaggacctcttcaaggagaactacaaaccactgctcaaggaaataacagaggatacaaacaaatggaagaacattccatgctcatgggtaggaagaatcaatatcgtgaaaatggccatactgcccaaggtaatttacagattcaatgctatccccatcaggctaccaatgactttcttcacagaattggaaaaaactactttaaagttcatatggaaccaaaaaagagcccgcatggccaagtcaatcctaagccaaaagaacaaagctggaggcatcacactacctgacttcaaactatactacaaggctacagtaaccaaaacagcatggtactggtaccaaaacagagatgtagatcaatggaacagaacagagccctcagaaataacgccgcatatctacaactatctgatctttgacaaacctgacaaaaacaagcaatggggaaaggattccctatttaataaatggggctgggaaaactggctagccatatgtagaaagctgaaactggatcccttccttacaccttatacaagaattaattcaagatggattaaagatttaaacgttagacctaaaaccataaaaaccctagaagaaaacctaggcattaccattcaggacataggcatgggcaaggacttcatgtctaaaacaccaaaagcaatggcaacaaaagccaaaattgacaaatgggatctaattaaactaaagagcttctgcatagcaaaagaaactaccatcagagtgaacaggcaacctacaaaatgggagaaaatttttgcaacctactcacctgacaaagggctaatatccagaatctacaatgaactcaaacaaatttacaagaaaaaaacaaacaaccccatcaaaaagtgggcgaaagacatgaacagacacttctcaaaagaagacatttatgcagccaaaaaacacatgaaaagatgctcatcatcactggccatcagagaaatacaaatcaaaaccacaatgagataccatctcacaccagttagaatggcaatcattaaaaagtcaggaaacaacaggtgctggagaggatgtggagaaataggaacacttttacactgtcggtgggactgtaaactagttcaaccattgtggaagtcagtgtggcgattcctcagggatctagaactagaaataccatttgacccagccatcccattactgggtatatacccaaatgactataaatcatgctgctataaagacacatgcacacgaatgtttattgcggcattattcacaatataatttattttagaagagaaaatttctataggatcactcccagggctagggccgtaagagtgtcgtcttcaagtaacacatagaaattaaacacagcatttcagagccaaataaattaagtaaacatcaattaattgtataccagtcctctgctttttcttcttaaatattataaaatctttgagcaaagtttcaaatttcattagttttctatattactcaggctgtttcacttgcaagtgacaaaatccagttgtaaattggcttaaataaaaggggaattggttggctcacgacttgtaaccgaagaggtaaggatagagctgggtctatgcccatcttaagtgggggactcagaagacatccctggatgcagtttctctcactttgtttctcttctctttctctggattggttttcatgcaagacaggctttcccttcatggtggtaagatagcttcagtcctgtgttctcacaaaatcaaagagcagcagatttagaaagattcatctgcagaaggttctctagaagtcttgatactcattctggaatcaccagctcaggtcaaggtctatataactctttaagttattagcttggccgggtgaagacaatgagctaattgggtcctgtacactaactttggaacccagtgctccccttctctcagattatactgaatgggaatcaaaaacgagtgtgtgatccaaaaatatcaagggctgctgacaaaagcagggaagatgggtacttgggcagacaatacaatcaggaagagccattatatctctgcacatgttgtactagttagaacctgagacacaaagaaacagacagcatatgaataaaatgcattgaaggtaggaaaagaaatagaagaatgaaaagatagcttttctgaaattaaggccacaatggggcccttgttaaaattatgcttttggaaaatttatatagaaaggactagtttactacttttaaaaatgctggaagatggtaaagagatgaggagtgctcacaagaatcttaatggaccaaaaatatgttttcaagatgaattcttactttcccatgaataggaataaacatagtggcatagataattaaaatatttggtaataaaaatatattttttcttaatttggagcaagagaaaatgagattatctatttttcttttttcttatttatatttaaggtgtaaagcatgatgttttgatatacttacacgtggtaaaatgattactacagtcaaggaaatttacataacggtctcgaatttctcttcctttttttttctttttaatgtttgtgcgtgtggtaagagcacctgaaatctactcttttagcaaacttccagtatataatacagtattactaatcatagtcaccattctgtacattaagtctctagattattcaccctacataacttcattgagaaacatcttctcatgatctgcaactcccaatccctggttatcatcattccactactctgtttttatgtcattaacttttttagttccatgcataagtgagatcatgcagcattgtctttctgtgcctggtttatttcagtaaataatgtcctccaggttcatctgtgttgtctaaaatggtaagattttcttatttttaaaatttgaataatatttcactgtgtgtgtgtgtatgtatcatgattctatatttcataagtatatttcacctaaggtgttgtttatgtttttcttgagaataacctgcctgatgatatccctgaagaatggtcaatgagaagttttgtgtaatccataagcaggataataaacagataaaaaactttttaaatttaatttttttttctcctatttgatggtctgtagaagtcccacataattttaattaaaatgtcagatttaatctgagtaaactacagtatgttaggacttctgctgagtgagatagcaatgacaaaatataaaatctgtcacctgggaacgcccagtctaaaaaaaacaaaaaccaaaaactcaaaccaataaaacccttcttttcccacttcgtattctaaggaaaatataatgcctttatttattgtatgccactgaatgagattataattaataattgacttgcatcaggtttgctgttttgtgtcctttagttttctgatggcagaagcctggcccatctggttaagctccccgttcctggaaggaggacatagcagggacttcatacgtggggatgaatcaatgtcaaatgaggaaaaatacaaagaccttaattagatggtcattgctatcagtggacatgttgtgaaaaacctaaatacatcagatttgggaggtttttgagagccactgaggcagctatcaaaatgctcttccagtctcttcctttaggaaggccgtgtttccgtactctgaagtctacagatgtgtttgctcaaaaaccacatttcccatgggccacacccaacctgactgaccggcaggaatgataacaggcagatccatttctggaaaacttgggtgggatttggcgcacacctgattttggcttcaggactccctgatatccttgctgaactttcttcagcttaaatagctacttaggacacttccaccccattttccctctcttcttcactcagagtcagccttgcatcatggattttctagacttcttaggcttcttcttcattttctttcacaggtatttccctaatataattcttgcacattgaatcacatcttagcatttgcttctcaggagactatgactatcacaaccatgttacactgacaaacagttttaatattattcgacagtctctgtggagtacaatgttgctgtgctagattctagtaatgcaaagataagaaagacaacactcccaataaaacatactgtattgggagagagtgtaattcaatacagtaaaagtattataatttacattctatggatttatcccaaaaggaaagcactgtggctggtggtaagacaccagtggatctcgttgaaggagaattctcaagagcaaataatattaacacccatctgtgtagagctagccatgagaagcattgattctagttgtggagcacatatacccaatgatgagattcatatgtgggtggacagtcattgttaatgattccacctaaggaagggtttgccaaaccctaccatactctaaagtaattctcaaacattaatatacatatccaaatgacctggaggtctcattaaaactcagtaagtttaatataaggcctgggaccatatattttctttcaattacaatcttactgagatataattgatatactgtaacaatcatccattaaagtgtacaattcagtggtttttagcatgttcacaatcacatagacatcatcattacctaatattataatatatttatcacacagaccacattttttatatcaaggtgcaaaagggctggcatactcaccagtaattagcaccaaataacactagccactcctgagtggtttctgtgaagccaagtgaaatagcaaccaaaattccatgtggatttcattttagggctggactagaacttcattcctgcctgaagttctttcctacagagtccctggagaaaacatcaggcacaaagatgttatgccatgaaagaatatggtcccttgtaagacctacgagatgctaagtattataaaatttagttataaagtataggggcagttggctaaggtaaagaagtagactgttaaaaaattgtgaaaagtccacatccatggaggagtttgggattttatctgaaggtagtgaaaagccatcaagcaagattaaaccataaagagacatgggataggaagatgaatacagtgttgtgaggtttcagaagaaagatgtgaaagaaatagcagattcaaataaaactgaagattctagtgtggttaacttgagaagataatgaggacattacttgagatagacagaacaaagaaaaaggaaaagccatctgtctatgtgtttggttttcatttatgtatatattttaggatgcagttggagtatgaggcagtatgcggcttgaagatactgatgtctgagtcttgtggaggtgtttgctgaaattatatgtgtgtttgggagtgtgcagggagggtaggaagaagtagataagtagcactgaggacacatcaacacttcaagagtgaacagaggtagaaaagtgtgtaaagaaatgagagattattgtgctaagggaaagaagatggaactgaactgtcaaaccaattcagggaaaaaagttaacaggaaggcttacttatttacaaataagcaaatttactgtttataaatttagtaatgtatgcaaagggcttctgtgcagcaaaagaaactatcaagagaggaaacacacagtcttcaaaatggaggaaaatacttgcaagttatatgtctgacaaaggtctaatatccaaaatctataaggaacctaaagaaatcaacaagcaaaaaacaaacaaccctattaaaaaatgagcaatggatatgaacagatacttctcaaaagaagacatacatgtggccaataagcatatgaaaaaaaatgctccacatcactaatcatagagaaatgcaaatcaaatcaacagtgagatgccttcacaccaaatcagaatggctatgaaagagtcaaaaaaataacagatacatgttgcagagacaagggaacacttataatgttggtaggagtagtggaaagcagtttggagatttctcaaaggatttaaaacagaactgctattggacccagcaatctcattactgggtatatacgcagaggaatataaatctttctaccaaaaaggacacatgcactcctatgttcattgcagcactattcatgatagcaaagacatggaatcagcctatctgcccatcaatggtaaactggataaagaaaatgtggcacatatacaccatagactattacatagccatagaaaagaagaaaatcttgtcctttgcaacatggttgcagctggaggacattatcctaagcaagctaatgcagaaacagaaaaccaaataccgcatattctcacttacaaatgacagttaaacgttgaatacacatagacaaaaagacgggagcaataaacgtcagggtctacttcagggtggaaagtgggaggacagtgagggttgaaaaactgcttgttgggtactatgctcactacctgggtgatgtgatcatttgcacaccaaaccccagcaatgcataatttacccacataacaaacctgcacacatacccccaaacctacaataaaagttgagaaagaagaaaaaagaaatctagtagtttaaggactgaaacctttctgtggatgtgatctctgcaagcatttagatatgtgaatgacagaaacagtctcagcgttgctcaaaatgaagaaagtcattctggacagtactgaggtcaggtggcctattgaggaaaaggtaaaagtctgccagttatacagtggattttatatacaatagatttttatacaagcacatttcataatgaaatccacataagatatgatcctgtttttttttctgtgtgcaaaaccagaaggcagaaagttgtagctatgcaggttactactgtgtacaattgtgacatgcccttaatattcagaaaagaatgtacagaaatgttgtactagaatatgtttgtttgctttgtttatttcttttaaagtgcctttaaatacaggtaaaaaaatgtggaaaaaaactgaagaaagatgtggattttgtttgtttttttagaatctctcctttgtggtcagtttttctttactggtgctttttttcaaattctccaaagtgagcacaagcctatttctaacatttttgttgataaacaaaatacctaaaatatgaaattattttgaaatgtgaaaattatcagaacattttaaattattatcttaattattattacctgaatctaaaaaaaaaattccatgaatgacaaacatttttaaggtcaatagagccccaatctagtaaatgctaaaacctggaaattgcactgtaatatattttaccattttaaatctttataatgatgtgcaatttggttttgtttcctctccaaggtcagatggctaaaaactggcaaatcccaagactaggattcaatttccatcaatgtcaatatccattccacacaaccacccttcttgacagtattgaatttgaggattaggtgaaaggggatagataaacaataacgtaatacaattgtggaagagttcagcactttttaaattacaatagttcaaatttgtttcattgatttttttggctaaggtgtaactctggaaatcttggagcttctgcaaaacataaagaaacttattggatagaagtggcgagtataattgtgaaggaggcgatggggaatttgtcagtgtaaacgatgacatccaaatgaatctacccttgaagtaaataaaggctttccttgagttcacaatacaattattgtaatcttgctgaaaactgaattgtggagtaatatgttttcaagtgaaggggcagtttatatatttctctgttcataatattacctactgtcaatgggaatcataaaatgtgcaccaaaaggtggcaagatataacatatttctgaactaaaataggagatacatattgcaaagtagggactttttccagaaagaatagcttcatgtaagtttgtctttgtttttagaacagctcacaaaaatttggtaagattatccacaaaagttatgaatgagctatcttaatgtttttatgccaaagtagtcattcaggatataagtgaattaatacattctgcaagtatttggatctgagtatgaaaaaaatagtagtagtgttactcaaaaagtagcataatcactgcaggaaaatacaaaacactgaattcttactaaaactttttattattattattattattttttgagatggagtctaaatctgtggcccaggctggggtgcagtggcgtgatctctgcttactgtaagctccacctcctgggttcacaccattctcctgcctcagcctcccaagtagctgggactacaggtgcccaccaccacacccggctaatttttttgtgtttttagtagagacgcagtttcgtcgtgttggccaggatggtctcaatctcctgacctcgtgatccgcttgccttggcctcccaaagactaaaactttttaaaattgctgacataatattcaattaataattatgtgtagatgcttagttgtgaatttgatatagtccatgttgaagaatttgtttttgctaggaactaatagttttaaacaaatgtagctttaaaaaaaattaaaatgaaattatttctttcttgtagtttttagagtagtgtcaaccacactcacaatcacaaaattccttatatgtcagagaaatattcttttctaacttagtcaattttgaaactaaggagagaggccgggcgcagtggcgggcgcctgtagtcccagctactcgggaggctgaggcaggagaatggtgtgaacccggaaggcggagcttgcagtgagcggagatcgcgccacagcactccagcctgggcgacaaaatgagactccgtctcaaaaaaaaaaacaaaaaacgaaactaaggagagttacaagtatagtgtatactttatgtactttaagattatgaagaaaatacagttttgttgactctgattgagagtgaaaaaacttaagagaacttcatcatgaaattcacccatcatgagtcttggcagtaccagatacaaaagaactttttatgtaagagaggtgttgcttgttaagtatgctgtatttcattcaaatttgtttatgcaacagcttttgtttcaatggttatacttggcatgcttagtttacatatgtctttttaaaatattaatatgtctaaagttgtaaatatttagttttggtgtgtgaaaagcaattgaattttttctacttcctacttctccaaaatcttataattgtcattattatttttcttacagggagtagaaatttcagattaattaaaacatagctcaactccaggaaaaacagagacataaaaatatttatcttcattctctcctgacattgtttttaattattttcatggtttcaaatctttccaggatattgctactgatttcatcttgctggtcaagaaaagaccatatgccaactaatttatcccaatttcatgaataaaatattcttccagtcagtatttcatttcaagatagggtaatatacagtgggccctttgtatcgctaggttactcatttgtagattgaaaatattgaaaaactaaattgcatctatactgaagatatactgactttttccttgtcattattccctaaataataccatctaacaactatttacataggattttcattgcatttggtatacgtaatctagagataagtatgcaggaggatgtgcataggttaaacacaaatagtaggccattttagatcaatggcttgaacatccgtggattttgttttctgtggagatcctggagccagttccccatggatattgagggatcactgtaatgattcttaatatagtggagaaagcatgggtttagaatttagacaagctcatttcataatgagatccatataagatgtgatcttgaacaagttatgtgtttgaatatcagtccttatttataagccatataattttgcaagtgatttaacatgaatatatacagtcatttattccttaggcaggcaatgttctaggttttgaagattttgtggaacataagtgcactttcattggagttcataacctagcaaagaagacaggtactcattacagctttacacaaaatagtgaacaaatcacactattgttcttctgtaggaggtaaacaatgttacatgtacacatagaacaacgggccacaatccatctagaggttacagaaggcattttgaaatttttgaggttttatactgaaatttaaaactatttaaaagcacctcacaaaaaataagtgagtcaaccattagggatatgtgtctaatggtaaaatttcagactctgtgttacttgaactggagagctatttgggaacaggtagaattccactctgagtccactgatgatgatattctctacataacaagtagattttctgctgctggtctttgagaatttagatagtattttaattgtttttaaacagaacccagatattctttatattttacatagtgtctgtggctaaaatgcatacagccacacatggatacacaaacaagacagaaaccaaatttgtgattattcaagaacattgattagaaaggaggatcttcaaaattgacatattcccattatcttagcaattttcaatagtgctgcagtaaacgtggggatgcaagtgtctctttgataaaatttcctttcttttggatagatatccagaggtaggattcctgtgccaaatggtagatctatatgcagcttcttgaggaaacttcatgctgctctccacagtaactgtactagtttgaattcccttcaacagtgtatgagttcccattctccacattctcactagcatttgctatcttttatctttgtgataataggcattctaatcgggatgagatgatatcctgtggttttgattgcatttccctgatgaatagtgatgttgaacattttctcataaatctgttggttatttgtagcttttttgagaaatggctaatcagagcatttgcacatttttaattgaattatttgcagtttttttgctattgtattgagttccttgtatattttggatattaattccttgttggatgaaagatttgcaaatattttctcccattttgtaggtggtcttttcactgtgttgttgattccttggctttttttagtttgacagaatcccatttgtctgtttttgcttttggtgcctaagtgttcatcaatagatgacggacaatgcaaatgtggtgtacatacacattggaatactattcagccacagaaaaaaatgaaatcctgtcattcgagacaacatggatgagctgggaagacattaaagtaagtgaaataagccaggaaaagaaaagttaataccacatgttctcactcatatgcagaagctaaaaaaagttgatttcatagaagtagagtaaaatagagtagaatagtggttactagaggttgtgaaggacagagggagggaaggaaaaggacagttttattaaaggatgcaaaattacaactaaatagaaagaacaagttctagtgttctatattactataggatgactatagttaacaataatttattatatactttcaaactgctaaaggagagggttttgaatattcgcaacacaaagaaactgtaagtgaggtgatggacatgctgattaccctgatttgatcactatgcactgtatgtatcaaaacatcactatgtatctgataaatttgtacagtttattacctgtcaattaaaaaaggacatattccttcaaatatattaacacaatattataattgaatatttacttgacaaacttttgaggtaaggctaagttactttctttgaagagaagcttgttaattagagttttatctagatttttcttcataaacagtacttggtatgcattttctatgtcatatttccattttcaggtttttaaaagtacaataatacttaacattcctttttttaaaaaattattttaggttcagggatccatgtgcaggtttgttttataggtaaattgtatgtcattggggtttggtgtatagattatttcatcacccaagtgagacgcatagtacccaatagtcagttttttcatcctcaccctcctcccactgtccaccttcaaatattccctggtgtctgttattttctttgtgtccacgtgtattcaatgtttatctccaacttataaacaagaacatatggtatttggttttctgttcctacgttactttgcttaggataatggcctccagttccatctatgttgctgtgaaaaacatgatctcactcttttttatggctgcatagtattccatggtatatatgtaccacattttccttacgcaatccatcattggtgggcatctaggtttatgctatgtctttgctaatgataatagggctgcaatgaacatacacatgcgtctgtttttatggtagaaaattaatattcctttgagtatatagtcagtaataggattgttgggtgaaatggtagtcctgttttaagttatttgagaaatctccaaactactttccacagaggctgaactaatttgcattcccaccagcagtgtataagcattcccttttcttcacaacttcttcagcatcgttattctttgagtttttaataataaccatctggctgatgtgagagaatatctcatggtggttttgatatgcatttcctaatgattagtgatggggagtatattttcttattttattttattttattattattatactttaagttttagggtacatgtgcacaatgtgcaggttagttacatatgtatacatgtgccatgctggtgtgctgcacacattaactcgtcatttagcattaggtatatctcctaatgctatccctcccccctcctcccaccccacaacagtccccagagtgtaatgttccccttcctgtgtccatgtgttctcattgttcaattcccacctatgagtgagaacatgcggtgtttggttttttgtccttgcgatagtttactgagaatgaagatttccaatttcatccatgtccctacaaaggacacgaactcatcattttttatggctgcatagtattccatggtgtatatgtgccacattttcttaatccagtctatcattgttggatatttgggttggttccaagtctttgctattgtgaatagtgccgcaataaacatacgtgtgcatgtgtctttatagcagcatgatttataatcctttgggtatataaccagtaatggaatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcattgtggttttgatttgcatttctctgatggccagtgatgatgagcattttttcatgtgttttttggctgcacaaatgtcttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggtttttttctagggtttttatggttttaggtctaacgtttaaatctttaatccatcttgaattaatttttgtataaggtgtaaggaagggatccagtttcagctttctacatatggctagccagttttcccagccccatttattaaatagggaatcctttccccattgcttgtttttgtcaggtttgtcaaagatcagatagttgtagatatgcggcgttatttctgagggctctgttctgttccattgatctatatctttgttttggtaccagtaccatgctgttttggttactgtagccttgtagtatagtttgaagtcaggtagtgtgatgcctccagctttgttcttttggcttaggattgacttggcgatgcgggctcttttttggttccatatgaacttgaaagtagttttttccaattctgtgaagaaagtcattggtagcttgatggggatggcattgaatctataaattaccttgggccgtatggccattttcacgatattgattcttcctacccatgagcatggaatgttcttccatttctttgtatcctcttttatttcattgagcagtggtttgtagttcttcttgaagaggtccttcacgtccttagtaagttggattcttaggtattttattctctttgaagcaattgtgaataggagttcactcatgatttggctctctgtttgtctgttgttggtgtataagaatgcttgtgatttttgtacattgattttgtatcctgagattttgctgaagttgcttatcagcttaaggagattttgggctgagatgatggggttttctagatatacaatcatgtcatctgcaaacagggacaatttgacttcctcttttcgtaatcgaataccctttatttccttctcctgcctaattgccctggccagaacttccaacactatgttgaataggagtggtgagagagggcatccctgtcttgtgccagttttcaaagggaatgcttccagtttttccccattcagaatgatattggctgtgggtttgtcatagatagctcttattattttgagatacgtcccatcaatacctaatttattgagagtttttagcatgaagagttgttgaattttgtcaaaggcttttcctgcatctattgagatagtcatgtggtttttgtctttggttctgtttatatgctggattacatttattgatttgcaaatattgaaccagccttgcatcccagggatgaagcccacttgatcatgctggataagctttttgatgtgctgctggatttggtttgccagtattttattgaggatttttgcatcaatgttcatcagggatatcagtctaaaattctcttttttggttgtgtctctgcccagctttggcatcaggatgatgctggcctcataaaatgagttagggaggagtccccctttttctattgattggaatagtttcagaaggaatggtaccagttcctccttgtacctctggtagaattcagctgtgaatccatctggtcttggactctttttggttggtaagctgttgattattgccacaatttcagagcctgttattagtctattcagagattcaacttcttcctggtttagtcttgggagggtgtatgtgtcgaggagtttatccatttcttctagattttctagtttatttgcatagaggtgtttgaagtattctctgatggtagtttgtatttctgtgggatcggtgctgatatcccctttatcattttttattgcgtctattttattcttctctcttttcttctttattagtcttgctagcggtctatcaattttgttgatcctttcaaaaaaccagctcctggattcattaattttttgaagcgtttttttgtgtctctatttccttcagttctgctctgattttagttatttttcgccgtctgctagcttttgaatgtgtttgctcttgcttttctaattcttttcattgtgatgttacggtgtcaattttggatctttcctgctttctgttgtgggcatttagtgctataaatttccctctacacactgctttgaatgtgtcccacagattctggtatgttgtgtctttgttcttgttggtttcaaagaacatctttatttctgccttcattttgcttctggccatgtgtatgtcttgttttgagaagtgtctgttcatgccctctgtccacttttcaatggggttgtttgtttttcacttgttgttgtgattagtttccttatagattatgcatattagactgttgtaggatgcagaatttgcaaatattttcttccattctgtaggttgtctatttactctgttgatggtttcttttgctctgcagaagccttttaatttaattaggtcatatttgtcaatttttgtttttgttgtagttacttttggcatctgcatcttgaaatctttgccatatcctacatccattcctaggttactttccagggcttttatagttttaagttttacattgaagtctttagtccctcttgagttgatttatgtatatggcgtaaggaaggagtccagctcctatcttctgcatatgggcagccagttatttcagcatcatttattgaataggaagttcttttcccattgcttgttttcttgactttgttgaaatcagatggttgtaggtgtgtagttttatttctgcactctccattctattccattggtttgtgtttctattttgtaccagtaccatgctcttttggttattgtagccttgaagtatagtttgaatttgagtaacatgatgtcttcagcttttttgttttgttttgttttgttttttttgcttattattgttttggctctttgggctcttttttgtcttcaaataatttttttctaattctgtgaagaaagttattggaattttagtaggaatagtatttaatctgtaaattgctttgtgcagtatggccattttgacagcatcaattcttcctattcatgagcatgggatatttttctagttgtgatgtctctgatttctttcagcagtgttttgtaaatctcattgtagagaaatttcgctttcctggttagctgtattcctaggtattttattatttttgtgactattgtgagtgagatcgcattctgaatttggctttcagcttggacattactggcatatagaaatcctactgatttttatacattgattttgtatcctgaaactttgacaaagttgtttatcagatctggaagcttttgggtaattactgtggggttttctaggtatagaatcatatcatctgcaaacaaaaatagtttgacttactctcttcctatttggatgccttttatttctttctcttgcctgattgctttagctaggacttccagtatgtattagtctattcgtacactgctataaataactacctgggactggttaatctatgaagaaaagaatttaattgactaacagttctgcaggcttaacaggaagcatgaatgggaggcctaaggaaacttacaatcatggtggaaggagaaggggaagtaagaatcttcttcacatagagggaggagagcaaggagaggaattgtcacacagttttaaataatcagatctcatgagaactcactcactatcatgagaataacatggggggaatccacctccatgatccaatcacttcccaccaagtccctctcccaaaattgggaattataattcaacatgagatttgggtggggacacagaactaaccatttcacagtactatgttgaataggaatagtgagggttggccatcctcatcttgttccagttctcaagagcagtgactccagcttttgctcattcaatgatgttgactgcagatttgtcagagatggctcttctcattttgaggtactttccttcaatgcctagtttgttgaggatttttaacatgaaggatgttgaattctatcaaaagtattttctgcatctcttgagatgatcgtgtgtttctgtttttagttttctttatgtgatatgaatgcagaatccttcttgcattctcatgagttttgcaaacttttctgattgacttactttaactttgataacattgtgtttgacaactcacctttattatgtccacccaaatattcacagattgtatagactcaattctatattttagcaaggaatttcaataatatgtatatctgaaaatcattatataatcacaatagcaattcatactgccataaacaggtttggagacaaacagagctgattaactcttgttcctaaattaaagttttatgattggcaagagcagaacacataggaaatatgttgcctgctggtaatgagcaactgaagctccagggtgcccagcaagacaattaagagactttccagtctaaattaaaagaattacagaatgtaaaattttattctcaaggaagggaatgcagttaatgtccactaaagtaagttttcttgaatgcccttttatattttcatcttctaaatatctttaccttttataaattctcaagactatcctaagttgccaaaacaaagtgtaacttgggcaacatgaaagaataaggtatggaccttttccccatcctttattagcattctggaaggaatattggcaacatagacagatagatatgtagatagatagataaaagaaaatagattgaaagattctcacacatgtatgatatttaaaggtcaattttataaagtaaggtgtctttaaatacttctttaattatgttatatttaataactagaattaattgctttcactttttttaaaagtttaggagtaacttatctcaaacattattttaaaggttaaaataacataaatgcggaatcaaggttttttgtttttttgttttttttgttttgttttgttggctgggctggagtggagtggcatgatcttggctcactgaaacctctgcttcctaggttcaagcaattctcctgccttagcctcctaagtagctgggattacaggcacctgcaaacatgcccagctaattttcatatttttagtagagacggggttttaccatgttggccaggttggtctcgaactcctgacctcaagtgatctgcccacctaagccgcccaaagtgctgggattacaggcatgaaccaccatgcctggctagaaatcaagatttttaacaagagcgaatcactaagtgttgtaagaatgaaatgagaaaatgtgtaaaatattttgtgttaacatcacataattttttggtaagcgttagtttccttgcctttgccgtgagcatttccccaagctatattttgaatgatgagtcagtgtccatttcattgatcacattctacctgtgtaggtcttttgctggcaacaagagatattccaagttttgatgaggtagccaccaacgtgggtcacacaaattctaccttgcatagttttctctctttaaataattaggccagcatcatttactaactaaatagaactctgttcaagaggcattgaagaaagatagagcaattattttattttgaaaataacagcaacaaatgaacagaatactgttatttattagacttgacatgctgagtaaaatcaagttgctgttaggggaatgaagagatattacaaagtacaagacagtttatgttctggtatttcagaaggcaggtcaaaggttgatgttgtaagaataatttatatttgccattctttgcaataatttcacatggaactgggattgaatttgatgttgtgtaaaaaacaatattgagagtgaagaaggtggtaaacgtattttcaatgctataaagatgatactgtacaaaaagcaagatttattttgtaacaaaacattcatgaagggaaaaacccccacaaaactttcggtaaaatttacaactgaataaaacaataacaacaaaaatgatttagtatcttctttctttgtgattttcttgaacctaaaatattttatatgcttttgttccatttatagaagctttgttaaaatcctactatgtccagctcctttgctgagttatttgtggggggattttagtcatacagtggcctgaacaaatttgcttgattttgagtatatccaatacattgctcaaggaaccttacactaaaacaactgtggtttacttttggagtctgaaggaaactttgaagaggccagagacccaggaatttgcagatgtgagatgaccctgtctggagcaatcttagcatcacttctgtgtatgtatatagtctaggtggaaaaggcgggtaggcagggagtaggaagcataattgacttaaggaaattccattattgaatataaagggactctactctgatttctgggtccagccctgtggggcaccaccatttccattgacaacagagacactttccactcctgggtatggagcatcccacattccttttctggaagttcataggaagccaattcatggcataccacaggaatcaaaagaaagatctctcccttgaactttgactatctttcttaccaaaagacaggacagcctgactctcttgtccactgacataaataggcaaatatttaaatgtacaaggatacaattaatacctaattcatgagaattttttagcagatgcaattcatattcactttcaagtttcttcaatcttaagttctgtcatcctgcagaaaatcacattaccaaaaacatgccaggagtctaagtccagcacctcaatggagagtataaaacatggaggaatcatagtggggaaaattggtaaaactgcaccaattttctagttagatcaagagttctcaaattatgttctgcagcatttagcaaatgttcatatgatattagttagaattgttctcaaacttaatgaatagaataccctactataattccttaaataactgagccattgagtggtctcattcaacaggaagtccaggtgttatcaggaagggggagatcctcggttcttggtcttacttgggagacagatttctactaagtgacaattcaaagatatcagtgagccctattgaagggaaattgagaacagagagtttacatagagagacaggatactctgaaaggtgaggcagagtgggctactgaaagccagtgtgccggcaacagccctgagagtctgcatgggctttttataatgttggattgttctggaagttcccacctttgtcttaagtcaccacctttttctttctctagttttcccacttctgtcttaagtacccacctttccccatctagtttctgcccaggcttgtggaattctctcttactctctgttgatacgcatgtgcaaaccaggaattggatatgaattctatctaatggctgtgtttttcactccaggaaggttgtgtagtggttaaacctgtacttactgctcctgcgtatctcttagggatttctcctctgccctcttcccttatcatcatgcatctagtgacattctggcaggttaactgcagagtgagggattactgcaagtcataagggacattgctttccatctaggtgttttccctcctctctcctcatatctagcatggatgctttgagtggtctctggggtgtgagattttccagccctcccttttctcaggggcttccccttctgctcatgtctggctatcagcctactctaacacaggtgcaggcaggactctcatcagtgaccatcatcagccttcctggaaggctcaggcatccttggtgagcaacacttgtgatttcatttgcaactgtagtagttagtctttctgagctcagacaagccatttgtctttcagcttttggtctctataaccctgaaccctcttagcactcctgcagatgcacaaagcctggaagagcaaggggctaaagctttaggaaccaacaccaactgctcgagatgaagctttttgtcctttaaatccaggtaaacatatttagtatattttttggtaaatatatttagtacacattgtaacattttctggtcacactgtcttgcagttactactcattaatactactgtagtgcaaaaacagccatagacaatacaaaagtgaatgaatgtggtcatgttccaattaaaattttatgtacaaaaattggcccctggctaaattgggccaatggggagggttgccatatttagcatataaaaatataggatgcttacattggaatttcaaataacaattaacttctttaatctaggtatgtcctaaacaattatttgttatttctatgaaattcaaacttaaccaggtatcatttatttaactttcaactctacctgcaagttgtaatgtgatgacttctggtttagacagattttctgaggaggaattcattatgattatccagatcccaggaagatttacaactctactcattgcaacatcaatgcctatgagtgttagtgtatttttgttgtcatcgccttactctcctagctccctcacacttgcttcctgaggtcacctactgtactttcctgctatggactaaattgtctctccccaaaactcatatgttgaagctctacccccccaatataatggtatttggagatggaggactctaaggaggtagtttacgttgaaggacgtcataaggtgggggtcttaattgaatatgaatagtgtccttatacgaagaggcaccagaaagtatatcctctctctgtctctttctctctctctctctttccctcttcttctcattcttcttgcacctacagaagaaaaccatgtgaggtcacagtgagaagggaggaagagagccctcaccagaaatccaactgctagaaacgaggttaggcttccagcctccagaaatatgagaaaataagtttctgttgtttaagccaccaagtctatgatattttattatggcagcgcaagaagagcaatatacccctccattaaaactcttattaaagagagaaaatgattactacaagtggaactgcatcagtatttaccaaggcccagtggagggcatatatctcagctccaagcaaaatcctaggaaactgaaattatgagtgacaaatgggacatggagaataactctgtggccaaataacaggagttgaaatggaaagtaaggaaaagaaagtatcagaagaaaaaagggactatggaaaaaagaaagtttccactttcagagttaaaaaactcacaaaggaagatataacaaaaataatactttaggccaaaaaaatagccacaatataagtaactttatggcataaatctgaaaaggtgaatgaattattttaagaaaattatattttatcaaacttgaaaatttagtagtactggaaaaatggtctgatagaaaagacaagtgttaatcttcagaaaacacatgatttttttcatcatccaaagaatttgagatgacagaaaagatagttggcatatattttatttcagaatattattaagatatgactaaaactaaatttgcattaagaacatagatgtaatcaccctaattataattttagttaattaaatctaaagtcataccaaaagaataatgtaggaaaccaggtaggtatgatttcaggcatacgtggatgactttacactaaacatattaaaatagagaaaaaagaataaagataaccttctgatttgaaggttcatatggtagcataaactgaagcaatacagcaattggatctaagaatgcaggtgtaaaaaccttaattaaaaaactagttaataaaatcaagaggtatatcaaaacagttatgcagcatacacaagtatttagttctttctttttttttttttttttttttttttgagacagattcttgctctgtcacccaggctggagtgcagtggcacaatctcagctcactgcaacctctatctcccaggttcaagagagtcttctgcctcaggcttccgagtagctgggattacaggcccctgccaccacacttggctaatttttgtatttttagtagagatggggtttcgccatgttggccaggctggtctcaagtgatccacctgcttcggcctcctaaagtgctgggattacaggcatgagccactgcatctggcccaaatatttaattctaaatatgcatggatgttaaatagggaatcctttccccatttcttgtttttgtcaggtttgtcaaaaatcagatagttgtaaatgtggggtattatttctgagggctctattctgttccattggtctatatctctgtttcggtaccagtaccatgctgttttggttactgtagccctgtagtatagtttgaagtcaggtagcatgatgcctccagctttgttcttttggcttaggattgattttgacttggcaatgtgggctcttttttggttccatatgaattttaaagtagtttttttccaattctgtgaagaaagtcattgctagcttgatggggatggcattgaatctataaattaccttgggcagtatggccattttcaggatattgattcttcctatccatgagcatggaaaattcttccatttgtttgtgtctgcttttattttgttgagcagtggtctgtagttctccttgaagaggtccttcacatcccttgtaagttggattcctaggtattttattctctttgaagcaattgtgaatgggagttcactcatgtcttttattggtttataagaatgcttgtgatttttgcacattgattttgtatcctgagactttgctgaagttgcttatcagcttaaggagattttgggctgagacgatggggttttctagatatacaatcatgtcatctgcaaacagggacaatttgacttccttttttcctaattgaataccctttatttctttctcctgcctgattgccctggccagaacttccaacactatgttgaataggagtggtgagagagggcatccctgtcttgtgccagttttcaaagggaatgcttccagtttttgcccattcagtatgcaattggctgtgggtttgtcataaatagcttttattattttgagatatgttccatcaatacctaatttatttagagtttttagcctgaaggactgttgaattttaaatgattagttaatgggtgcagcacaccaacatggcacatgtatatacatatgtaacaaacctgcacgttgtgcacatgtaccctagaacttaaagtataataaaaatatacaaataaataaataaataaataaataaataaatatgcatggatgtctcaacttcacataaattatcatagaaaaaatctaatcacaaaacgacgtttgacaagattatgtgatctttactgcttttaaagactaataatctaggaatagattgagaatattcgacataataactaacaattcacccacaaataatgtgaataatactatatcacataagagacactcatttactttgatttatattattgcatgcctagaaaatcaaaggtgcaactaaaaagcagttggaattattttagacaatttgatatggtaattatctaaaaaataaatacttaaaaccagtagattttctttatattagtaataagcagtaaaagaatgtatctcattgctaatagtgacaaacatgcaataacttcttaaaaagaaggaaatcctgctatctgtgacaatatggatgaacctggaggacattgtgctaaatgaaataaacctgattgagaaaaacaaatgctgtacaatatcacttatttgagaaattttaaaaagtcaaacccatagaagcagcatgtcagaaggtagttggcctgagactgagggaaaggaaactggggaaatgttggccaaagggtataaagtttcagttttaagatgaacaaagccgggcgcagtggctcacacctgtaatcctagcactttgggaggcccaggcaggtggatcacgaggtcaagagactgagaccatcctggccagcatggtgaaaccccgtctctactaaaaatataaaaattagctgggcgtagatgtgcacgcctgtagtcccagctactctggaggctgaggcaggagaatcacttgaacccaggaggcagaggttgcaatgagccgagatcgtgccaatgcactacagcctggtgacagagtgagactccatctctaaaaaagaaaaaaaatatatgaacaagttctgggggatataatgtacagcaggagtggtgtagcaattagtttgattgtgattattataacacaatgtttgcatatatcaaatcatcatgttggacaccttgaatatatatgacatgtacttgtcaattaaatatgttaaaattcaagaatagatttgccatgaaaaatgaaaacatgaaaaaataaatactttagaaagtgaatttaattggaaatatattgggtttataatgaaagtccatgtctgaggtcatggatttaaagtgcaaccagtcagcttactttctgatattgtcttgcaaaattcaggtgttaagactggagagaatggtgattaaattctactaaggatgtggttttacagtgtgagtgagagggttaagatgcttggccgggtgccatggctcatgcctgtaatcccagcactttgggaggccgaggtgggtggatcacctgaggtcaggagttcaagatcagcctggctaacatggtgaaaccccgtctctacaaaaatacaaaaattagccgagcatcatgtctggtgcctgtaatctcagctactggggtggctaggtgggagaattgctggaggaaccctggaggcagagtttgcaatgagccaagatcttgccattgcactccagcctgggtgacagagcgagactctgtctcaaaaaaaaaaaaaaaaaaaacgagatggttgaaggcctttgtaggaaagttgctatgatactctgcagttaaggagacaagtgatgacaaatgagtgctgagaggtggaaggaaattgtcgtgctctgtgtgtgtgtctagaactttattgtttacattgcattttattgtttacattacattaagtcaatgacccatttagagatcatttttttgcaaggtatgacgtttagcttaagacttattttattttgcttataaatgtccaactactccttcatcattcattgaaaagtaccacccaccgccccccaacccccagtggagagaattttgttttaaagtaaataaaatgtcagtcatacactacagcagtcccaaggtcatgtcaggtttgccactgtgcagctgaagcagccctccccagcatcatacacacagtcacagcaccatgagcgtaacttgagtgtttgttatgctcaaggcactttttgaagatctttcatatgtctttctttttatttaattctttataaaatgtgcaccatttttatttccaggttacataaaagaaaatacgctataggcagacatcagtgacttccaacagttaaattgttattaagtggtcaaatttagggtgtcggattccagaccccatgccctgaaacataactaacaccatctaacattaaacactttccaaatgcctttttttctacttaatgtaatacttacaatgattctgtgaagtaggattttactccaaaatcaatttcagcataaaatttgtctttcttgatttttctcagcactggcttttccccaactccactcttaggtcttttatttctatgatttttacccaccctttgatttacgttgcttataatttttaggaatccttgactctgtgttggaatggactttaaaaccacataagataaaattctcacccacttctccatcctcagtcattgcgtacctaattcgtattcgttcatttataagaattttgaatatacaccttcttcatatgcacaaagcatgcccattggatgcaggcctacgtgaagttttataattttaaaacctggcctatttctttctcttgttagtcaggttaggttgttggtgtgccagaaatgtctattttagactcattttccatgagcattttgcttgaggagtgcaggggctgctgctcctatttgcctgttgatgcagaagccatattccaataacttctgagctctatgctattcactctgcaaatttacttatgactctacctgaccatggcatcagcagaatgaccttcagaactgcaaaggagtcaaaaaacatcctggcattttaagttaagtggaaaactttatatttaacttacagaataccaaagcttctgagtacttagattttttaatgctaggactcattttctcagtggagaatgaggcatgaaacaacatgacgaagattatatttgataattttaacatcacggtttacattttaagacaattttaataatactggaactaacatattccgttctttctgcttgaaaaagttctaatcactcagctgaatgtgaatcatcatttgtctttgttttacatatgcctgaaaatattcaaatgccttttagacatcttttccagagtgtgtgcacacaatttggacttgtcatgctgtaaaaaagcacttaagaacagatgtaatttactataattttagagtccagcatatcaaaaaataaacaggctatgcttgtttatccggtatgatcaaaatgcgtgtgattcttcacattctggaaaaataaacaagaaagaattgtccttatctaagattgattcctgacatcagtatacaatatgtttttctttttcttataaagaacataaaatgtttagggtctaattcacacacagggaaatgccaatatttcagataaagctgatcaataatcatggaggaggaaggtagggcatggcaccagtcctcatgcctctcagcaaaattgttttcgctccattgctgtctgagtcttacaatttagttatttttaagtgattttttaatcacagaattagctctcactatatttcagtgagtagcgaagtctctctcctggtcactgagtttacttattctctctgttaccactagactgtagataagcatgtactagcaactgaaaagtcccaggaactaggaggaagccaacatttcctctattcatttatattttcttctttaatattaatattaggtctgaagttaggttatgtttggttttgcttcacaatctaattagtgtggtgagatttgtgactagcagagctgaagtgtgctgagttccctgtaacctggtaaaagctatgtgaagttggccctggggaagggaaagatgctgaccactgcagaagactgagcaccctcctgttcttaggttgcattttacagaaagcacctacttgcttctctattttccaaatgtatgatttatgaacaatctatttgataataaaaaataaggctgcataccagccacttgggaatatgatttgtttattaaccttaaatttcctagttgttaaggcattggaagtgtttgacccactaagagtccattctcaacaggcttcaacccaaagagtagaaaccatgcttcatgactggagaagacactacaactccaagaagcaacagttcatttttccccttcaggttttaaaaaaaaattacatgtaccatgattttcaatattttatttcaaataaatatgttggaaatgataagaaaatgaactaagatttattaactgctaagtgttgttctcagtgctttacacattttacatatgtagattactcacacaatctttgagtgtccctatgaggtagataatatcatcagctctactttacatataaggaaatagaagcaaagaggatgttagttattgactctggacacatagctaacacgtggccaagccaatcatgtgaggagttcaccgaaaggctcagctcttctctccattccctgtggaccccaaagaatcctgagaattttgaaagaaaaatcaagagcctatgagttgaaaacaaagtattattttcttttatttttcctttatagtttataaaattaaagtgtattcttaaattccacattgtttttcaaataacaaaattaccagctttttatcattctaaagaattatatatagattaatattaaaaccatgctcagtcagaatccaaaaattaatttctttaaattaaaagacttggaggtagagtaatgggatctagaacttctttgtattagacttagcagagacagatgcctgttttctgcttgagtgatgaaattctacttctaactacctcaagaaaatacggcaggatgcactggctcacagaaactaatgaagctttggccctccaaactgctgtggtggaggcacacagctggtgctcagaaactacatggaagcaaaacaaacaaacaaacaaacaaaacacctctggaagtaattttatgttaactatttctgattttcttttttcagtgtgccctcttctttctctcactgcctttctctatatggtaaaaaattatatagccagcgaagtgcccacttttatattttatcactgatcactgccaccacagagagaaggctaattctcttttcagtggccatttaaacaatttcaggaacacactctggttgacatggccgggaaatggcctccttggattaatcaagtaccttcagaggcaacttgtgctcagaggagtcctatggctgaggcttgttcccaggattcctataggggagtgaggctggcatgcagctgaacacacttgacccaagaaaagttatgttgcaattcaccaagaaacaaaatgatgtgatggcaaggacatggaatttaagtgttaaagaaatagtaattcaacaaatcctggttcaactaattacaactaattaattaatttatataaattgtgataatttttacattattatgaaaattagatgagataataggtaaacagataatagctagcattgagctagctagctattattttttatcaaaacccttgtattgattcagtttgtaattttacaatgtaaggacaattactatacccctatcagatgagaaactgaggcatagggaaattaaagaagttgttcaaaaactcatatctagtaaatttaggagccagaattaatacgctagaataatacaagcatgcttgctgttacaggaaagtgcaatactcaggatatgcattacatacttctttgaattggattcagaattgctaagattataaaaatatccctcattctttattaacaattacttatcatcagttttgttcatgataatttagtttcttgccttgagaagcacagtagaagatgaagatgaaaccagtcttcctgagttaaaaatgtagctttgccatttaccttggacacattgcataacatctgtcttgttatttttgttttctccccctctagcaaaaatgttaatagtagtagtaactacctttttgggttattgtaaggaaacaattaatgaattaatacttgtaagcactctgaataatgcctgacccttagaaaacacttaagaaaaagttagatcttagtatactagctattactagctattactgtcactactatcatcactaccaccaccactactgaaactaccagtgttactacgatcacgactactgccactaatactaccaatattactaccatcaccaccaccaccactaccataactactactatccctactagtactactactaccaccaccaccctactgaaactattaactattactaccattactactgccactaacactatccaacattactgcaatcaccaatactgccatcaccaatactgctaccatgataactactactactaccactactagtaccactactaccaccacaaactactactcattattactgccatctttatactaccatcacctctgtcactaccaacctcaccaccactattaccgctgttatcaccaccaacgctactaatagtattgcaatgaggtttcttctcctgaacccacaatttttaggtgatcacattttaatgtccacattctgtttttatttttgggcctcatatttcacttaatcaaaaattatgtaccaagttcttaatttgtaagaaactggtagagaaattatatggtagatattaaatgaacaagtcatgtagccgtggaatgagtgcagttttgcaggacaactgatcctctctacatgtctggttgccataacttcgcataaacgtatcgtaggacaatctgacttataggaaacactgagctgcttttgctccccatatttcattatcatatcaagacactgaaaggaaaatatttatttattagatttatttttatttaagaatattaaaatgtcttcattagtattgaaaataaatgcacacttgccatacacaaaaaactagtctctcaagaccattattttttatacgtaagtgcctctgaatataacaacagcattgtcagagttaaaatttattgaactggatgcttgaagactaattttggcctctgacttggctatttctgtgaacttagacaagttaaaatttctgagttttggtttccatatctgtaaaacaaagcacttttaactagatgggctcaaaggcctcttggagttctggtgttcctacctagttctatgtgcactgctcagaaaccctgtacattctggaatgtttaacctcagatatttatcagtgcatacaaaattttatgtacaaaaataaaaataatgttacaggtacctgctagaaaaaaaatgttgatgtgctttggaagattatagagtctgttaggtgagaagtaacatgattcactcaaataagtattaatacaaactaactttagtggtattgtgccagtattttagaataattagaaactgaaactagtgacagagaaggagaatttgttgaggatttaaaccaatgtgttacaactgtaccaaaaaaatagaatgaattttaaatcatgaaaataagccaaacttggtggctcacacctgcagtcccagttactcgggaggctaaggttggaggattgttggagcccaggacttcaaggcctcattgagttatgatagcaccactgcactccagcctgggtgaaataacgcaatgtttaagcttgaaactaaattggagaagagaataaatgcaataaggcaataatatacactttaaatacaaatcttaagttttctggataggaaaatttttagtaatagtgcattttggtggtaaaaattctgggactgggaaaaaacccaagtgaaattgtttttaggctggcttgcctgtgctggcctctcacctgctcctcagcaccatgtccaaccctcgatgccccctgccttggtttagggacccccagtgtcctctgccatacagatacacacacaccttgtaagttgtgcccatggttgtgtgggatagtgtttctcagcctctgtaggccacgctgcctttgaataaatgtaaaaatattcaaggcatccttggtaacttgtgccttacctcgttttgcaaagcaaatagtaaaatgggtaaataactactcccttattcccagcagaagacttcacttttcttatgcacttggagaggggatgcagctgggagaagtagtgaaagtgagggagtgaggtccctttcaggagttacagtagatttgcgaggcctggaatgcaggaagagggcaggctgagcactgcacaagaagtaggtcaaaaaaaagctgtgactgcactcagccctttggacctcatcttcaaggctattagagcctgaagaatgttgaggaggaggatgacattgaggctcgtagctcatattttagaaagagcatttgggctgcaatgtcaataactaattaaaggaggtgaggcggtagctcaggagcagtgggaagatggttggcagcataaggaggcactgtgacttcaatagaggcaggaggatagtaatggggacaagaggatgcatttaaaataactgatgatgagttgaaggaggataggagtagcacagagaagaaattcaagagatataccagctaaaataccctaacagtagttctcctcatagaaaaccaaattgtatgagctctcacaggaagaatgcaccaaaccaatagagagaaaaacctgattgctttgcatataaaatgggaatggaaatacatttatttaacaaatatttacatagaggcttttatgtgctaaacacaaacactctgtggattcagggggctcataacttctagcatactgtgacagattcagaaactaagcggaagcccgtggcagaccaggtcatcaatactgcaggtgagagtaggtcaccagagtacaaaatcttagatgcatttgagacatctaagatttcatactccacatgcctttgcaaagtcctaagactcacttcaaacctgatttgtcagtttttattgaagcattgcagaatgtacataaatacagactagtggctgatggtaattattgtaccgctcagtgctccaacacacaattacatcggtgcataaaagcatagatatttaaactgccagacagttaatttgagaaaatgaatgcttttgctggtttcagtgttcctgaaaggagaatggagaatactgcacaggtcttatgtgaattcctaatgatcggtagataaaccagttgcacaagagcaagcaaatgattcagttacactcagctaaaattatagttttattcactgctgccaaaaatataaagagatcaggcatttagaacatctttacattaagaaagcaagagtatggtttttttcttatatgcattataaaagatgaaatatcaatttgctaagagatgcctattatatgtcattaattctcataatttccaaacaaaaaccctctttcagaataaaatctggtcttcatgtatatgcaaagcacagattcttttattttgtttttcctactgggaaagggtgacattgtagaggccaaaagaagggacatcttcaagcaaaccagtcctgtgtgacaaatagctgtgtaacctacaggtagcagctaaaaatgcacacaagccaacacatctttgctttcttaagtgatgtgcccaagtccatacaggtagtaagtagcagggcttggagtcaaacgtagacatcccatttcccaaggtgactttgcttttaacaaaattgaatataaataatatagggttttcagtgtctttttcttattattagaacaacaactaaaacaacaaaatccttcagtcaggatctgaactgtgtctccctcagattaatatgttaaattcttaacttccggtacctcagaatctgtacttggagatggtgtcttggaagagctaactaaattaaaacgaggccattaggatggtccctaatccaatatgccttgtgtccttattaaaagaggaggttaggacagagacagattcacagagaagaccatgtgaagacacagggagaaaatggccatttgcaagcccgtgagaaaggctttgggagaaaccaacccgctgacacatcagcctcagagttccagcctctagaatgtcgagaaaacaaatttcagttgtttaagtcacccagtatctgctactgttttatggcaggcctagcaaactaaaacaccttcttagcatgtgaatagtattgctgctaaaggatagatgtaatgaatcattgttcagaaattttttaatagactgtgtaaaatagtatttgtctgatacttctaaattataaatgttatctttcaaaagattaacgttgcatattaataaagctgacctctaaatataagatgctgaatagcaatacggtcctaattgcatgattgaaatggactttgaagctttacttttaatcctctgcttataaattattgatatagcttcaaattattggtgaataagacagaaaatgatcctgttcccatgccaaattacctccaagggctttccctgcttctgcttgtgctaggcagtgaggaagaaaattgttgccaaattcctaaagaaattggccctagtaattgaagcttgttgctaaaattcgagtgttaagcaaaagacagtatgagagtgggattaaatactccatagaatttttgaaatatttgttgtgttaaagggtttgtaactggattacaaattcttgtgggcaggcagttacttgcactgaacatatgttatcttattttcatggcataccctctcataaatgttactataagatagttacttatctatggataaagccatacctgaaagcactgagatttctgccatcactatacaagagtccagctgctgattattgaaaggcacatttggctttagtccagagttctgtaaaaagattatgtgaatacaaagcaattacagaggttggtttgggtagcaggtggactaggaaagtgagcatatgcatttttaacatcaggaactcagtaatcaatggctcctctaaatgtgaaattaaatcccagctaagaatataagccattatttaaagcaattacaggtgaaattctaaatataactataatcaacacttgtttttctttcctataaacagtatcaagataatgtagtagttattatttttaaaatgcattagctaaattgaagaagatggttaattttgtccaataccatttttgtttgtttctttaaatagacattaggttttctttatttatgagtgtgtcacatggaaatctctcaaatatatgtttaagtaatgcctagtaagtttaaatatgtagtattagaacatgatttttttaataagcacataaaatgtaatttttatatactaaggcaaccattgtaataaatactctactactgaattcacactatgtcctaagaacggtgcgagctctgtggatagaaggaaaagatgcacacttgctttcctggggctcaggtctgctgtgatacaaaggtgtcattgtacagtgacttgtttcctaagtgcttagtatatggtgtgttacgttgctgtattaagatgtgctgggtggcaatcatatgctgtgctaaagaaaatgctgatcgtatggcatgctatgtgcccatcatacagtgtgctcagtgctcctcagagggcatgctaagtgcctgcatatggaatgctatgtgtagagtctgtgcaaggtcagaggcatattactgttggtggaattctggaatatttcatagagaaagcaacataagaagagctgtctctggttgtgtaggtgaacttttcctgccatgctttgaactttatgcatgagtacacaatggctggttctgcggcacccttcttgggtcatcacacctgaggacaagtggccgcacactgagaaaggtgaagtgaaaaagagtcatagaggccagggaaattcagggactccatttatctgcatgactcagtaatgaaaacagtgatgttaagttttgaaagggccacgtgactaaatttctaagaatctcaaaccaggcctttggactcagactggctatttttaattggttgtgccaggctgtgtaggttgtgccaggctgtatagttttatgagactattcacatccataactgatacaggagaagaaataggtttgaatgcaaggaaaagaagctttttcagaatgttttattgtaatgtacataaaattgattaaaataacttagtaaataatggaacaattgtaagaaattagtgtgcatttttttcaaaagtttagtattgatgaaaaaaagatatgcataaacttgagaagatagagatttacaatcaccaacattgggacatgtgttttatatataaagcatatatacatttacatatgtgttttaaatataaattcatatatgtttatatgtttcatatattatatattatatataacacagatcccaatgttggtgatttgtcaagatcatattgtagaggaaggtgtgtgagtcagcattaccagtggagaaacttctggaacaggtgacaatagtatccaggttagacagaaaggcagacaaaacaaaagaaagcccatgagctatatgggccagtaaaggtccaagtctgtattgaaggtgagtaccaggctccacaaagtggtagtgaaggtgagtaccaggttccacaaagtggagaggtacgagctttttcctcaggagcatacaatcttggaggcagcatgcttttacatacatcacagttatatctggggtcatggaagttaaaatggttaagaacctccccagtcagggataaaaatataaagtctcctggtaaataaggacaatggaacggtgaagacagaaaaatgttaggtataatatcagaaattgtgatgtgtcctactgattctttaaaacagaaagtaaaggattcctgagtgaagggggaggagaaatttgctgacgcagagctaggagctgaggctgaggtccactcttcagaccgacacatgaggcctatatgatagaggcactttggaagccatttactgtgacttttagtagtaattaagtggtaccaacattgcattaaaatacatcttaggaatactagagggaatatgaggtcataatgaaggtatggacttacttagcaatagtaaaaacagtgcatcagatttaatcatcttgaatgacttaagcattgggttcagttacaacaggtgctctttttcggtccttttcatcaaaatggttattctggcccaccgcccagtgggtagagggactggaacagaagtctcaagggctttcttggagctggaatccttttagagccaactgcctcaaggcctggcaattttcctgtaataactgcagggaagcctcctggtctagaccgggtttgcacagatagaaacattcaagacatttagtcagttttctgccactcttgttgctagaataatttttaataatgcttcatttcagaatttccaaacaggatatatttccaaagttatctcaacctacaaactctctgaccaaaagtaaacaattaggacatatttccttcagtaaaataaatgttatcttcatttattttcattggtttacaattcagtctgctttgcaagtccaattgttttgtttttctgactgtgtctgcctctgagcagccacacaccactgcattaaacatgccttttaatatcacttctgtattcaataggtggcttttaaatgtatgtatatcgttatcatgcaaaactggttattagattggggagagagtctaaaaaatgtcttttactgcaaacaaatgggaagaatcaaactttaaatcactgaaacttagtagcactgcatattaagtttctaatgtagcactctaattactctccactgaggaatcacaattcacaaatatattggaaaaagaaagattctgtacagagaaactacttgcttatcccaagatcggtacttatgttttaattctatctccctccattactgatggtgaacaggaatgaaaatagagacatagtccaagcataaactaaataaaatgatggttgtgattaagagataagcagagaaatattttgctctttttgagtgtctcacttgtaacaatggttcttgtctttagctagacagagcgtatagaaagagcctgtagaaatttaaaagcaatattactttatacggtaaaagcaatttaaaaagcattcatgcccatagcaaagatgctaaaatttgtaggttctaaaagcagtaataagtacttacattctttcaaaaattcctacacacatgtccagataaataaaccatatattgttcccaatacttcatcctaggttcaaattccaataccgtgacttaaaagtgggatgactttgaacaagttgagctttttgttggttattgtttctcccactttagaataaaaaaaaataattgaaccagcttcatggagtgttgaaaagtaagttaacttaagttcttaccccaattctcagcttgcagttagtttcataaatgttagttctaattataattacaaaaatgtttgaatagaaaattatctatatgctcaccccattatttaaataacacacaatttgaactttatatcaatatatactcataatttggacatacaaattgcatttaagtgtcattttagtgattttgggctatacattcatggctatgtcagtcagaaatgaaatttcagatcatgaaattactttgaaatccagcatgacttagaattgacatgaccagtagcgagagtcagaacatcatttgatgaagataaaattgatgacagacaactgtattctctaaaattgcatatatcttaactgatagcattaaactgatttatttaggcaacaaatatttactgagtgcctactatgtgccaagcactacactagatactaaagacataagaatgaataaattatattaaaggtcttttgtattattgtttatactttaaaagttagtttagcacacacgctgcccgatcattcagagcatcgcatatggcatagaagagaaaagagtggttgagggttttgtttcaaggcttcatagcatccagaaggaaaccttagtgtctactgtccaggtggaatgcagaaggagaggccctcaataaatgggaactgaaactttttggtttaaagccagcaccctcagaggaccccaaatataattcataaaaaacatcagtcttcctacaaaagttgaaaacttgattctcactgtcttggcctgagttgtcagcaaagcacaagctactatgggtaacaattttacctacagagttgccctcacaggatctgtgggtttggattcataccgtcttggtggagaaatggctcagacttgaaacttctcccaattgtgttatggagaaaccatcctcatatcacacattataggttcctcaagattaagaacaaccaaacatgacttcaatctcatagtcaacaattgcaaatacagcaggaaaaagccttctgttttcaaagctcataataaaactaaatacagagtaatttcattttattattttgttgttgttgttgttgaggatcttgctgtgcttcccagactagtctccaacccctgatctcaagcaatcctcttgcctccacctcccaaagtactggatccacaggcgtgagccactgcaccttgagcaaagtaattttaggtgaccagaaattcatataaagagttaatatacttaaggacataaaattcaagtggaaattctgtacaatatcactatggaaaaaatgttcatgtgaatgtgaaaaagaaacaagtggaatgctttgtaaatagcctctaagttaaaactataagtttaaaactctgaggagaattattagattgtcatagcccaaaaaagacatatctttagttacagctataaaatataacaaaataagttatcctgaatgtagaactgaaaagacagaaattgaaaccaagataagttaagggtcaaagaaagcaaaatgggaggttctcacacaaagctaattggagtttcagaaagagaatagtgagagtgagagacaactattttacagatttttcataagtgaggaaacacaaaaatcttcaaatctaggaggcacaaatatcaagaaagagaaatacgaagaaatgtaatatatagctgattttgtagtggattccaaaatgccaaagggaaattgaaaagtgtttaagtagtcagagagaaaaggttatatattttactatcatgataatggaaaccaggagcaaaatataacactttcacaatgctaaaagaatgcaaataccagcttgcctttcctgcgttcacacttttacttataaaaattagaaagaatttttgttttacaaaacctttgaaatttgcgttaaaagatgctcaataaatgcatttctgaaagaggtacttgaggaagaagataaaggatcttgcaagggaagtctgagaatcaaaaattaatactgagcaaaaaattattaaacatttgggtaaacataaataaacactgactacataaaacagaagcaaatttgaagagtaaaaaagtatgggagctccacattattggacaacagtatcatttaggatgggaaataatggtttcaagtaacatttgagctctttgttctgtttagaaagattacaaagatattcattgactgtaaacttgaaattttagaatgtcttcttaatttaacaacagcaaggtataaaaataatatagaccataggaaggagcaaattagaataaaaacagcatgtttaatttcaaaaagagagcatgaaaaacacagagaaaaagcagaacatataaaataagcttccagtggatatagacagtgaaagtttcaaataatgtaaaatatgtgtattataaatcaacacatttatgacagtgtttgctttcagtgtgaaggctagcaaatgcaatcaggaaagcattcacaaagaactgtttcagtaagcattatattttgacctggaataatcaaagtgggcactcgattatttcttgaatttttttgcagcttttttggaggtataattgaaaaataaaaattgtatatattcaaggtgtacaacattaagttttgttatatgtatgcattccacacatatgtgaaatcatgcagtattttttttctgtgtctggtttatttcactcagcagaatgtccttcaggttcatggatgttgctgcaagtgacaggatttacttgtgtattaaggctgaataatattccattgtacatatgtgtacacacacacacagacattttctttgtctatttatttgttgttagatgtctaggttgttttcatatcttggctattgtgaataatgcctcaatgaacatgggagtatgattatctcctcaaaatagtgatttcattttattttgtggatatatactcagaagtgggattgctggatcatatggtagttccatatttaattttttgaggaacctccattctgtttaatttaaatgattgtaccaatttacgtttcccaccaacaaggatgtccctctcttcacatccttcccaacacttgttacctttatatatatacaatatatataaaatagccattcaaacatatgagatgatatcttactgtggttttgatttgcatttctctgataattagtgatgttgagcaccttgttatatacctgttggagattagttgaccacatatgcatgtgcttatttctgggttttctatttcattccatcagtctatttttctgtttctatgctggtactatactgttttgattactgcagctttgtaatataatttgaaatcaaaatgtgatgcctctagctttgttattcttgctcaaaattgcttttgctatttatgggtctattgtcattccatgaaagtcttagaattactttctctatttctgtgaaaaagtcatataattttttaatcatcattaaaatatattcaccatatcccaacatccctcaagtaaccattgcagcatcaactctaagtctgaaatcttatctatatatcatcaaattgaaacatcctaaattttatcatttaaattatttatgggtgagattcagggtacagtagatcctgtgacaaaacctctccacctgtggacctgtgaaaacaccaaacaagttatctgcttccaagttacaataattagactgagacaggcagaatatagacattctcattccaaagggagaaactggaagaaaaaaagaattacaggtcccaggcaagtctgaaatccaacagggaaaattctattaggtttcaaggactactaataattctttgtatcttgaaaatctgtcctctgggccttctgtggcaaaagtcctcactctcttggcccaagtaggtcccattggacagtgactctgcacccatttttataccctagaatttttcctttattttgtcccatctctgtctctttcagtctaaactgacagtgtctctgctggtataaaattctcaaaagccttatcagtttcctgtataattcacagggatccaagccataagacaagaattgtcccccacagatcattcctggataactgtgtctctatccctggcttctgctgagaggtttgtggactggatccatgagttacacataaaatctcattaaaaacacctgtccagtttcatccttgacaccgtctccaggacatagtatcttagtaccctagagattttccatatcaacaagtactgattcctttttgcttcactgttaattcctcactttatctctttttctcacattttactataagaagcaaggacgagccagtctgcaccttctgtgctttgcttggaaataacctcagctaaatgttcacatttatgacttacaagttctacttttcactcaattctagaacacgattcacccacattctctgacactttataccaagtattgcctttccttcctttcctccactgaccaataatatgcttgtcatttctccataaggcctcaacaggagcactgttaatgtccatatttctaacatcagtcttgtcaagacaatctaggtttttctattaagcatctaaaaattctctcagcttctgtctcttacccaattccaaagccacttccacatttttagctatctgtatgtcagctcccttcctttggtactaacatctgtattggctccctagggctgccataaactgagtggcttaagagacatttattttctcaaagttcttaaggctagaaatctaacatcagggagtcaacatagccatgccccctctgacattctgggtagaagctgcctcctggccccttcccagcttcctctggtggccatccatctttgacaggtctaagcttacagctgtgtcaccccagtctctgcctccactggcacatggcatcctcattgtgtgtctcttctcttctttaaagaatataagtcatgttggattcagggcccaccctactccagtatgactttattttaaccatttatacctgcaatggctcccttttccaaatgagtttacattctgtggtactatgggttaaaacttcaatatgtctttttgaaagacacagtctaattcataataagaaacttcaatgtaattaacaaaagaagtcatggaagcagagaaaaggacagctagtccagcctgggatgcttagcaagacagcccttaggaggctgtgcttaaattttctatattgttgagtatattagttaaggccaatacataaaaagggctattggggcaggggctgccaagattcagtacataatatgccattcatggaactcaatctatggtggtgggttagtatcagtgttggtggtggtgggttaatatcagtgttgctgtcagaaaggaagagatccttgaattgatgagaacatgtgaggcaattccagccattatcatggcataggttatagcaagagcactgaaagtgaaaaagtcacccaggtgaacaaatctgcgtggttaataagtgtaaaggagaatgaaagctggagatcgccaatgcctatgaaaagagcacagggagaggagctttccaaatgaggcttacaatcaatgtaagataaaataaaaagagagggaatgtaattgctgaaccaagttgtcacagagctgttaggcaagggaagcactgacataagtacactggatttggcaagcaggcttttcctggcttatgggaaagcttttttttaaatagaatatggtagaaatgtaatcagcaagtataaacaacaattttaagaatcttttctgtgatgacagggaaagatagaatagtaattagagggaatgtatggttagtagggtacattcctttttcttaacttttaaaaatgagagacgctgaggtgtgagtatgtactttaggagaaaaaatagttgagcggttatagatagaagaaggggcatacttgaatcactcatggaatgtgatctcaggaagaattgagattcagagcacagatggaagtgttcactttgaacaggagactagaatgatcccaacttactatcaaaaacgatccagctttgatgatattcttccagtggttataaagtaattttcagtcctcttttatgtatttacaatgaaaaaaagggtcaaataaatagaaactgtagcatagaactgatcctggattgggttgttttctgtgatcccagtaggaaatagctccacaggttcaattatgtcaacccggtagttggcctggaaatgaacatctctgtgagactcagattcccttttctgcacagctgcgtgctgcagtctgaggagagccaagctctttcaaagccctaccccctgtcaacaagaaaaggcatgaaaagtcaattgatcttcacggctattcatccccttaccaatactgttctcaaagctttctgaatgaagttcggctttgttttatcctatgtgaatacttgaatcggactctaaatcaaaatcctgaacattcttaacattccatcatgtggtaataaatacaaagacaaatcaaaaagtaaaatattacataaggaatgaaactgaagaattgtagtcttctttcatacttaggtttattctggtaagcatttgtcattatttgaattgttattatttctatttgtgtgtttagcagcagataatattgttgatagctaccattaatatgtagtggatattaaagtgatcagtaggaagcaagaactatttaattcttgtttatatcagcttgtggatacatgataatttctccttaacctttacaaggtctttcatgattttgggggactttcgtttttaaaaaaaaaattcaatgaattttatttctctgcttttaaaaactttatttttcagtagtagtggaatatttatgctgcatctcttctgtccttgttatctctcagtttatctgaaatttttgtttgtatgtttaattttttaaatttagtttttagtttagtttactacatttaggtaaactgcatgttgcaggggtttggtgtgccgattgttttgtctcccaggtaacgaacatagtagctgatagatagttttttgatcctcaccctccttccaacctcctccctcaagtaggtcccactgtctgttgttctcttctttgtgtccatgtgtactcaatgtttagctcccagttataagtgaaaacatgttgtatttggtttcctgcccctgtgttagtttgattaggataatggcctccagcttcacccatgttgctgcaaaggacatgatcttgttccttttttatggctgcattgtatttcatggtctatatgtaccacattttctttaacaagaccaactattcatggatatttaggttgatttcatggcttttctattgtaaatagtactgcgatgaacttatgtgtgcatgtgtctctatggtagagtaatttatattttgggggggaatatgcccagtattggaatgctgggccaaatggtagttctgctttgagttcttcgagaaattgccaaactgctttccatggtggatgaattagtttcccacaacaatgaaagcatataagctttctcttttgtcttcagccacaccagcatctgttatgttttgacctttcagtaatagccattctgactggtgtgagatggtatccctttgtggttttgatttgtatttctctagtgatcagtgatgttgagcatttagtggtcttgcttttgtgtgaattcagctaaagggcacagactccttttgtcctgagaaacacctgaatagcagggcacgtgaccccacccacacctgctactgatagccaggtgggcaatgcctgctataacttccagcccagccttcctgaagcatcaatttaatacctggtgaatgttattttatgcctgagctgcagggggcacagagatgactatgacttaccttgtgtaaaaggacatcatgtgaaacagacctacaggcctattagccccatggcaactcacagggactctgacagagtacatacaggggtcagggttgggacccatggtaacttgtggtccatgctaccaaaatgaggaagaggtcaggagactctttaaaaccaacacattttaactctctgttgaaaaacagtaggttttcatcaagcagaagagagcctaaagcatttgtggccctgtggtactctctggaaaagatatacagagagcatcccaaaacaccacaacacatttaggggaaaaatacctgcttcagaatgacttcattttcagcagagtagttgccacaaagacactctaagaaatacaaacattatctcatgtccggtgttaacatactgtatttaaacatcctcccatgcagtgtgaaagatggagtgtatttggtgagatttgaaagtgagaagatgagctagaaggctcctgaattagtatagtgagaaatttaaaagggtgcataacacagaacagtgcttttaatctgcccattcatcttcatcgtcctgctgatgggacgctctgagtcccccatctcattggaccaatctcatctcctgaccacagctctcactgcctgtagtcaactttccatctttcatttagcaatggtttatatggtgcttgctgtgtttcagtaggtgtgggaacctggcagcaaacaaaaccaagactttgcttgaagagtttatctttcagtggaggaggacagtcactcattaagtaaatgcgtacgtagatagtatgttagaaggcaataagtattcccgagaataaataagcaaagcagcaagaaggcgacagaatgacagtgtgctatttcacctagagtggatggggaggcttccattctaaggtcagacctggcaagggcatgaggaagtgacatggagtaaaccaccagatctgtggggaagattccaggagacgtccaggcaggaggcagcttcctgttctgaggcagcatcaacacagagattgcactggacactgaggatggacgagctgagcttggaggcgactgtccagagatgcagcagctggggccacagtgagtgaccaatggtgactcctcttggagtgactcctcaagacaggattcccatgttagcatgtcagccatgcctcatctcctgggctagtctctgtgtcctgagtccaattcttcagcctttccattaattatgggatcaagccaatatctttcttatcaataaattttctgcttgaattccattctgttgtctaaagctaagaaacctatctagtggaggaataagttttttttacagatgctggtaattgtgacttcataataaccttaaaaatgacattagtgtgaggactttaacagtctggaataacgacgtcacggcaagacactgcctcccaacccctgaaattcacacatatgttttccacggatgacgaaagcactgaaaatgtctgttcagaaaaaaaaacagcaattgaaataattcagcatgatgccactggaaatataccaaccttaataataagagttctggctggacgtggtggctcacacctataatcccagcacttttgggaggccgaggtgggtgggtcaaccgaggtcaggagttcaataccagcctggccaatatggtgaaactccatctctactaataaaaaaaaaataaaaaattagccaggcatggtggcacacccctgtaatcccagctactcaggaggctgaggcaggagaattgcttgaacctgggaggtggaggttgcactgagctgagatggttccattgcactccagcctgggcaacaagagtgaaactctgtctcaacaataataataataataataataataataataataataataattccttgaaagactcatgcaccttcaaagcactgaaggacatgcagttcatactggctggtgagtgccatttgcaggcagttgtgttttttcccaataaaatagttatctattttaaacagaaaaatccttgggtaagatattgaaattcataaaagtgggtaggattattgcatattttcctaagcaaataaaaactataagttatgtttatatgatatacagtgtatcatactgactttataaaatttaaattttatgtttatttgacaataaaattactgaactaaagtctaaaagtttagaaataacagaaaaacagtgggaaataaaagccacctgtgatcctgctacacacaaatgctgttaccattttgatgtatgaatccatttgtaatgtgtatatttgcttacatttgtgtagatttttgtgtacatatatttgcatatatttatgtacatttgtgtatatctgtgggtatttatgttcctatagttcagattacaatgaattctgacttttggcatatagcaggggaaattatgttatcaacattttaaaaaacatttttaattgcagcaaaatattgtactgaatgtacacatcacaatttatgtaaccaatcatttatatttgaacatgcaattttttactctaaaattgctgtggatatttgtatgcataatttctaaatatgacttatttgcctaggtaaaccctaaatatggatgtagtctaagagtgtaagcttttaggctttaacccatgttgactagcactcccagaagagctgcaatatgtaagacggtgtcattaacctagaaaacagaatgcctgtgtcatgtctgccaacattcaacttagttaaaatccccaaatatatgctaaaataactccaactattttattaaaagtccatcagtgaaaacttaaaagactagaaagacacatcatttgatgtgttatagtatgccctactctgggagattgagcaaggaaaagaagaaagagccctctacatttatgggactctagaattatcttaatgcactccacggttgggccatttgaagaaacagctaattatctttcatgtgcccactgtgcacattccccagatacctggcaagattgcaaagcaccagagccaagagtgagtcactggaatttaaaggagatgagaacatttgcagaaagattcacagtgactcttagtgatgagtaaactcagatagctcagtaatgtagttcagtttagaatagtcttgccaaattcagttgatgtctgaagcttttcacatgtcactagcgagctttgtgtttctgttttatattgcaaagaaaacaatgcaaaaattaaaataagtgctggagtaaatggccgcgaaacttgcaatgtcatgaagataatatattgttctgtaaggtcccagtttatttgataaaaaataatcaatcaaccaataagcactgatgaggcaaatctttgttctgtgtgatgctggaaatcaagaagtgtgagacagaaatctaacatttaaagaggggtcaactgattccactattgttattgtagttgagaagggtttctggaaggatcccacattgtcacacatggcattgcatctttccagttgtatccatgttcagtcttcttctgagcctaatgaactgctaaaggtgatgcttcctttctcagccagatttcccattctggttcatcttgaacatgtgtgtgtctgaaagagagtgtgtatgtacggtgtgtatatgccttatgtatgtgtatgtgggtgtaagagtgtgtgtgtttgcgagaatgtgtgtgtattttatgtggtgtggtcagtgtgggtatgagtgttagaaactgtgtatgagaatgttcatgttagtgtgtatgtgtgaatgtttatagtatgtggatgtaagtctgaatgtggatgggtgggtgtgagtgtgtttttgagtgtgtgtgcacatacataatacaaactcccccttggcctgcagagaccaagtgccaacctcacttgtctttcattttaaatgcttaaagcattaagttcatattttgacatatctatcttcattccttctttatgggaggatctttctggatcatctttaaaacatggtcattttggaaacagggagattgttttcatctcacctcacacatcattgtacaaatacttgtatacattggttccattataaagaagtaggttgagggagcaaccatctaagctctttactaattatattctaaatcagtgtgctcattgtctggtttccaaagcaacggctttaacatcccctggaaacttgatagaaattcaaattatttggcccacaccagacccactggaacagaaactctgtaagaatgcatgaaaatgtgtttcttcagtgatcacttgaaagatacatggagtctccaggtttcgctgattatgaattagcctgctgttcacgttttaggcaggtcttcctatgaatgtctcttttcaactttcttacttaaatatatgggaataggattgccagatcagatagtaagtgcaggattgctacatcagatggtaagtgcatgttgaacttcataagatacctctgaatgcccaccagcaacctgtaagagcttcagctcttcatccttgccaacccttagtctgcattttttcatttgtttcacttttgtttttaatttccagaattctagtaggtgtgcaattgttccacatcttgggtttaattagcattttcctaatgattaataaacaaaaattgtgactactaatggttcaaacctacctaaacgcttgcaatgagagatatgaatatgtgcaaaaatggacatgtgctaggaaggttagctaattaagcttccatataattatttatccatttaaaatggaacattttgagtatctgaaacacattagttactatgtgatcattaagatacacagcaatgacaacaacaaaatgacatgaaatccaccttagagaattcttaatttagtggagggtgaaaatgtaagtttaatgccttacaacatgttgtataaatgttctactagatagatctacagagaaagaattagaggaccacaaggaaccaataacatatctcatgataaagattcagttaaggtttcataatgcataattatgtatatttataatttaataatattgaaaataaaagaaaataaaagctgggcatatatatgtgtgtttcattatttgtcatcctttacaatggcatataactattacacacacactcacacatagatacaaattatttatattgacacctattattgcaaaatcagctcacactctatttttctataacttactttttatctttaaatgttatgacatttctttctgggtcactataattgtgtatgtttgtaggtttacctaattgtttcttatggcttcatgatattttatagtatagctgtaatattgttatctaaacatttttaaagttatttagccagaaaacatacatttcttaaacacttcccacgacaggcattttacaagatctgggaacacaagaatgaattcctctgtgtgttttctacagaaacccagactacagttaagatgaaggatataatatgatttataatacaaggacataaagtttataacagaggagctataaacaaagaaaagtgaggaagagagtaggagcttgaagaagaattcacaaggaatttcatagcaaacataaaaattttgctttttactttttaacacaaacctgcaattaaaaagattatatatatatatatatatatttgggttgaatgaatcaagcagttggttaagtgagagaatttatttattttttaagaaaaggtaaccagaagtaaaatgaatgttgataacattgtagttaggtttattcaggaagagataaggttttgttaaagaagctgatggtaaatgaagtaaaattttctaatggcttgcatttttactttatacaagtgttacaagcatatgaatacaggttgatggatgtatttcatcatgttaaaacctctcactgaaattttgcaaaagcaagacaaattaaaaataaagtccatgaccagtgtggtggcttacacctgtaatcccaacactttgggaggccaaggcgggtggatcacctgaggtcaggagtttgaaaccagcctggccaacatagtgaaaccccatctttactaaaaatacaaaaaaattagctgggtctggtggcgggcacctgtagacccagctactcgggaggctgagacatgagaatcgcctgaacccaggagatggatgttgcaataagtcgagatcactccactgcactccagcctgggggccagagcaagactccatctcaaaataaataaataaataaataaataaaaataaaaaataaataaagtccatagtgtctcccattacccagaacaattacattatatggccatgctgtgtcgacctgacagaatgttccatgtgggaaatgttctagtgggacatttgtttacatgtttctgatttccaatactcacaataatatcactttctgtctgaggtgaaatttcctgtctagttttcaagttttgccttgctatattttgtactactaaatttttattgagaaaaacgttgtgtttgttccttatcctcccttggcattaaaatactgaatggaaatggggaatacaattatattttagcagtggaagggatgactctagaaaatatttcctaactagggtgacaaatagtaactggtgtagcagaaattgcttctgtgtattaaagacttattcatattagaaacatcacttttcaagtgtctatggatactcttttccaccaaactgtgccagatagtctcgtacttttaaacatacatatgcataacatttgctcagatgcaagtttgataagaatcacttagcaagcagtctgtaaaagcaatttagaaagaaccaatatgttactgtttgggcgcataactctgttggtctggtttaattttagagtgtattttagtataatggatatgtcacatattcctgagtacaacctccattgaaaatgccttgtatttagttgataatggggagtaacatattaagactgacttcctaggtcaaaacttggaatacagctacactctgctgcttattaaaagttacatcatataccttaatcagtattaaaaattagaattccttttaacatgaggtagctgagaagcataacaagaacatgtcaccagaagccttccatcaacctcggtatggatttgagtccatgaatcctggagagcaggaccagagtgatgacacatttcatcagaagcactgacacacagatgcagtcacacacattcacttccaacatcctggctagaatctttagcctagaaaatttcatccgattgaatgaaatgcctacttaaaaaaataactttgaaaaacactacttcaagatatgctatacgaaaccatcttaatgattaaatgacctactttttagacaaattacttagaatgcattgtatgttcgggccacagatggaaggcagatggagaaatcaatcaggaaggaaacataaaaatggagacaatagttccagatagtgttgattttgataggacagaataacctaagggtgaaatgatagtggtgagtatgaggtccagcatacctaggtgaggtcatcaaggatgggctcctctgagcaggagatattacaatgaggaggagccagctgcatacagattttcaggaagaatttccatgggttatacagggacctagtcctttaaggtgctgtaagtgaagggtgagaattttatatgtttcatgcctttagcactgtagggtgaattggagggctcaaaaataggactggggatcatttaggaagcttcttcaggaatggggatggagtgaatcatatgcttccatttgcactgcagggaccagcaggtaagaatgagtggcaggcgactgagtgggcaggaggagcggctgtagattgggagttgagcagtgggtggataaacgttctactcacatatataggtacacagagcattttttatataaaggaaagggatcaatagttgtaaaagaaagggatcaatagttgtatttttattctgggtttgagacacttatgaaaacttctagtagcattgtcaggtcagcagtcttggtaatcttgaataaagatcaggaaagagagcaggacttgagctgcctgcagtgctctgggctttgggggtcaggatgacagaaaacaatgacaaaaggagatgagaaggaacaccaaatgaggtaggaacaccagtcacatgtggtgccctccacgccgagaggactcagtgcttcaggaatgatggcaatgccaaccatagggaggatgccaggagtgacagtggcagagccctggccacctggaggacagcagtgttaggagaaaagggggagcctcattggaatggattgagggattgaggagactcttcatcgagtgctagtggagacaatgactatagacacattttaaaataagtcttgaaacagataaatatgaaaaatctatatacaaatatatatagctagatggaattatagactcagttttatttgcttgcttctttgcagaggaaatagctctgtatttttgatattttaatatttacttttagactaattcatacataactatttattattcaaaaaaaattgatgtgaaactaatgaagtaactcctggttgcagatcatagtcaaagaagaagcctactaatgtgaattttgggcccttttgtagacttactcaagatgaaactctagggatgaagcctgactgcatttactgtcttacagaaaaagtcatggcagttggggcggtgttgagaaactcatgctgacatactctgcttcagggattaataacacaaactgaaatatttttctcacccgacaaagtttagggaaagcagaactgattgttccaaaataacaaatttccttattgtcaaaagcactttttatttttatgttcatctattttagaaagtagcagtttacatatttaaataatttaaaattagatatatatttttgaataattagatatctatgaataataaaattcaaatacatttaaaggggaaataatatagcatattcaaattctaataaaaatatatagatgacttgaactatctttgtatcatgtaccctagaacttaaagtataataataataaaaaaaaaaagaatgttaggtggaaacttgtagaaatatagctaaatatagataaatgattttgttaaacttattaaggcactttggaaagaaaattagaaaaataaaatgcctatacttaatgttattttgtatgaggataaggaaatatttcaactaaagagtatccaatttgtgtgtgtgtgtgtgttttgtgtgtgtttgtatgtgtgtgaacatgctttcaagttacttggataaatgcttaaaagtgggaatgcttggccaggtgtggtggctcatgcctgtaatcccagcactttgggaggccgaggcgggtggatcacctgaggtcaggagttcgcgaccagcctgactaacatggtgaaaccccgtctgtactaaatacaaaaaaattagccaggcgtggtggcgcatgcctttaatccaagctacttgggaggctgagacaggagaatcgctggtacctgggagggggaggttgcagtgagccaagatcacgccattgcactccagcctgggcaacaaaagtgaaactcagtctaaaaacaaaaacaaaaacacaaaaacaaacaaacaaacaaacaaaacaaagtgggaattctaggttgaaaggtaaggcaggcttacttatctaaaaaactgccaaactgtcatccagagtggctatgtcgtattgcaaccaattgtcaatgtgtgaggattcctgtgcctgccgatcctcaccagccattgatattgtaagagttttgtttaattttagatattctaaaaattatgtagtggcctttcaatgtagtttaaatttagatttatttatattattatttgccattaatatgtcttctatggttaagtgtctgttaaaagtcttgtgatgattttttgttctttttttttcttgttgagttttaagatttttttatacattctggatataaattctttatcacatatatgatttgcaaatattttctctcactatatggctgtcttcttattctcttaacaatgtgtttcacagagcaaaagtttacattttaattaagtccaatttttaattttttttttaccatatatcctgttgatgttgtatttaaaaccaaaggcaggagtgtttgaatgtgacaaggatacagggaactttgaaagtgataaaattcttctgcatgatacttgggtggtagatacatgactctacgcatttgtcaagagtcatctagtaaatttgaaaacaggtcatttaagaaaaatcaaccaggacatcagggaatgtcagaatggaacgcagactgtgaaaaatgaatcaaactatattataaatgtataacaaacttcactgaaggtggtaagggaaaaattggagctgacttgagaaacatcagaaaaataactgttttgactggtaactgtaaagtaagctaaagacaaaagaattatagaattaaagaattaatcactgtaccttatttggaaaacttgttttttacagaaatggaggttagaaattttgaaaccactttacaaatacactagggtttgacaaataagtaataaaatataagtaatgggttactctaaagagtgactttggagtagataaaccttgcagatgccaccttgaccaaattgattcagcattttttctgtcagaggaataagccaggagggatggtggggattgactttgaagctcatagttctggattacatctggaggtattatgaatttatttaattcaataacagatacagacagatacataaattatatgagatgcaggttaggatacatgcatgtattgcctagctgtgcacatgcatgggatctagaagcactgtaattccagtaaccataaacacactgcatgtgccatgcctcagtttctaaatattactctctaatgaaatgaaccaggatttcctggaaaaatggctgattctctacttgagacagggaaaatagaggataagcataatgcatattataatgctagaaagtagaatactggcaaaaatagaagttaaataaagatcaggttatatcagaaggacatgggacccaatctgaaagaactcacaacagccaaagtttgtacaatttgagcaaaaatatgcgtaacatagcgtgtgtgtgtatacatagatatatatcctatataaggtatatgtatatatctatagacactatattaaatataaaataaacatacatgaatatgaattcatactggtataaaaatgattatgaatataaatatatggcacagggggatcttccttgcagaggaattcagaataatatatgttgatatacctcctttcaagaagtggagcttaatatcactacttttgagtgtaggttggacttagagactcactttcaaagaataaagtacataaagtgagaaatagtaactttattttttatttgtttattaatttttttattactttaacttctagggtacatgtgcacaacgtgcaggtttgttacatatgtatacatatgccatgttggtgtgctgcacccattaactcatcatttacattacatatatctcctaatgatttccctccccccaacccagaacaggccccagtgtgtgatgttccccttcctgtgtccaagtgttctcattgttcaattcccacctatgagtgagaacatgcggtgtttggttttttgttcttgtgatagttggctgagaatgatggtttgcagcttcatccatgtccatacaaaggacatgaactcatcatttttatggatgcatagtattccatggtctatatgtgccacattttcttaatccagtctatcattgatgcacatttgggttggttccaatctttgctattgtgaatagtgctgcaataaacatacgtgtgcatgtgccttgatagcagcatgatttataatcctttgggtatatacccagtaatgggatggctgggtgaaatggtatttctagttctagatccctgaggaatcgccacaccaacttccacaatggttgaattagtttacagtcccaccaacagtgtaaaagcgtccctatttctccacatcctctccagcacctgtagtttcctgactctttatgatcaccattctaactggtgtgagatggtatctcattggagatttgatttctctgatgccagtgatgatgagcattttttcatgtgtctgttggctgcataaatgtcttcttttgagaagtgtctgttcatatccttcacccactttttgatggggttgtttgtttttttctcgtaaatttgtttgagttctttgtagattctggatattagcactttgcaagatgagtagattgcaaaaattttctcccattctgtaggttgcctgttcaccctgatggcagtttcttttgctgtgcagaagctctttagtttgattagatcccatttgtcaattttggcttttgttgccattgcttttgttgttttagacatgaagtccttgcccatgcctatgtcctgaatagtattggctaggttttcttctagggtttttatggtttcaggtctaacatttaagtcttcaatccatcttgaattaatttttgtataaggtgtaaggaagggatccagtttcagctttcttcatatggctagccagttttcccagcaccatttgttaaatagggaatcctttccccatttcttgtttttgtcagggttgtcaaagatcagatggttgtagatgtgtggcattatttctgagggctctgttctgttccattggtctatatctctgttttggtaccagtaccattgctgttttggtcactgtagccttgcagtatagtttgaagtcaggtatcgtgatgcttccagctttgttcttttggcttaggattgtcttggcaatgcgggttcttttttggttccatatgaactttaaagtagtttttttccaattctgtgaagaaagtcattggtagcttgatggggatggcattgaatctataaattaccttgggcagtatggccattttcacgatattgatttttcctatccatgaccatggaatgttcttccgtttgtttgtatcctctttttttcattaagcagtggtttgtagttctccttgaagaggtccttcacatcccttgtaagttggattcctaggtattttattctctttgaagcaattgtgaaggggtgttcactcaggatttggttctctgtttgtctgttattggtgtataagaatgcttgttatttttgcacattgattttgtatcctgagactttgctgaatttgcttatcagcttaaggagattttgggctgagacggtggggttttctaaatatacaatcatgtcatctgcaaacagggacaatttgactacctcttttcctaattgaataccctttatttctttctccttcctgattgccctggccagaacttccaacactatgttgaataggagtggtgagagagggcatccctgtcttgtgccagttttcaaagggaatgcttccagtttttgccctttcagtatgatattggctgtgggtttgtcataaatagctcttattattttgagatacgtcccattaatacctaatttattgagagtttttagcatgaagggttgttgaattttgtcaaaggccttttctgcatctgttaagataatcatgtggtttttgtctttggttctgtttatatgatggattacatttattgatttgtgtatgttgaaccagcctgtatgttgaaccagacttgcatcccagggatgaagcccacttgatcatggtggataacctttttgatgtgctgctggattcggtttgtcagtattttattgaggatttttgcatcgatgttcatcagggatgttggtctaaaattctcttttttgttgtgtctctgccaggctttggtatcaggatgatgctggcctcataaaatgagttagggaggattccctctttttctattgattgggatagtttcagaaggaatggtaccagctcctccttgttatctctggtagaattcggctgtgaatctgcctggtcctggactttttatggttggtagactattaattatttcctcaatttcagagcctgttattggtctattcagggattcaacttcttcctggcttagtcttgggatggtgtatgtgtccaggaatttatccatttcttctagattttctagtttatttgtgtagaggtgtttatagtgttctctgatggtagtttgtatttctgtggaattggtggtgatatcccctttatcattttttattgggtttattttattcttctttcatttattctttattagtcttgctagtggtctatcaattttgttgatcttttcaaaaaaccagctcccggtttcactgatttttttaaaggcttttttgtgtctctatcttcttcagttctctgatcttagtcattccttgccttctgctagcttttgaatgtgtttcctcttgcttctctagttcttttaattgtgatgttagggtgtcaattttagatctttcctgctttctcctgtgggcatttagtgctgtaaatttccctctacatactggtttaaatgtgtcccagagattctggtatgttttgtctttgttctcattggtttcaaagaacatctttatttctgccttcatttcattgtgtacccagtagtcattcatgagcaggttgttcagtttccatgtagttgattggttttgagtgagtttcttaatcctgagttctagtttgattgcactgtggtctgagggagagcttgttgtaatttctgttcttttacatttgctaaggagtgctttacttccaactatgttgtcaattttggaataagtgcgatgcagtgctgagaagaatgtatattctgttgatttggggtggagagttccatagatatctattaggtcagcttggtgccgagctgagttcaattcctggatatccttgttaactttctgtctcattgatctgtctaatgttgacagtggggtgttaaagtctcccattattattgtgtgggagtctaagtctctttgtaggtctctaaggacttgctttatgaaactgggtgctcctgtattgggtgcatatatatttaagataactcttcttgtcgaatttctccctttaccattatgtaatggccttctttgtctcttttgatctttgttggtttaaagtctgttttatcagagactgggattgcaaacccctgccattttttgttttccatttgcttggtagatcttcctccatctctttattttgagcctatgtgtgtctctgcacatgagatgggtctcctgaatacagcacactgatgggtcttgactctttatccaatttgccagtctgtgtcttttaattgtagcatttagcccatttacatttaaggttaatattgttatgtgtgaatttgatcctgtcattatatgttatctggttattttgcttgttaattgatgcagtttcttcctagcatcaatggtctttacaatttggaatggttttgcagtggctggtaccggttgttcctttctatgtttagtgcttccttcaggagctcttttagggcaggcctggtggtgagaaaatctctcagcatttgcttgtctgtaaaggattttatttctccttcacttatgaaacttaatttgactggatatgaaattctgggttgaaaattattttctttaagaatgttgaatattggcccccactctcttctggcttgtagtttctgccgagagatcagctgttagtctgatgggtttccctttgtgagtaaccagacttttctctctggctgcccttaacattttttcctccatttcaactttggtgaatctgccaattatgtgtcttggagttgctcttctcgaggagtatctttgtggtgttctctgtatttcctgaatttgaatgttggcctgccttgctaggttggggaagttctcctggataatatcatgaggagtgttttccaacttggttctattctccccgtcactttcaggtacaccaatcagacgtagatttggtcttttcacatagtaccatatttcttggaggccttgttcgtttctttttactcttttttctctaaacttctcttctcacttcattttattcattcgatcttcaatcactgataccctttcttccacttgatcgaattggctactgaagcttgtgcatgcatcaaatagttcttgtgccacggttttcagctccatcaggtcatttaaggacttctctacactggttattctagttagccatttgtctattcttttttcaaggtttttagcttctttgcattgggttcaaacttcctccgttagctcagagaagtttgattgtctgaagtattctctcaactcgtcagcatcattctctctccagttttgttccactgctggcgaggagctgtgttcctttggagggggagaggtactctgatttttagaattttcagcttttctgctctgttttttccccatctttgtggttttatttacctttggtctttgatgatggtgatgtacagatgggggttttggtgcggatgtcctttctgtttgttagttttccttctaccagtcaggaccctcagctgcaggtctgctggagtttgctggaggtccactccagaccctgtttgcctgggtatcagcagcggaggctgcagaacagcgaatattgctgaacagcaaatgttgctgccagatcgttcctctggaagcttcgtctcagatgggtacccagctgtatgaggtgtcagtctgccccctactggggggtgcctcccagttaggctactcgggagtcagggacccacttgaggaggcagtctgtctgttctcagatatcgaactcctgctgggagaaccactactctctttgaagctgtcagacatgaacatttaagtctgcagaggtttttgctgccttttgttaggctatgccctgcctccagaggtggagtctacagaggcatgcaggcctccttgagctgaggtgggctccacccagtttgagcttccaggctgctttatttacctactcaagcctcagcaatggtgggcacccctcccccagcctcgctgctgccttgcactttgatgtcagactgctgtgctaccagtaggggcagactgacacctcatacagcccggtacccctctgtgggtgtgggaccccccaagccaggcatgggatataatctcctggtgtgccgtttgctaagacccttggaaaagtgcagtattagggtgggagtgacccaattttccaggtactgtctgtcaccgcttcccttggctaggaaagggaattccctgaccccttgcacttcctgggtaaggcgatgcctcaccctgcttcggctcacactcggtgggctacatccactgtcctacccccactgtccaacgtgccccagtgagatgaaccgggtacctcagttggaagtgcagaaatcacctgtcttagtaactttagaatagagaaacccagcagacgccactgtaaccaagagggcaaggtatatgttaccagaaataagtcctgtcgttcctcaaataatgaaataagaaagatgctcatctctgtgatattcttcacaaaaatctttaaacctagtctaaccatggggaagcattgaactaaccaaaattgcaaccatctataaatcacctggcctatactgatcacaactatcaaggtcatagaaaacaaaacacctgaacaaaatgccatcgattggaagtgaccaagaaaacatgatgactaaatgaaatgtggcgtgttggatgaaatcttgcagtgaaagaagacattagtggaaaaaaggtaaagtctgaatataaagcctatagttcagttcatggcaatgtggcaatgttaacctgttaatggttatgtaatttgttacacttagaataaaatgggtgtaggttatagagtaattctgtgtactatacttacaacttttttctatgaaattatttcaaagtaaaaattcaattgaaataattttaaaatagcttgtgaaagaattagatttttcttttacttgagatcaattaatagagaccaaatttgccaccatgcttgaaacaaagttgtagtgctgctgcatttgaaagctcaaaataaaactaccttgattacaggcagtatggtcctgttgtaaaaatacacagagagatcataagaaaaggatagagagtacaaaattagacccaggttcacatgatcagttggttttcatctaagttgcaaaggcaattcattaagaaaaggattatctaaaaacaactggtagtagaacaatttgatatccacagtaaacaaaaataatctcaatcaacaattcaaaaattagctaaaagtgtattagagaactaatgtaaaagttaaaaccacaacagttatagaaaaaaaaatggaagaaaatatttgtgacctttggctaggcaaaaaattttaagttatgacactacagaattaaataagagataaaatattctataatgtttagaaattcccaaatatttgtaaattaagctatgcacaggaaaccacaaaataaatgagaaattatagataatttaaagataataaacatttgtaagatgaagcttagagggaaatgtatagccttaattttttatattagaaagaataaaaggtttatgataaaaacatcacctttcactctatagggccatctgaagaaagatttaatgtaattcaaggtaagttgaagaaaacaaataataaaggtaacagaaaacaaacataagatagaaataataaagacaaaagttgtttgaaatgatgaataaaacaaatacatctctagttagaattgtaaaagaaaataaacagaaaaatcacaatttgtcagagcaacaccatgaatactacatatatagaagtgtaaaaaggaaaaaaaataaacactattcagtaaagaaaaaaagggcaaatgaaatgaaatgaaaacttttattgaaaaatagaatctgctaagactaatacaaaaagaggaaatctgaatagccttattttgtttaaataaatgaaattgagacttaagacttcatcctttgcccctatacacaaaacacccccaggtacagttggcttcattagtcaactctactaaaactcaggaaacaattatacaaaacttacacaaactctttcaaaaaatacaaggagaggaaacattcccaatttgttgtacgaaatcagtatggccctgaatccagtattgtcaagtgctatagcagaatgaaaatgtattaaaattacggatctataacgcttatgatcacggatgctaaaatcttttatgaaatattgtcagatctcattgagcaatacataaaaggataacacatgttggccacatagatttagtctagaaatctaagattacttcaaaatacaaaaatcaatatatgcactgatcaatatatggctgatatatataatgtgaatctgtatgtatatatagttatatatgtattactgtatacagtttaatatataacctaaaatataggttgggatatgtgcatgtatttcctagttgtgcccatggacaaaatgtatcaagaataataaaaatcattgctaaaaagacaaatcagcccattaaaaatgggcaagtgttctgatcaaggacccaggcatgccactaaagaagatgtacaaattgtgaataagtacatgaaaaggcgctgacatcattattaatcaagtaagtggaaattaaaccatcttgggctaccacgtcacacccactagaataactaaaaggagaaagactggcaataccaagtgttgttaaggatgttgagcaactgaactcacaagcactgtgtgaaatgtaaaatggtacagtgcttccatttccaagaggaataaaatcaagtgttcatagcagtttttcatatctaaattgaaactgcacaaaattctcatgatcaaatgaatagataagcaaatggttttatatttatgcaatgattgctactcagcaatacaaagaatggaatactgatagatgcaaaaacagagctgaatctcaaacaaggaagactagacaaaaatagatatcaatatctatagatgtatggacacttccatatgtctgaatatagatatttagatgcatagctgtggtagtatttcatttgtttgctttctaggtaaattaatctatgatgatgaaaatcagaagagtgactgtgcctgagtgctatagaaatgttctgtatcttgatcagaggagtagttacaaagctatataggtttgctaaaactcatcaaactgtgtctttcatatatgagtattttattttgtttaaattgtccccccaataaacacttatatttaatgattacttgataattctttaaggtaaatctgattataaaaatacatattagtatacacaaaatacatattattcaacacacaattaaaaacttattcttcgcataattattattgtcttatcaaaaaaggaaggttaaatagagcagcaaaagcctttaagaaaattttaaattatggaatttccccgagcttgcagataaggtattattggatgacaaaataaaatgtgatatttaggacttttcattataaatcattaaaacggaggtaaaattcaagaattcagccaaggaaacaaaacaatgtgcagcttcttgagattgctactggtgctttgtttacagcactgagacctttcctgtcttgcacattcatagaaatgaaaataaagaaatccatagaatcgagaatgttataaaagtagttaccaaacctagatggaagttaactttttcaaaaatttctaaagaaatgttcattgacagataaaagcaataagtggttgttagttttggataagttaaatgtatattttcttttcccagggcattcctggcttatgtcaactgtcctggcaaattgtaaatacctcttcctatcactctcccaagtgacattgtttgggtggcaaattccatgatcatcttagtttgggagacctggtccatttagacatcaagataggcacttttggttcatttcttctactaagcagtaaagggttctcttcccattatcaggttcagattatggtagatccatgatatccaaagctttcttgatattttaatgtcacatggctggaattttagaaaattcttgaatttatatgaaatctattcatctttcacatatgtagtcttatttttagcctgtctcttaggaaataaaaaacaattgtacccatgtgcaaagtagcttcttgggtgggttctcaaaactttttaagtataggaagatgaccatcagagagcactgggcagagtccccagggattgacaatactcagtgaatgctatgcctatgatcatggagcacacacaggacttctatttagaataacagggtaatagtattagcttcaatttaataaaaacaattttaaatgcaaaataggaagtcaaagtttgttaattttcaactatgcaattattgaatacctacagacattttcctatttttccacgttgatttatgtagctggagttcattgtttttttctgttgtaatcaaccttccattgcagtaatactgcataatttgtttctctattccttattacattaacataacttttaattgattcaattttttgctatgataaagatgctttggtgaacagacattctggtaggccttgatgcacatgtgtaagaggatttttgttttttaagggtatatatctggtgatagaatcgctgagaccttggatatggacacctttaactttaataaataatactagactattttccacaattattttacaaatttatgttcttactagagtttacaaaccagttgctcctcttagtctcaagcatttattgtctgtgtttgcttctaatttgatggttgaataacgtgttgtgaacggaatgtgcctttgcctgataactagtgggcgttgagtgctttttgatgaccggccgtttgggttttttctcttctaaaatgcttgttcctgtcttggctccatgtttatattggattatttgacttttttctttattgacttttagaagatttttgactattttaaatattccttttttttcacttgcaatttgttgcagttatgttctatgagtttgttactaaactctttaggtatgctataaaccagtcttattttctgtccacttgaggcaatactttcaaacatctagattttacgtttcctggttataccaaatttctgcagtataaattatcttattcctattatttgcctactgttggcttaggacaggtttaggcattaggcttctaagcaagttactcatcatccatctggttttaaacttccaaaacattgttgtgtcctccgctgttctttgtaattattaatttgtgtttttctagtctctttactataatctcaatgagattttggtcaaaggaaaaagcaaaatgtgagtctttactattttatcatgtttatatagagaatattttcactatttgacatgtatatcaaaaaaggaaataaaatagtagtcattgttttgcagcttcaatgaaactaaaagccatacgtgtgtacttgagtatttgactctctcagcaattttattcagtacctgagcctagtgtttctatggagtgttcacaggcatcctctcattctacccttattcatttggtcccattggtcttacaggttccattatatatgacaaggaatcacagttcaaaaaccttaattatcttgttctggagtaccaccagcagcagttgaagaaattaaaccaagttcttcagaatccacctgcagctccctctcctactgaaaaatatacccaattacctaagttgggcccttacctggtagacttaaactgggagaaattttaattcagaacaataaaacagtagcaaactctgcatgtttgatatttatgcaggacaacatattgagtaatgtgtttgttggtttttctaataaaaggaggacatgctcttgggcattgcacttaattttctatgcagtttgtgtctcatcttctgagaaaaatttactaatctttagggttggaagaactatttctagataatactcacctggagccttatggaattgaattcaatttctgacacataaacgttgttacagcaaattgactttcaataatatctgaaatttttgtgttaaagggatgatataaacaatatctcttctaatggtaactggtaaccttttgttgacttttgagatgaatttgaaagggaaaatgctattgctttgaaacagttacctctttccaagaagaaaacctctcagttttcttaaagggtcatatggattgcttaagattagtcctcatcacttagaagcatggacattcttttgcttttctgtgctttcattttatatcacaactaggatagtttctaggatttacatttcattgtgaatgaaatgtaaataaaataacatagtgtattagtaaatatccctgaataacaaggcatgtgatttgtgatctgagtcataatatatttctgaaatctcccttagaaatactatgcatagctaattattgccttataatgtatcctatggattttgaacctgaagtcatactcatacttgtatcagcttatttgatactcatagggatcttgcagaagcacggaatagctgtagtacttttttgggagcacagaacttgggcatagaacatagactgtagagaatattttttgaaggagttttgaaaacaactggacacaagcctggaagaaggataggagtctgagaagtgtggggaaaggggagttcaggcagacacagccaccaatgagagggaccactgctgcaaagagaggatttcatatttagagaatggcaatgactttggaatagtaaaatagagaagatgatattttaatgtcaagacttatagatagatcattaaggacagtgaatattattctaaatgatactgattgtgtcctgaagatgatgatgatccatgaaagaacttattgttgaagaatcacatgatcacataagttgaaattttatgtttcaaaaagatgacttcagcagcagcgcatagaacaaatcagggattttatatggaacactatatgatcagtttttcatgattatggaaatctaagcaaggaaaagtaacaggataagctaaatgaggtagaaagacttaaggaaagtacacagttgggaaattatctggagattttagtagaacttgacccattgattgtatagggccaaagtgaaggaagaaatcaaatacgaagttcagtttcatggcttggggcataagagttgtgatgacactattaatagattacatggaaagacaggcatgttttcgtagggaaaggctaactttcagtgtccatgtgctgattctagggactttccaagaggacctgatagtgtgtggtgcatgtgttgtgtgtggtgtatctgttgtgtgttctgtatgtgtatctggagttcagagaaatctctggcctagagatagaatcagtgattggcccttgagtgcatgaggtaagtatagatttgaaagcccttgtctagtgagggaagcattcccacaaaaaaggtatggaagaaacagaaaagaaaaagaaaaagaaaaaaaaagtcacccaatcaaaacatcctggatagcagcaatatttaaggggcaaaaggaaagaccacaaattaggttaagagataattgtctttaaaaaaacacaattcattccctattttgcattaataaagcatataatcttagacaagcattcaaaatccttcacaacctggccgaaactgcttttagaagaatgaaagagaggggaatgatatttagggaaggagaaagagaagaggaaggaggaagagcaagagggagaagaaatgctgtgtgatttgtggttgaattgaattgtacagcgtcagggaaggtggagagcttgacttgactgccacttgcttggcaggacaaaataaggaattgagatagaattagtcaccctggttcttgtcagagcagctctgtgaataacctgagagcaggaaaatagtgtcacaaagccaatgggaagtgaggctgcccagagtgaaccctgcggcctgctggctataagaaagcaccggccgtgcgcggtggctcatgcctgtaatcccagcactttgggaggtcgaggcgggcgtatcacgaggtcaggagatggagaccaccctggctaacacggtgaaaccccgtctctactaaaaatacaaaaaattagccggacgtggaggcgggtgcctgtagtcccggctacttgggaggctgaggcaggagaacggcatgaacccgggaggtggagcttgcagtgagccgagttcacgccactgcactccagcctgggcgacagcaagactctgtctcaaaaaaaaaaaaaaaaaagaaaaaaaaagaaagaaaacaccagtccctagcagaacttcatcctccatcatgcttcccttcgttagcccgctggatctccagttgaggtgctatctaatctaggacatcaggataggaaggggtatttacgtcacatgtgtgaagctgagtcctctgtcctgattgacatcagcctggccattcctcatgattatgcagtgacgtgttctgctcctgccatctgctcccactgctgttcctggaggtaaacatgccccggctatcccagcttcagagcatgatcctcttactgcctcatgggagcctggacccagaaactttctcgcatattctatagcaaggcacagccgagatcaccatgaaatccttaggaagcctttctaatggctcagggcaaacagaaggggatggcatctggtgccatgtggctgcttccaggattcatggttccagtcttttcccatagagttgctaactacctgcttccataagcaactggctaggtcccagttcactcttcagaagagaggcctctcccttcaccctccagggaggccctttctggtctctctgtagattctatcaactgggaagaaagcaactctcctcaactcagccagttattccaccgccctttagtgagacagactcgtttcacccacagaaactaaatcccatattctctagttttaaattttgaaaactgtcttctcaaccataacctatataacctattgattagaagacgacttttctgtgtcgcttttactgttgcttccgagtattccaaaatataatttttccaaaatttatgtcttccagttataattccaagtttttttttttttaataaacaaactaagtattacaaatttctcttcaggaattttcttcttttttctttttttttttttttagacggagtcttgctctggcgccaggtgggagtgcagtggcgagatctcgggtcactgcaacctccacctcctgggttcaagtgattctcctgccacagcctcccaagtagctgggactatgggactacaggcgcccgccaccacgcccggccaatttgtgtattttaatacacaacaggatttcgccatgttggccaggattgtctcgatctcctgacctcagggtctgccgcctccacctcccaaagtgctgggattacaggcgtgagccaccacactcggcccatgaatttttttagtaaaattgatttgcttttataatagaagattatttagactgtagtttaagattctaaatggaacatgacaagtttaagaattcaaaaatcttcatcaatatcacttgttggatcctaccttttcaagataatgactacatctttacaattgctgcctttagcactgcaaattattgaactgacagactgaaatctatgggtttgatctacctcttgtatttgctttttcctcttatctctcttccattttaatgttcccattgatctcagagactttgatagaaagacacaatttctttttttttttttttttttttttttgctatctatcatcatgggcttgctgaatatgcttaaactatggtcagaagtaaaaatgaacagaaagctaatttttcacaatgcttgtctgaattggtcaaggagaatagaacattactctgctgctattcagatgctttgccatggctggtacagcgtgatgcacagttacaaagaactttgcgtatgaacatgttctgttccagtatcaaattctgaaaggggactgcttttttccagagaactggcaattctccattgacaagcatgaacagtggataacaaagcaaaccttgtttactggtacttattcatttaaagctctatcaggcaatctgactgaaatgatagttttgttctgcaaaatcaaaagatatttaaaattagataggttgttaagtagataatttttagtgaacacattttaaattactaggggatatttggttgcaactctttttgtgcatacaacatattacatgtcataatataaatttcacttatttatttgtcccttgttttctttccctgctacattcacagaccctagaagagcgcaaggtccctaatatgcactcaaatatgtagtgaatgtgtaaatagaagtaactcttcaaaatatgcaactcttatgttaacagttgggaaactctttggaaaaaatattatctccaactatgaattctactgttaaatacttattatgctccttggctttattaaatggtatggctatacaacatcagaagataaagttcattcttctgaatattactctaacattttggtcaaagaatgagtcatcccttatttataggtttttaaatttgctttcagcttattttatgtatgtcataaattaagacaatagtgactctaactcatagaaactatgcttccccctccccagcaggaaaaataatctttcatctcccacacacacacacaaaaaatgttgaattaggtgtcaggtgtttatactattttggatagaacagtgttgagttctgctttgatgagcttcacaggcatagctttgcttactgaaaagagagcaattagcttcatattgctcgatttaattaagtgaggtcaatttaacttaacatttagtctccatccccagccagagattcccattcaccttgctccagcaagttgtcagagtgagaaaagattaattttctatatcacagtgcagtcagtgacagagatgaggctttagcaaactgatgtttggatgtacagaaatcatttttgcaggtagtgatttattcaagcaagaatcaggaaaatgtcaaaacgtatccaaaaattattttgtgtcctgtatactgatgtttgctgtagagtttgttcatccttgtactcatctccagatagagcttttgtatctggaaagagtacaattgacttaatattgcttaatttaagtgaagcaattaaatttacgtcatcttcagccacggacactcatcgaccatgttctgcatattatctgcttgaaaattgctgccactatggccatgccatttttattttccttcttcagtgatttgcaactataattttcagatagtaacagaaaccctggattggaaaaccttagtggttcctaaaaagatcgagatatatgttgatacatacatttgtcatataaccaatgggcattactagttgaacctaaagtcgcattgtaacttaaatgtcatccaattatgctggaggcatcacactacctgacttcaaactatactacaaggctacagtaaccaaaacagcatggtactggtaccaaaacagagatatagatcaatggaacagaccagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagatttaaacgttagacctaaaaccataaaaaccctagaagaaaacctaggcattaccattcaggacataggcgtgggcaaggacttcatgtccaaaacaccaaaagcaatggcaacaaaagccaaaattgacaaatgggatctaattaaactaaagagcttctgcacagcaaaagaaactaccatcagagtgaacaggcaacctacaacatgggagaaaattttcgcaacctactcatctgacaaagggctaatatccagaatctacaatgaactcaaacaaatttacaagaaaaaaacaaacaaccccatcaaaaagtgggcgaaggacatgaacagacacttctcaaaagaagacatttatgcagccaaaaaacacatgaaaaaatgctcatcatcactggccatcagagaaatgcaaatcaaaaccactatgagatatcatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattcctcagggatctagaactagaaataccatttgacccagccatcccattactgggtatatacccaaaggactataaatcatgctgctataaagacacatgcacacgtatgtttattgcggcattattcacaatagcagcgacttggaaccaacccaaatgtccaacattgatagactggattaagaaaatgtggcaaatatacaccatggaatactatgcagccataaaaaatgatgagttcatgtcctttgtagggacatggataaaattggaaaccatcattctcagtaaactatcgcaagaacaaaaaaccaaacactgcatattctcactcataggtgggaattgaacaatgcgatcacatggacacaggaaggggaatatcacactctggggactgtggtggggtcgggggaggggggagggatagcattgggagatatacctaatgctagatgacacgttagtgggtgcagcacaccagcatggcacatgtatacatatgtaactaacctgcacaatgtgcacatgtaccctaaaacttaaagtataataataataataaaaaaagaaaaaaaaaagattaaaaataaaaaaaataaaataaaataaaataaaaaaaaaaatctttgaaattaggaaagcaaaagagtctgtttctaaaccaacttttcctatatgtcactcaggtattgaatcttgtgtatgtaaaacctttcatatcacattccttcaaatcacattgacctctctggaccgtgattatatgtaatggtcctgataagaaaatatatttggccaagtgcggtagctcatgcctataatcccagcactttgtgaggccttggcaggcagattgcttgagcccacgagtttgaggccagcctgagcaacagaacaaaacctcatcgctacgaaaaaaaaaaaaaatacaaaatacaaaaattggccagacatggtggcatgcgcctgtagtcccagctattcaggaagctgagatgggaggatcctgtcagcctggcaattcgaggttgcagtgagtcatgatcacaccagtggaccccaggctgggcaagtttgcaagattctatctcaaaaaaaaaaaaaaaaggtaaagaaaaaaagaaagaataaagtaaatttgtttcactcaagtattattttgagagagatttagaaagccattaattagtttgcatatcattatgattttttctaataatttaaaaattaccttagataagtattattttaaaatacatgattacttaatgaaggaatctaaattttaacttataatttgatgttatgtggctacttcttgtgctttatttctcttattgaaatgtaaaaatataatttaattacaattcctttaatttgtatgataacacttaagcaagttaaatcattaataatctttttctaaaatgtttaatatttcccaacttcctgaaaaaaatctacacatctttaggaaggaccatatttgtgaaaaattataattcctgactattaattttattgctacatacttcatacaaacacaaaccagtttacattgttaacataaagacaatcaaatgtaaataaggccacaaattgtagatttactattaagaccaagtcattccattccttatattactgccattaagtaacaatttgtttttttctctaatagtaaaggaaagaaaatatgtacctctcatctgaagatatgcacacacaaacacataaacagagtatacattataagatgcatttttcttgttttactttagtgtgatagttgacaaagacaaaaccttaacacatccgtgtgtgtatacatgtatatgcatgtgtatatatatatgtatatatgtatgttataaagcatattaataccaaaagaatctgtgaatctattacccaatataagaagtggagcatgacaactgtagtacacatggtttttactatatttgtattttattctattttcctttaagagataatacgagttggagttatattcaatatttcctttactttttaagaaacttttaagattttaattagtcataatttctaggaagttgcaaagaaatctacagagagatccagtgtacacttcacccaacttctcccaaatttaacatcttgcataactgcagtacctgattatgaaaagcaggaaactgaccttggtacaacccacagagttattcggttacacgtgcactcgtttttatgtataagtcattttatcatatgtatatttctgtgaaacttccatcacaactaagatatttaacttattaaataatacgccaggcagagtgattgtttcacatttttatatagatgaggagtattttaaaacacttattttctttctgtaacttttccatctttgtcatttgtggttgatttcttttcctcagtgatatttgtgtttcagggttttcaatgaacaataatttcaatgaataatttcagtgaataataatttatttcacaaaaagacatcatagggcacacagatggtatggttgtatctatattaaaagactttgaataactgacatcaatagtgtatttttaaaactcacatgtatactcatatttcacacttaaattttccagttaaattcctaagtcaaaaatgaagttcgacttctgcttctgagaaaactggagtaggagcaattctgcttcttcctcccacttaaatgcaacttaatatcttggacatcacatagagaaaaatgtataaagacctagaaagggagggagaagacagcccactcttagggagctcagaactgggaaggacatggtggcaagagccctggtatttcttatttgcctcacatattccagttggatagaaacttaaaatccctccgttattctagttccttgttaagtaatacattgattaacctaccatttttagatttttatttacttcattagctgtagtgaactcttctttggactgtctgtgttttggtttgtagtttttatttgatttcttcatttccctcacagtgttaagttaaagcctttgcagaggtcccaactaggagctgagtgtagtggcttgcacttgtaatcccagctacttgggtggttaaggcaggaggatcactggagccgaggagttagaggctgcagtgagttatgcactgagtgttcacccactgcactctagtcttgatgacagagtgggaccccatgtgtaaaataataataatgaagtaaaaataaataggtaatcgtggaaatgagggtggtaaatatgtaaacagaagactcatctagccattgaacttcctttccctttttgctcttcatatttgcacctggggctgtgagagtggtactttggacattgtgttctagttctaatgtctgctcacctctgtggctatagagaccaggagcggaccagcctcagtgacgacagcatgttgttctttaagtaatgttcctactttcacacctcaacattggtcctttggaacaaggttacattttttttaattcaagaggcttaatgtatatttattatttcataaataaaacccacaaatacatctatataaaataaataaatggagaaaatcagattagtctaaaattatttcacataaaataactaaggaaacaacctatgaaaaaacttaaaagatatgataatgattctagtgcaattaacattattttgacacaacatctaattctgaactccttatcatgtaaattaaaaaaaaatctggaatcacatgtatgacatatgtggggatacagtaataatagagtgaggcataagatttatctcgtgtattggttatctattgctgcataaaaacatgtagcaaacttagtcatttaaaatagtactcttttgtttcctcatagtttccatagccagaagtgcaggcatgacatatccagattgattctatgcagtctcacaatgctacaattgtagtgtcatccaggctgtgtttgcatctggaacttgggggttctaccaagcttgtgtaggtttgtggcaaaatccagttctttgcatttctaggactgaggtccccacattcttgccgcttgctggccaagggctgctctgggttcctaatgggcacctcctggaggacttgggcatgcaaccatctccacagggcagcctccctcttccaaaggcacaggaggatctgtcccagcttgatcctctgaccctttgtaggagctcccacctgatcgatcaagtatggccacccagttaatctccttcaaactgattaattcaaaattgactgatttgggagatgacagctacaaaatccttccacctttgtcatctgatggaatcttagaacaggagtgaaatccacaactgccacaagtccagtccacagccaagaggcatttcaggggcaagaatctgggggccatctgtattagtcagggttctctagagggacaggactaataggaaatatacatacatatatatatatttccttttacatatatataatgggagtttattaagtattattaactcacacaatcacagtgtcccacaataggctgcctgtcaactgaggagcaaagaaaccagtttgagtcccaaagctgaagaacttggagtctgatgttcaagcgcaggaagcatccagcacaggagaaatatgtaggctgggccgctaagccagtctagtcttttcatggttttctgcctgctttatatcctggcaaagctggcagctgattagattgtgcccatccagattaagggtgggtctgccttccccagcccactgactcaaatgttaatctactttggcaacactctcacagacacacccaggttcaatactttgcatccttcaatccaattaagttgacactgagtgttaaccatcacaccatccaagaattattcctagcacatctcacaagctttattctggttaagggttctcgacttagctgtgcttcagattttgagggagcttcttaaaaatgcatatttataggcctctatatgaatctgattcagattcagaattgaactctatctcctcagttataaatattattttcaataagctacagaagcaatgcttatggagccagcttcatccccttgagacttctgataaccactgctctattaaatataggcatctcacctgcctatcattgattaaagtatggtattttcaaaactacagttgagttcatgaggggccaagtaacataaacgggatctttaaaaactaaatgacaaaggcagaagcaccactctagcctctaaaattagcaatctgttgctcaagtcttcaattacagtatgttttaagaggtcagcctgccccccaccaccataaaactgagttaacagctaagtctcataaaaaagtaatcacttcttggcattaaatcaatagaccattcctcacaatgaatgcttttaaatattatcactaatttaaacttggagtctgattctaaatttagatccaagtgctacctactggcaaatgaaatatcctctggtactccttttgaagtcaatttccccaaagtgtgttctacagaacttaatcttgtggcattagtcatttggaaaatattacctcatttggtctctagataatttacagggatttgagctattcctagaaattgacaagaaagtgtggaaaattgtgtatgatttgagtgtaaatagcagtcttgtcttcctcatgggtaaagtagatacatttcggtgtgtagatttcatcacttctatttttgaatgctcataggacttatttttttttatttctgcatctagactgctctccagaatgttgagattgcccgagaagtgaccccagcaaaagaaaaatattgctgtacctaaattcaagtaagaccattactttgcaataacgtatcatgtgtaaattagtggaaaaaatcaactgtattagtctacacttctaagagacaattgttttctttgatattaatctttttgaagcttctttctctgttcttgaaaaatgacaaaaaaaaaaaacaaaacctcttgttatggaagcagtagaaatattcagaacgtatctccatgtttagttgtagttacacagcattttgatgtgtctttccacaatgtttatttaaacagctatgttgaatttgtgttgtttctttaataagcactatttataggaatgagaaaaatcatttagtttttcaaaaacaccctttattaggtgagggatctgtgtctcttcatgaagatggtaactggagttacacatttcagtgagctgcgattttctgagaagggcagacactcaacaatggggagtgggttgcgatgcttggcagggtgactataaactgtcacgttctcttttgtttgttcagaggaaggagtgaatgaggtgaaattagtacaatgaatcaaattccttcaggaagggagtgtgagtcagcatgggtgatgcaggtggatcaatgaccttgtagtagaataagtgttactttaggaaggaatcatacactatttgttggaaggaggtgaacgtggctagaaaaggttaggattgaagtcactaaatctatttttataataagctgtcacagtatttttgatagcttatgtccttacagtccaaggacttgtagtatggctttagtaagattcatcaaactcactgatatatgttgggtttcaatgagtgccagtactgaaaagtatactgtgtgcatatttatgtactcaattatacttaaatgtagtgtagaagtggcaagaatctttgagtgtatcatgtgttataaaaaccatgaaactttataactttatgtagccatgcagattgcctattaaagagatttctaggctgggttttcaaggactatggcaagttctgaggcactgaggattaagcaattaggcctcaaagttgtcctgtttgctacctattctgttagacatggaagccacattgtgctgtttcttgtcatggatgggttgctaatagattgatttccctcacccaatctgatccttaaattattcaggtagattttttaaacaattatctttttaaaaaattttactttaagttctgggatacatgtgcagaacatgcaggtttgttacataggtatacatgtgccatggtggtttgttgcacctatcaacccatcatctaggttttaagccctgcatgcagtaggtatttgtcctaatgctctccgtccccttggccccaactcccaaaaggccctggtgtgtgatgttcccctccctgtgtccatgtgttcttgttattgagctcccacttacacatgagaacatgcggtgtttggttttctgttcttgtgttagagtgttgcgaatgatggcttccagcttcatccacgtccctgcaaaggacatgaactcattcttttttatgcctgcatagtattccatgatgtacatgtaccacattttctttatgcagtctaccactgatggatatttgggttggttccaagtctttgctattgtgaatagtgctgcagtagacatacgtgggcatgtgtctttatagcagaatgattcctaatcctttgggtatatacccagtaatgggattgctgggtcaaatggtatttctggttctagatccttgaggaatcaccacactgttttccacaatggttgaactaatttacacttccaccaacagtgtaaaagcgttaaacagttacctttaaattaaacagtgtattttcatcattcatgtaaactcagaaatttccaaagcacattttccccaaagcaaaaataaccctttctaacgcattataaatgccattatatacccaatgttttcaagttatttttcattgctagaccttttttcatagttaaatatgtacttcaaataaaatctcataggggagtccaacagataaaagaggaaaaaagaagcattttttaaatttttttatttttatactttaagttttagggtacatgtgcacaacgtgcaggtttgttacatatgtatacatgtgccatgttggtgtgctgcacccattaactcatcatttagcattaggtatatctcgtaatgctatccctcccccctccccccaccccacaacagtccccggtgtgtgatgttccccttcctgtgtccatgtgttctcattgttcagtttccacctatgagtgagaacatgcggtgtttggtttttttgtccttgcgatagtttgctgagaatgatggtttccatcttcatccatgtccctacaaaggacatgaactcatcattttttatggctgcatagtattccatggtgtatatttgccacattttcttaatccagtctatcattgttggacatttgggttggttccaagtcgttgctatcgtgaatagtgccgcaataaacatacgtgtgcatgtgtctttatagcagcatgatttatagtcctttgggtatatacccagtaatgggatggctgggtcaaatggtatttctagttctagatccctgaggaatcgccacaccgaagcagcagcgagtgatctagaacttggctgctctgtcactgccttcatttcttctaaatccattcccattccccaaacctccagactaaatggatattcatatttctcctgtgattccttggtttctcaatccttaatttggaagcacttgtggaagaatcaattgaaggggacagagagcaaaggatggaagctgaaacttccagaattattctgggctagccatcagtggccaagctgttgctgtgtaagagggggtcatttattcccttcttagaatttcccagtgtcaggggctgctctgcatgctttcacactaccattgtgcaaaggtttcaaagtatcatgcacagtaaatcctgactaaagcccaataagagtacaggttatacatgaagaaatggagaaaggcagttgtaaggaaaataatggaaattcacttgagggcggctattctcatcctcaagccaccttcttctgacaatcctgaaaagtagttaatattttgttattttttaaaaaatatggctggatgcatttcaagccgtcctctttcttaaatatatctctttgcctcttcatgtttaattcatgctcatatttgcccacatttaaagctaggctggcttcacattggaattgaaaatagccctaggagcatgaggaaccctgagagcctgggtgtcctcagctgtcacaactgggtacctgcccctttgtgtttgctgccctctctgcctggctagaggcggccccaggcttcctgggcatttttaaattactgaaacaagagtattataataaaacacttaacattttaatacatagtttttttttgctattgttgcttttgtgtgttttggggatgtctgaggcctctgcccttgactgcaattggtccttctgctgtggcctgcccctctctgtgtcacaagttgcagctgctgacaggacgcaacttctattgccccatgtgccaccagaatcattgttcaagctcccagtactctcagacagatttgtgattgaagaatcattgacttcacttggaaatcatctctatttctagtgttgtctgtcacagataaaatgacaaattgatcaaatgcaagcaagcttagcattcagcccagtactgacttcatatcctgggcaactttctgaattcattctgactgggacccactgcctatttctcttgtttcctggatctgactgcaaaagcttcatgtagggaaggcaggtaaagtcctcagctagggcactaatagcagtgaggttcccctagactggaaaaaaaagagtgacttgcatttgtttgcttgttttatgtttccaggaaagttatatgacagggaagaaacggtagtttctccttgtgatctcaggattaactggtgtaccacaatgtataaggtccaaatgaacatttcagaaaaattgatcaactgaagggaacatttctgtagctccattttgttcatttcaaagactctcttagttgagaaaagtctagctacacttaaaaatagtcccttttattgttcgtattgtctaccctagtaggtatgaagggacttctggaagttctcaagttcttggtattgctttccctcatgggcagattaatctaggctgcttcagtcttggtgattccatctccccctgttcagtcaagagaaggtgggactgtgccgtgcaggtaaaggccattggcagcctctcaggactaaaagtgtgggcctgtatttgtgtttgtctgtgaagtagagtcacaagaaaatctttaggtcaccatcagacaactttggtaatacagggaaaagcaaaaaagtctcaaaaattattctcataaatcttgttgtgttaaatgctgcttatagtatcaaagctgcagaacagaattacagaaactctggagcatggcagctgaaatggtggagagaggtagtgtctccctgagagtgtggggccctcttgttcatatgactttccacatctgctcagtcctgccttctttccaaatttcaggtgtcttccttgccttcaggctggattactcctagtgatggctctcactaccccatggttatcttgtgtcagctgcagtcagtgcctcattcccgaacatccctgcttgcctccctctgtcctggatgcaaaagccaatcttcacttcaacctcaactattcccacggaggaggagttacagctgtacagtgtctgctccaacccgtgggacacacagagaccctggtttgctcagagaggctggttacagccagcaaaaagcacagaggcaaatgttaagaggcaaacgttgacaagtgaaacaggagtgggctggcttcatggaaacaaagacttacttagccttataaggcccctgcatacacagccccacacttaattgaacgctttgacctctttaacacttgtttaatttgcctacattcaaatgagtgctttgtgttgcagtgttctatgggtctgacaaatgcatatcatggaaccatcattacagtgtcatgcagaggagtttcaccacccaaaaatatcccctacgcttctcttatttaactctcctcattcctgaacccctggaaaccaatgatcttttcactgtctctaccgttttgcattttctcaattgtcacataattggaatcctacagtagatagcctttcagaatggcttccttcacttaacaaaatgcattttagattcatctatgtctcttggaggtttgatagctgatttttttcctaaaaatatggcattctgtggtatactccgatttatttattcattcgtcttctgaaggcagttacaaatacagctgcaataaaaatattcagaccttacataagctttcaaatccattggtaatgcttagtagcataactgctgcatcaagtggtaagctctgtagggaattgcaaagctgttttccaatgtggcaaaaccatttggcattctcttttttgccactgctgtcttctccttcctctacctctccctctttccattcctctttttcttcttctggtctcttcctcctctcttttttttttttctgtcactttctgtctctctcttcacacacgtgcgcgcgcacacacacacacacacagggatagtttaggaaattgttggaggttatctaacatgttagttttgaaattaacaagttgggaaaggccattatagacaatactaattaatacaaatgaattataaagagaagatacaatatgaagcctcttcctcaggtcccagtattagtcaatatcttcctctatttatctgcaaaatcaaacctatagttgtccatttctttcttcttgaacttccaggtgtccatgaattctataaccatcagctctatcagccttcttatgcatgttctgttcattatttttgttctttatcatatcgagatatatatttgcctcatcctataatctcacctttctccctgatgttatctctgtgtgacactctgccaaaaagacacactttcccttactaaaacgtttcctattttgatgtagtcatgcttgcttatttttacttttgctgcctgagctttcaatgtcatattcaaaataattattgctaagaccaatatcaagaaggttttccccatgttttcttctacaaattttactgcttcagatctcatattgaaatcatcaatttattttgagttgatttttgtgtgttgtataagagtccagtttcactcttttgagtactgattcccagttatcctaatgtcattgtgtcttctttgtggccttcccaaaattagttgaccatgtatgcttgggttgatttttgggctctctactctgttccattggtctatgtatctgtttttatgccagtaccatattgttcttactactgtagctttgtcatgtaatttgaagtcaggaaatatgataccccaaactctgttttcagctttcaagatctcattggttatttgagtctttcagggtcccatataactttagaatgtttttctgttcctgtgaaaatgccattgaaattttgactgagattgcattcaatctgtatatggctttaggcagtatttgacattttaaaaatattaaaactttcaagccataaacattagttattaaactaaaaaacatttgcatggaaaaggaaataatcaacacaataaaaaggtaatctatggactgggagagaatatttgcaagctatacatctgataagaaattaatactcaaaatacataagcagttcccacaacttgaaaggaaaaaagtaatctaattaaaaaagggcaaaatatatgaatagacgtttttcgaagaaagacatacaaatagccaaacatatgcaaaggcattcaacatcactaattatcaggaaaatgcaaatcaaaatcacagtaagatatcactttacatctgttaagatggctataataaaaatgacaagagataagaggtgtcagcaagggtgtggagggaaggaaacccttgtgcactgctgctgagaatgtaaattggaacagctattgtgaaaaactgcatggagttttctcaaaaaattaaaaacagaactactgtatgatccagctatcctactgctggttatatacccaaagaaggtgaaatcagcatctggtagaaatatctgcatttgtcttttctttgtagcattattcacaatagccaagatattaaaacaaccctaactgttcatagatggatgaatggataaataaattatggtatatgtacataatataatactattcagtcttaaaaaaggacatgctgacatttgcaacaacattgttgagcctggaggatattacactaagtgaaataagccataaacagtaagacagatactgtattatttcacttatatgtggaatcttaagtcaaatacacacaaacacagagtgcaatggtagttacttgggaggagagggtgtggaaataaagagatgggaatcaaagagtacaaacttgaagttatataggatgaattagtctagagatctatggtacagcatgaggactctagttcataatactgttctgtatactggaaatttctgaagagagtagactttaggtgtgcttaccatacatacaaaaaagaaagtaataaaacgtcttgaaactagatagaagtaatatttgcacaatgttgtgaatttactaaatgccactgagctatatactttaatcaattttattctatgtgaattttacctcaatgaaaagaaatgcaagagaaaatgggagaaaacagacttcctattatacaaaacccaaacataaatcccaccaccttcaacacattttttttaggtggcccatcctaattattccttttctatctttctatataatagcattttagattaattttgcttgcgtttcccaccagattgtgaagcctttttttttttttttttttttttttttttaacaaagttttgctcttgttgcccaagctggagtgcaatggcacaagctcggctcactgcaacctccacctcccaggttcaagcgactctccggcctcagcctcccgagtagctgggctaacagatgcacgccaccatgcctggctaaatttttttgtatttttagtagagatggggtttcaccatgttggccagtctggtctcgaactcctggcctcaggtgatctgcctgtttcagcctccctaagtgctaggattacaggcgtgagccactgcacccggcctgtgaactcttgaagagaagtcttgcattactccattgccaagagtacttctccctcctagtcacttcacacagccctgtctgaactgtgctctccaggccagcattgttggtggtgattgctctggacctcacttttagttaacttaatctgactcatgtcctatgcttttacacatgccccatccttaaaactcatttctttgtaccttgtgtgtctcagatcctgcatctggatatttggacttgatctttgtttttattttcctaatggagtttatcataaacttgactgtagttttattaattgctttaatataatttcagccttcttgcctttccaaaaacttattctccaaaaacaaccatttggttagcacgtgcatcagtcctacctccatgaataggtggggaagggcagtcagcagagtttttcaggtgctatttctgggctatacattctcattttataaatttaattgggtttaactggtacttacaatatttatgttttcaacaagttattttgagtatttaaggaagaaaataacactagtataatgtatactgtgataatatttaagggatttcatttttatttttaactgtgtaattgctagtatgcatagaaaaatgatgagaaaatgaagcaaaatttaatctgttaacatttctcagtgatggatagtaacatgtacaaagttatatgcttttgaaatgtgatattatcttttattctttaaaaagttcaatttgggctttgctgcatattatttcttaatatgtagaaaaaataagaaggaaagctattgattttcctccagtatgaaagaaaatcaatagtgcaagaagggccaattgaccaagcaaagaaacagttcccttgaaataaatgttgtgacagaatacaataattattctgctatttaaaaaccaagccagattttcaaaattattctacacttctttgttacagtatataatgtatgaactcaatggagcaagtggtgatatcatattaagaatataatattattttctaaagcaagatcaatacgaagatctattttagaagagtgtcatttgcagcatgagcaccccagtctaaatgcctaagggttgaagaggcaaagaataacacatatataataataacaccagtcaagtttatgcctttttaaaaatgagaatgcaccattcagctttgatatagatatggtgggttcttttattgccgattgcccttctccaaagttaggtggtgagataatggcagatcaacaactgtctcttcaggtttttgtcaactaatccaaatatttttatgacatgacattaaaccatttttatattgcagggtataaacactataagaaataaatctttagttgagtaacatgtaattagtaagctgaaagagataaataggtacaagatgcatgttactaaataaaatatattttatgtttatgagtacagatatcctaatatattagttataaaagtagccctatttgcaacaggaagcattttttcaagaaaaaaatgtgatttggcacgtgcgtgtctgtgtgtgtgcgtgtgtgtgtacaccagacatctcttaaaagctacttcagattctcttaatttcatcttttttggtcacttcttccagcttcagccactactgcagtggtcaagtttctggagtttgaaaaaaatttatgcaagcacaagtgaccagctcttcatcttaaacctgcatcccatatcactcctcttttttcttctgcctggaaattttctattgagatgaggcacaaacaaatgctatggaattaattgtccatgaggcaaatctctgacaacctggagactagagccaataaatatattattctcccctttatcctcagagacaccatcccaagatgatgtcactgatgccgcataccaagtggtggccaactttacattacatcctctcacggtttgccccaactgactgtaacgcctaatctgacccattctgttaccttgctcctccttgcttttcctgatctccactctcttataaaccactactcctttgctaggcatttcatcagaatgcattgcttattttcatactgatgacatcaacctggtcactcctgctcatttactcaaggttttagtgtttgactaacagtgtttctctgcgctatttctgtaagtcttacgcttccgcattcacacagaagattaattccacaccctggctttcagtgctatgctgcttccctctcagctatttgtgcatttgtctgcaggtgcccattccctaaactgtatgattgcctgtgactgtaccgtctccagagtctccgttttataactctatatcccattttttcagcccacttaccttagttatcctattccagactaagctgaagacttccagtcctcaaccctttaccttcaagtgcccatagcacgttatggcttcattccatccttatacaacttatattccataatacatcagtataatcaccatttacataccttcccagcgtttttgcctttctctccttcccacagcacatctggaaaaatcttaaccataattaaactaaatttctatctgcttccccaagtagcaaaatatgactcaaagaaaacatacaactatgctgatgagttcgccttcaacttgtgacccccaaacctcagcccagtcatgactcttacttatgagtcatcatttgtctgaatttgctatttatatctattttctctccaaactttcagcaaatgtcttttatcgctgtatttaataaccttgccttaactttactactatagcagcattaataaaaaaattacttatctattaagaaaatctaccaaactagctgcatttattcccgtatcccttcttactatgaaggaaatgtatatgctcccatcttagccaaaaatccttcacttttacattggattccattttttttccacccgcttaaggactctgcttctgaaattgtatcttacttattcaagtatcaacagtttgtctctctctgcttcatttgtctatttccattagaatacaaatatggttacatcttttttattattattattattttttgagatggagtcttgctctgtcgcccaggctggacttcagtggtgtgatctcggctcactgcaacctccgctgcccagattcaagcaattctcctgcctcagcctcctgaatagctgggattacaggtgcccaccaccacacctggctagtttttgtatttttagtagagacagggtttcaccatgttggtcaggctggtctccaactcctgacctcatgatctgcctcccttggcctcccaaagtgctgggattacaggtgtgagccaccgtgcccggcctacatcttaaaattaaaaataaaattcctcctttaactccacttattttggtagcttcagcctgaaatgtctgtttcctgcaatctcaatctcttttaaatggttgtaattatggtatgttttcaaatcttcacattttagtcacctttgaaactattacaaataggtcttaactcagcattccactgaaaccattcttatcaaacgagccaagggaaatttaatatgtgtcccagtgagtttacccctgacttgaaatatctccgtcattcagattcctttttaatggttaaacaatagatattagtgccccaaatgtaaaaacataaggattggtatatttttgaggaaaaaaaattaaaatgttcctagttcagtattaaatatcctttttgtggtatttaagtattattgactttgtaaatgacagttatttattactgtgaagattctcaatatttttataatataaaattatgattgttcttttttaacaaaacaaagaaaaatttgagattcttcttattcaaggttatactttctgacattgattcctctgaagatgacaaatgtcttcacaaggtaacagtgttttataatatgcttagaaaatagaatcaggttcatatggtttgcatctatgtccccacccaaatctcacattgaattgtagtaatccccacatgtcaagggcaggaccaggtgaagataattgaatcaaaggggcagtttccccattctgctctcatgataatgactgagtctcttgagatctgatggttttataagcatatcacataacccctgctggcactcattctctttcctgttgccctgtgaagaggtgccttctgccatgactgtaagtttcctgaggcttccgcagccatatggaactgtgagtcgattaaacctttttctttataaggtatccagtctcaggcagttatttacagcagtgagtgtgataatggactaatatacatgttgtgttaaaagttgtccaaagaaatactgcttaggtcaaaacctgatgctgccatttactagttgtgactcatttgacagtttcttaaactctctgagtaagttcccacatagaccatactgctatgataaatataaatgtatatgtgaaaactgcttaaggtcatatttatcagacaatataagcaaataatatatgttaattggttaagagaaatcacacctttttttactttaaagttcactaataattgtggaaaatattcttttttctttttcctcatcaaacttttatctattaatgtacatttctatgaattcatttttttctatattatacaatggaagataatataacactattgttttttattttatttatttttttttaattttactttaacttccaagatacatgtgcagaaagtgcaggtttgttacataggtatacatgtgccatggtggtttgtttgctgcacctatcaacacgtcatctaggttttaagccctgcattcattaagtatttgccctaatgctctccataccctagactcccacccccgacaggtctgtgtgtgttgttcctctccctgtgtgcatgtgttctcattgttgaactcccacttaggagtgagaacatgcagtgtttggttttctgttcctgtgttagtttgctgaggatgatggctgccagcttcttgaaccatgtccctgcaaaggacatgatctcattcttttttatggctgcatagtattccatggtgtatatgtgccacattttctttattcaatatatcattgatgtgcatttaggtaggctccatgtctttgctattgtaaatagtgctgcagtaaatatatgtgtgcatgtatctttatagtagaatgatttatattcctttgggtatatactcaataatgggatttcctatggtcaaagggtatttcttattctagaaatcaccttaattcaaatcaatcaaagtccttgaggaacactgtcttccacaatgtttgaactaatttacattcacaccaacagtgtaaaaacattcctatttctccacagcctcgacagcaaatattgtttcttgactttttaataattgttattctgactggtgtgagatggtatctcattatggttttgatttacatgtctctaatgatcagtgataatgagctttttttcatatgtttgttggcggcataaatgtctttttttttgagaagtgtctgttcatatccttttaacactttttgatggggttgttttgtttttgttttgttttgctttgtttgtaaatttaagttccttgtagattgtggatattagacctttgtcagatgggtagattgcaaagattttctcccattctgtaggttgcctgttcactctgatgctggtttcttttgctgtgcagaagctctttaattatatcccatttgtcaattttggcttttgttgcaattacttttggcatttttgtcatgaagtctttgcccacgcctatttcctgaatggtattgcctgcattttcttccaggttttttatggtttggggttttacatttaagtctttaatccatcttgagttaatttttgtataaggtgtaaggaaggggtccagtttcagcccaaagtaatttataggttcaatgctatttccgtcaaactgccactgactttcttcacagaattagaaaaaaactattttaaatttcatatggaaccaaaaaagagatcatatagccaagacaatcccatgtcaaaagaacaaagctggaggcaccctgctacctgacttcaaagtctgctacaaggctacagcaatgaaaacagcaaggtactggtaccaaaacagacatatagaccaatggaacagaacagagacctcagaaataacaccacacatctacaacgatctggtctttgacaaacctgacaaaaacgagctatggggaaaggattccctatttaagaaatggttctgggtaaactgactagccatacgcagaaagctgaaacaagaaaatgttatacttacatttttgtttaacttttacagtatctttgttaaatagattatgtgcttgggcccattttatagcttatagaattaaaaaaataagcaatatcaaactgcacaaacccatacatatataaactcaggatgctattgttttagagttttcatgagcataaaccaatggtcacatttcttttgctctgagatgaggtccatggtcagaaacaatactacgtacaatgccatgatatttgaaagggcattttattagttcatggatggtaattttgcaaaagcactgtaatcagggaaagcaaatcaatacctgtagtaagtattccactatgaacaaagctctgcccttccatgatggaagtggcccagtgaaaacaaccaggcagctggctgatcacccaggaagtggttccatgttagcagggactatatccaaatcagcccaggtgagtggaagacagtgtttttcagcacatacatattatccatcactgccaccttagccactttgtcaccagccaatacttggatatgatagtaatggctggtgaaagagcctggctgacatcaacagaacaggccattctattttcattattaaaatattggtctactgaatccacttattgacaatcattctcaaagaacacgaatatctttatggtgttccattcagtgaccattcagtgaggtctacccacatgctccttccctagacttccttgccaccaatattccaatcacgtttcttcaaatagtgaaccatacaggcaagccattggcttcagctcatgaatcattgtagtcccccatctttagccctctctgcttccaggcaaaatgaacaaccaggtgcactcatccacgttctgcccactgggaggattttcctttgcgattgtcttcaggaagaccctgtaggtgtggggctgcagtattgcagctgcccatctcagacagtacgtgcacatcattcagatccatttgtaaactacacaagagttttttcaccctcagatagtcatagggtactctcatgtgggttcaggtacaagctgagagagaaaaagcagtgtagcaagagtaagagccatgcacatttgggacacctcttcatgtaactttcctattccttcaaggtgtgcctgagtccactctggtaaacaccacttccatttgataatggagtactgcagtgcacacccaactgtgacttttgggggcaaacaatacacagttcacaatggactatctattaagtccctgtagcagaccaaaatctgtttctcaaaagcagagtagacgttcactgaggatagtaaggccttgatcccaaatcctaaaggcctgcactgtgactcacctgtagcaaccctctctgccactgacatttcaagttccctgaggtgtactctatcatgaaacccaagaggcagagcagattgcatagcagcctggatctgttcagagcccttttgtgttctgggcctcacccagcattagcaacttttgagtcactatgtaaatgggccagagaagcatatcttaatgaggtacacacttcctccataatccatggaggtctcacaggaatagcacaaaggtggaaaaacaacaacttatcctttacctagacaaggatattttgacaatctccaggccactgggccgtggaaactttgaaagacacataattaagccatcagaggtattatgaatttaaggatgaaattaatgggatagaaatatagtactttttattgttatcctatgtcattgtttatttttttttcagtagtctttgacatcataaagcagtggttctcaaaagtgagcatacaatggaatcacctggatatcttgttaaaactctggttgctaggccctaaccccagagtttctgattcggtagatgtgggaaggagcctaggaatttgcaattctaagttcccaggtgctgctgatgcagggaccacactgtgcaaaccactagatggagaaagaagtggatgatttatggtagaaagcaagttataagttgactgtaatatgatttgtccctgataactctctgttttgtttctgaatttgttctgtgggtaaaggatactctgtgtaaaaggaaagttaacaacattcaaactccaggtaccaagtctgctgtaagaccacacagacctctgtgtcaagcctccttgtgtctaggtgctgcatggcatttacacagcagaacagaacatttaatacatttcagaagagataaacattttagtataaatatttagtattttaggcataaaatatagtgtttttcaaaaaactataaaaatagagataggattttaacttgatttcagtagcacatctaataattgaacttttttgaatcccaattctaaattctaatctaagttaaattctgatctaagttaattcttctctagaacacgtttgagtgaagattattttgtgaacaatgggaagacaattgcttgtgttatagatattccctattttctgtttgaatgttgattactcataagtcatttggtagctttcattcatttattaatccattaaacaagcatgtactgaatacctgctatatactaggttatctactaggcactggaattcaaagatggatacggtataattcagcctttaaggagctcacagtctactgtaactgagtcttctcagagaaaggccagcattctgcttctgattctttctagaacaatattatatttcatagaatatgatatttcatgcaaaatacagctgttaaccatatttttatagttattacctccctggattgaggagaacagtcagaacaaaaggtggtaatatttatatttcatattttctgcttttaagattatatttcagatttattttcactcaatgtgcccaatttaagtctattgttgataacattgataacatcagtaaggttatgactttgcaatcagtttgaaatgcatagctccagttgatttaaatgatttctctttgagaaaaaaaggtaatgaattggccgtaactaattagcatgccataaatcatcacactggtgttcttttctacttgaatacctgagaaaggtatactaacagaaaatactctctttctctttttttaagtgtttgctagtgccttttagaggtaaattgtttcaataaagcttcttgcacacacttgcagaacctttgaaagccattttactacctcctgttgacaaacagcaagatcctccgcacatcacagaggtgacatgcttggtcatttgggggtggatagtggaactggttccctgtgaggaagcagccacctgttcactctttcagtaggtgaagcaaaacagctagagcatatgaagaaacaaggtggaatgacacgacaataagaataaattgggcttagatagaatggtgcaattatgctacaaacagcttgcctttcattgccataaattatgccgggttatagtattattttctggataagcacttcgctattttttctttcactggtcttctttttacattttaccattcagaattctctattttcatcagtcttgccatatatcatacttacgtagccttctgaaagctccaaagtttatgagacttttatgtcaaatatgttaggctgggttttgtttatttgttatttatattatgctgtggtgtttctgggataaaatcctctctgtcctcactataagcattacatacagccatttggtaatggtaagaaaactaagattttattgtaacagatattttatcctttttttggttcatcagaagcagtattgaagggcaaaaggagaaaaatgcttggcaaatcgttgctaattttgaaatattgggttatcagcataggatgctctaatatgccaggtgaatcagtaagtagtgttccattgattcacaagagcactactggaaatagttcggcaaatcatttgcctcactatctttggttaatcagctgtaatttatgttgagaaacaatcctctaatacagaattatgaggggaaactgttcttgttttttaaaaaaataaactttaaattctgggatacatatgcagaacatacaggtttgttacataggtatacacgtgccatgctggtttgctgaacctgtcaacccatcacctaggttttaagccctgcatgcagtaggtatttgtgctaatgctctacctcccctttctcctcaccccacaacaggccccggtgtgtgctgttcccctccctgtatccatgcaaggaacgtgttcttgagatgagactggtgataccaatcaccattgaatatttgtcctctcagtatattgtctcagttagcctatgtatgatgggacaataaaagggagaatttcatggtcaataactcaaaagcaaatgtaataaaaacaaagaaaaatagctggggcctaattaaactaaagagcttttgcacagcaaaagaggatttccaaatatcaccatattgtttttacctttccgtgtttactggacttcatggagtcagagaagccacagagaaggcttccgtgtggcctgatttattgagagccctggtgtgcccagtgggcatcccaccctgagtgcagcacaagaaagccaaatctccaaaaagcttttgttgttgttttgttgtttgttttgtttgtcatatctttttaaaaagaacaaaaccagaagcagcttggtattatcagattccactggcctgggatgttggagtctctggctcaacaactcatctgctttttaggtttgagaaatttacttgctttctttggtccttagttttttcatctgtgaaataaggaagttaggcccattttgttgttacaccatcatgtaacatttccctgatcattattgatgttgagcatttttttcatatgtttgttggccatctgtatatcttcttttaagaattgtctattcatatccttagcccacattttgatgggattgtttgttttactgatttgtttgagtttgttgtagattgtggatattagtcctttgtcagatgtataggttgtgatgattttctcccactctgtgggttgtctgtttattctgctgacattccttttgctgcataaaagctcttcagtttaaataggtcccagctattttttttttttaattgcatttgcttttgggttcttggtcatgaaatccttgcctaagccaatgtctagaagggtttttccaatgttaatttctacaatttttatagttttaggtcttaggtttaagtccttaatccatcttgagttgatttttgtataaggtgagagatgaggatccagtttccttctcctacatgtggccagccaattatcccagcactatttgttgaaaaggatgtcctttccctgttttatgtttttgtttgctttgtcgaagatcagttgactgtaagtatttgggtttatttctggattctctattctgtttcattggtctgtgtgcctttttttataccagtaccatgctgtttgggtgactatggccttatagtatagtttgaaatcaggtagtgtgatgcctccagatttgttctttttgcttagtctgctttggctgtgtgggcttgtttttggatccatatgaattttataattattttttctaattctgtgtagaatgatggtggtattttgatggggattgcattcaatttgtaaattacttttggcagtatggtcattttcacaacattgtttctacctatccatgagcatgggatgtgtttccatttgtttgtgtcatctacaatttatttcagcagtgttttgtagttttcctcatagaagtctttaggctccttaggtatattcccaagttgtttttttgttttcttatttgtttgtttgtttgtttttgcagctatagtaaaaagggttgagttcttgatttgattctccacttggtcgctgttggtatatagaagagctactgatttgtatacattaatcttgtatctggaaactttgctgaatccttttatcaattctaggagctttctggaggagtccttagggttttcaaggtaaaggatcatatcatcagcaaacagtgacagtttgacttcctctttgccaatgtggatgccctttatttcttccttttgtatgattgctctgactaggacttctagtactttgttgaagaagagtagtgagagagtgcatccttgttttgttccagttctcagagggaatgctttcaacatttccccattcagtattatgttggctgtgggtttgtcctagatgaccttcattaccttaaggtatgtcccttgtatgctgattttgctgagagttttaatcataaagagatgctggattttgtcaaatgctttttctgcatctattgagatgatcatgtgatttttgtttttaattctgtttttgtggcgtaccacatttattgacttgtgtatattaaaccatccctgcatctctggtatgaaaaccacttgatcatggtggatcatctttttgatatgttgttggattctgtagctagtattttgtttaggatactagcaaatacattcatcaaggatatcaatctatagttttcttttcagttatgtcctttcctggtttaggtattagggtgatgctggctccataaattgaattagggaggtttccttcttcctctatcttgtggaatagtgttcaataagattggtaccaattcttatttgaatgtctggtagaattctgctgtgaatccatctggtcctggacatgttttgttggcaattttcaaattagcatttccatctccctgcttgatattgttctgttcagggtatctaattcttcttgatttaagccaggaagttgtatttttccaggaattactcatctcttctagattttctagtttatgtgtgtataggtgttcatagtagccttgaatgatcttttgcattccagtggtgtcagttgtaatatctcctgtttcatttctcagtgaggttatttggattttctctcttcttttcttggttaatcttgctaatggtctattaattttatttatcttttcaaagaaccagctttttgtttcatttattttttgtacttcttttggtttcaatttcatttagttctgctctgatcttggtaatttcctttcttctgctgggtttgggtttggattattcttgtttttctatttccttgagatgtgaccttagaatgtcagtttgtgctctttcattttttttgatgtaggcacttagggctatgaactttcctcttggcaccgcctttgcattagcccagagattttgatagattgtgtcattattgtcattcagttcgaagaatttttttacttcaatcttgattttgtttttgacccagaagatgactctttctagaaagcatcagctgtagtagtgtacagagagacaggcggtgggcagggccctagaactcacaagattatatgccccttgtcttctgctaccaggatggatagggaaggaccatctggtggggacagggctaggcatcactgacctcagtctctacttgggcagttcttgctgtggctgctgtggagaatgcaagtgaggttcccatgtcactggagttgtgtacctggaggactatggctgcctctgctgagtcatgcaggtcatcagggaagtgggggaaagccagcagtcacaggcctcacacagctcccatgcaaacctaagggctggtctcactcccaccgtgacccccacaagaaccctgagtctgtttccaaggagagggcatgatgggcttgaaaacttgccccgggatacctgccttccagctgtgaaagaaaagggcttggttcttcccccatctgtaaagtctgcacaccagatttccatcctccctggatttctggccaggaggtttctcgccccgttcaaattgttacaaaattcagctagagatttccttctccctgtggagttatacctcctgctcctctggtcaccctcccaatggatccctgttatgccaggcaagaatggcctgctaggggatgcggcaagctcccagggcctttctgcttcttcctctacccctgtatttcacttagctctctaaattgactcagctccaggtaaagtcagaaaggtctcccgcaaacagaccttcagcttttccactgggggtgtgtgttctggagagaagggtctccctttcccacttctgcagttgtatttggggtgtcttctgggtcctacaggagcagttcacttccttcagagggtctgtgggtcctctcagggctgttggtttgttcttgcagtcggcctggagctaaaattcacaatgagagtttgcgcaagctgctctgtctggaattgcaactagtcctgcctccggtcctccatgatgatgattcttgagatgagattttaatatcaataattttcatggggatctttatccatccaaacatatgaaagtggcttaactggagtaaatttcaggaattatttgggcttaatataaaaactatccttttatgtaatgtccttagtctgtttcacactgctgaagttgatggaattgtcccaggaaatcactgttgtataaagtctaatgattctctatctgagttgaccagtatccattagagtttttgacctagtgtcaaggcaaaagcacttaaataattgtcagaaggcctggacagaagaccctgatttgccattttatggctagcaactggtatctcgtaatccatgcaactgtctcagaattaacaagtacatgagattcttatgaaagcctaatgaaatgatttgtgaaaactgcaatgcacaatgaataatcatgattattaaagataaatttagaatatttgtagaagctgcctttaaactctctttttctcttctttaagccgtgtctacttttacagcaagtgtggatggttgaaggatctctctctctcatttgttttggattatttggatcaaagcattgtctgctttcttttttaatttcattctatgtagaaaagtactcttcatagaagagcaaggagaaaagttgtttggggccagacttggcaagtagatgtgaacattcttgatgttttaaaagtagcatataggctgggagtggtggctcatgcttgtaatcccaggacttcgagaagctgaggccggtggatcacttgaggtcaggtgtttgagattagcctggccaacaagctgaaactccatctctactaaaaatacaaaaaaaaaaaaacaaaaaaaacccaaaacctagtcaggcatagtgatgtgcacctgtaatcccagctactcaggaggctgaggcaggaaaatcacttgaacctggtaggtggaagttgcagtgagctgagatcatgccacggcactccagcctgagtgacagagccagattctgtctcaaaataaagaaagaaagaaaaattgaaagtagcatacagagagagaaagaaaacaggaatttttaaaataaaagataccactttgctactacttggtttattttcttgaaaagtaggaactggaagagtaccgaaatttagcaaaaatgattgttatttatttccatatttatttttctttgtggtcttcacttgcaaatagttgaattaatcatattatttggtctatggaaaacatcaccactggcctatgcaaggcccgcctgattatacatttatgtgtatgtgtgaatatgtaatatgtacataaagatatatacattcaaatacattcctgtaagcagtatttctgttgtctgtttacatacattttaggattgcatagtttattgtgctctaatgctttctcattctattgtacttttgctcagcatttttttaaaaacttgtctctgttaataggtgcaccttttctctatcttttagtttctcagtattgttctccagagattgactttgagattgcatccagggccttgtcatcacaggataacaccagaatgaatatccttgcatactttcccttgtgtgagaatatctttggaatatttatctgtgatctgactttctaagattttcacatgcttaaattttgtattgccagattactgtccagagtggcaagctacatatcactaaaaataaggatattctactttatcattttaccttccacattgaggtttctgatgcatctcgtttcaaacttggaacatggtgttatgcaggtacacagttttatcatttttccctagtagtaaacatgtcctagtaccgtcttctaaaccatctatttttcccgttggttttactggcatatttattatattttctttttttattttaaaaattatcagtctttattctcatatgcagttcaaacaatacaatttaacaattctaagacattattttcaattgtcacttataaattgaccattcttaaatctctctcttgtgttctgttggtgtccacttccctaccaatgtcattatatttatttccgtactttgcagtttatctgcacatttgtcttcttttcagaatgagccccatatcagatagcagcctgtgcccagagcgcaggtgaagtctcccatttgccgcccctcagcaggtgcatcctaggccagtgacttgactttagactcagaaaaaaacagcatctgattgggagggatccagctgggagaaagcagtctcccgggttgaatccgccggctctgaaggtggcagtggggagaagggaaataaatgccctttggcgacttgtcctgctaatagcgtttttcctttcctggttttatcatgccacaccatcagtttgagttgctgattatttctctggaaataggataggcaatcattttacaaggcaatatggggcaagtaaatcctgaagcagaagatttttctccagccttgacacagtcctcaggcagctacagagcccaaatctgttcctcaaatctacagggctctgcaagccctgatgatttacctttgtgacaggtgacagacactcaggaagttcataatagggaaggaggcagagtgattaacatcagcagcaaagtacagtaaagcatccatttcttttttaaaatgtcatactttcttttaattaacaacttgatgccttgtagaatttttaggttcagaagctagcaagtacagctatgaatgctacaattcaaggaatcacagtgtgtttccacaatcatttttccataccagccaatacactatgatcttggacttttttggcatcacaatcattaggaggttcaagtcttttcgtagagtatcaacagtatgaaagaaagggacctcaaagctaaaatccctgaattaaagtcctacttccagtgcttgttaaatgtgatcctggtcacactgtttttatttttggtggaagttgtaaatgaaatgcttacacagggaattagtactgaatatggttagcattatctcacctgggaagtcaggagcaaaagtaatgtcatcaggctcagatttggaatgcattctctgggatgaagacggtggaagatagtttcttctattctgtaaaagtttttatttttctttgcagtgtttttttttaaaatcacagtttcttgtgattagacaaaactgttgaatgttgaaacacaacgattaggacttaatttccttttttttttttttttgagaccaagtttcactcttgttgcccaggctacagtgcaatggttcaatctcggctcactgcaacctctgtctccccagttcaagtgattctcctgcctcagccccccaagtagctggcattacaggtgcccaccactacacctggctaatttttgtatttttattaaagacagtgtttcaccatgttggccaggctggtctcgaactcttgacctcaggtgatccacctcctcagcctcccaaagtgctgggattataagtgtgagccactgcgcctggcaggacttaacttctgatgtgctcatagtaaagcaaatcaaccaacgtggagttgagcccaaaattgtgttgaagcaattctgagaaatatgtggcaggacaagcagaccctccttgtgagtacagattctaggaaattatgacgacgctgagtgcaggtcgtcagctgccctgttttggtgcatgactgccttatctacaggatagtatggaacctggtggatgtagggtgcgagtcagccaacagctgttccaatcttccagtgggccttatcttagcagagagtgcaaaatacttcttgcacgtggtttcagtttcatcagtgatttgatctgtagggaatattgattctgaagtgaatgacatggataaagaaacaaaattagggaacctgtattgtgggtgtggattttagcaagcatttgggcgctaataggatgataggcaaggagtgcaattagctatttgtatcattcccccaacaaattggtttttcttttgagagtctgaataatataaatgcttaccttcatgtgcctacctggttgttttagaaaggtgtatgtgacataataacagcaaatattttcttagcccctgcttcctgccagacattgtactaagcactttgcatataatgactcactgagtcctcaaacaactctgtgaattaattcccgttagtatctccactttacactgaaaaaacaaggcatcaaaatgaaaataattttccaagggtcgcattgagcaagtgctggaagtggaagtgggactttatctcaggcagtttagctctgaagtctcctcacttaagctcctgaagactatgacatcagaaaatccaaggtcacaatgacttgagctgtggagaaagtaaatgatcatagaaacagacgttgattccttgggttgtagcattaatactcgaaactcaatccccagacttgggctaaaatgaaaagtgtagcaagcagaaatcttctctgtgtggaaagatgtgtacttgtaattctctgctctctcttaaaatctggcctgttccatccaggcgcttactgaacaaaatgccatctacaccagggatgcccttcctcaactctagtcaatttagtcaccagaagcacaagaggagcaaggattggaagcatttgagcaaggatacctcaactgatgacagacactagaaaggcaatttcagaatgaatcacgataaatgaaaaccaaataggcctctgtgaagggaaggggaatgatccatgcaatatttatacatgtgtcagtgatatttacagcaaactagggctaaaaaaagtaaaacaaaccaaaaaaaacctctaagtataaaaagaataaatttgatgtaaataaattgttgactttgttcttcacagtggctaccactatgaatccagtgtacaaatcttaatttattcccctaaatcagagaaggggcttatgttataaatcaaaggaggggctcattcattgtcttttgattttttattttaagcattaaaactttctctaacatcatggcttgctttgaggtatactgatggaatacttcatgaaaaaaacaatatgttatcaagtccttctcaagattaaaaactagaagtttaaaggaggtaacatacatcttatagccatgtgcccaggatcagacaattaataatgaagtttagagttttctcatttatctgtaattcccagaaatttaagtgatattttgctataataatgtggctgaaatctctctttttcctaagaaaactgaattcctttcactgtgatttttaaacataatttaatatttaaaactgttttagatttaaagaaaaattgaaaagataacacaaagagtttccacacattccacacaaagttttctgtattattaacaccttctactagtactgggtatttgttacaactaatgaaccaatattagtatgtcattattaactaaagtccatggcacatttttaaaatttattttacttttatggagcactttcttcctttctagcgctgcgtgacactccatgatcatcttgtttactttctgagttctagaattagccatttctctaaggagccttggtttattttactgaacactgatactagaaatcaggaactgggtgttatgtgtccttgtagctcttgatgtgcttttcttttagacaatctcagcaaacataagtgtgtatattcattggcttttaaacagatatttataaatatttttgtatatatccatttgtatctatattcagctaaacatgaattgataccaatgacctcaactctctaatctatcaccacctgaatcatttagcttcttcttgtctataaattttcacttcaatagttagaaacatggctcccaccatcaaacagccatttactgatgtattcaattctagaatacaagtatagcaatatgaggatttttaacccacgtctccatgggcaacacctttatcaaatacagcaccgttcttatgtgccgttctttttgcatttagccttatagacaatccttctttccagagttacttaggtcagcaccttttcttcccaaccccatcaatgaggttgtttcatatatttgtaatacagttagattttcttatcatggtctgaattccttcctgggatacccaatcctcctttttttaaatttgcatgtattaattttcactttatgttctgtaagttctatggtttttgacaaatgggtagggccatgtatccacaattacatatcatacagcacagtgttaatgttctaaataatctcctgtgcttccttcctctactctcctgtcctcccctccttcccctgatctctcttggaattactgctctttgtatcatctttatatctttgcttttccagggtgtgatataattgaaagcatacagtatgtagtctttttccaccgattctttcacttagcaatgtacagtgtttcctcagtgcccttttacggcttgatagtgcatttctttttactactgaatactgttctattgcacagatgacccacagtttttttatccatttgcttattaaaggacattttgatactttccaatttttggcagcagagaataagttgatataaagttatgtgcagtattatctatggaaataagttttcatttaatttgtaaggagagttaaagtaaatttaccctttttcttctaaaggtaagcattccctcacctcccattcatggcttctttcaagactttctctttgttttgtttttttttttttacagtttgaaaatgttatgtgtaggtgaatgtatttatttattattttactatttatactgctctgtgttctctgtgtattctgtttttttgttttgagtagcattaattttggaaagatctcaatgactattacttcaaatatttcttggttttgtctcctttttcttttgatattgtcattacacatatatgacagctttgaaactgtcccaaagttcttgggtacttcttctttctcctccttatcctcttatttttctccttcttcctcttcattatatattttttgctttttccatttcagttgggaagttcctgttaacatgccttcaagctcactcattcttttctttgccacgtctaggattctgatgaatccatcaaaggcatgtttctgtttcagagtttttcagttctagcattttccttgaatttttctgagagtttttatttacattacccatctgttcttccatgctgaccactttttccagaagtgttaactttagggctccagcagcccatcctccaggtaagacaatctcagctgtttctctgtgttcacctgtctctgcagatttcaggtgacagtttggcatgagacttcagttctttaatgggcccaagaaaagccattaactttcagtgcattcatattttttcttgttgtaaggagtggagtagctatttctaagattttttatacatcagacgtgaaagaaacatattgtattttttttaatagcagcatttcggctccttacttagtggttgttctttgtgtgcagaaaaccaagcgaaaaaaatgtgaaacatataccttttatttgggcatttgtaatggttctgaggagctgaaattgaagcttagtttcgtattaatacaaaatttcatccattgtactattattgtcattgctatgtggcagaattaaatatgtgtgtgtgtgtttctgtgtgtgtgtgtttctgtgtgtgtgtgtgtgttcgtaataaaatcttgttatatttgtactgaagaataatgtaagacttttagtataaaaataacaatgtaggatgactagaaataactgcaacgtcaatgcattttttgtagcaaatctatattttttcaacctaaaagttatgttgttattgatgagctctgtaaagggcaactctgcttttgtgacctgtcagttttataaggtgatgaaaaatgcataatgataccccctggaaaaatttagtagatacattttgtatacagacatagaatttagtgtaaattaaacaatttactaatggactgaaaaagggaatgggaatgtttgatttcctcaagttttggtggctaagagactagccatctaccttacagccctccgaagatatgtgccaagtaagatttattttcttcaagtgaagaacttttcattatttttctatttcataatatctccactctacctaggtctgtactagatgtatagtacatatcttttttttgtccagtaaatatggcactgaaatgaattgtagtcaacactcagtatctgggcatgaattatgttccaagtagattatcttgatcatgattttctgtcttttccttgccaatgtgtctgtaccttgccagacaatatttgtctggactagatatcttccaaataaactgcaagttcattttgtatagcatattaatctaggaattgcataaatgtaaatttgttgaaaatacatctttgaaaataaatttatttaatcttaaaataagatataaattttttattatacttcaagttctagggtacatgtgcacaacatgcaggtttgttacatatgtatacatgtgccatattggtgtgctgcacctgttaactcgtcatttacattagttatatctcctaatgctatccctccccactcccccaaccccatgacaggccccggtgtgtgatgttccccactctgtgtccaggtgttctcattgttcaattcccacctatgagtgacaacatgcggtgtttggttttctgtccttgtgagagtttgctgagaatgatggttcccagcttcatccatgtccctacaaaggacgtgaactcatccttttttatggctgcatagtattccatggtatatatgtgccacattttcttaatccagtctatcattgatggacatttgggttggttccaagtctttgctattgtgaatagtgccgcaataaacatacgtgtgcatgtgtctttataacagcatgatttataatcttttgggtatacacccagtaatgagatggctgggtcaaatggtatttctagttctagatccttgaggaatcaccacactgtcttccacaatggttgaacaagtttacagtcccaacagcagtgtaaaactgttcctatttctccacatcctctccagcacctgttgtttcctgactttttaatgatcaccattctaactggtgtgtgatggtatctcattgtggttttgatctgcatttctctgatggccaatgatgatgaacattttttcatgtgtctgttggctgcacaaaatgtcttcttttgagaagtgtctgttcatatcctttgcccactttttgatggggttgtttgatttttttcttgtaaatctgtttaagttctttgtagattccagatattagacctttgtcagatgggtagattgcaaaaattttctcccattctgtagggtgcctgttcacgctgatggtagtttcttttgctgtgcagaagctctttaattagatcccatttgtccattttggcttttgttgcaattgcttttggtgttttagtcatgaagtccttgcccatgcctatgtcctgaatggtattccctaggttttcttctagggtttttatggttttaggtctaacatgtaagtctttaatccatcttgaattaatttttgtgtaagatgtaaggaagggatccacttacagctttctacatatggctagccagttttcccagcaccatttgttaagtagggaatcctttccccatttcttgtttttgtcaggtttgtcaaagatcagagagttgtagatgtgtggtattattcctgagggctctgttctgttccattggtctatatatctgttttggtaccagtaccatgctgttttggttactgtagacttgtagtatagtttgaagtcaggtagtgtgatgcctccagctttgttcttttggcttagggttgacttggcaatgagggctcttttttggttccatatgaactttaaagtagttttttccgattctgtgaagaaagtcattggtagcttgattgggatggcattgaatctataaattaccttgggcagtatggccattttcatgatattgattcttcctatccatgaccatggaatgttcttccgtttgtttgtgtcctcttttattttgttgagcagtgttttgtagttctccttgaagaggtccttcacatcccttgtcagttggattcctaggtattttattctctttgaagcaattgtgaatgggagttcactctttatttggctctctgtttgtctgttattggtgtgtaagaatgcttgtgatttttgaacattgattttgtatcctgagactgctgaagtttcttatcagcttaaggagattttaggctgagacgatggggttttctaaatacacaatcatgtcatctgcaaacagggacagtttgacttcctcttttcctaactgaataccctttatttctttctccttcctgattgccctggccagaacttccaacactattttgactaggagtggtgagagagggcatccctgtcttgtgccagttttcaaaggggatgcttccagtttttgcccattcagtatgatattggctgtgggtttgtcataaatagctcttatattttgaaatatgtcccatcaatacctagtttattgagagtttttagcatgaagggttgttgaattttgtcaaaggccttttctgcatctattgagacaatcatgtggtttttgtctttggttctgtttatatgatggattacgtttattgattttcatatgttgaaccagactttcatcctagggatgaagccaacttgattgtgatggataacctttttgacgtgctgctggttttggtttgccagtattttattgaggatttttgcattaatgttcatcagggatattggtctaaaattgtctttttttgttgtgtctctgccagcctttgttatcaggatgatgctggcctcataaaatgagttagggaggattccctctttttctattgattggattagtttcagaaggaatggtaccagctcctctttgtacctctggtagaattcgactgtgaatccctctggtcctggactttttttggttggtaagctattaattattgcctcaatttcagagcctgttattggtctattcatggattcaacttcttcctggtttagtcttgggagggtgtatatgtccaggaatttatccatttcttctagattttgtagtttatttgcatagaggtgtttatagtatactctgatgtagattgtatttctatgggattggaggggatatcccctttatcattttttattgtgtctatttgattcttctctcttttcttctttattagtcttgctagtggtttatcgatgttcttgatctcttcaaaaaactagctcctagattcattgattttttgaagggtttttttgtgtctctatctccttcaattctgctctgatcttagttatttcttgccttctggaacttttgaatgtgtttgctcttgcttctctagttcttttagttgtgatattatggtgtcaattttacatctttcctgctttctcttgtgggcatttagtgctatacatttccctctacacactgctttaaatgtgtcccagagattctggtatgttgtgtctttgttctcattggtttcaaagaacatctttatttctgccttcctttctttatgtacccagtagtcattcaagagcaggttattcagtttccatgtagttgagaaattttgagtgagtttcttaatcctgagttctagtttgattgcactgtgatctcagagacagtttgttataatttctgttcttttacatttgatgaggagtgctttacttccaactatgtggtcaattttgaaataagtgaaatatggtgttgagaagaatgtatattctattggtttggggtggagagttctctagatgtctattaagtccacttggtgcagagctgagttcaattcctggatatccttcttaactttctgtctcgtcgatctgtgtaatgtggacagtgggatgttaaagtctcccattattattgagtgggagtctaagtctctttgtaggtctctaagagcttgctttatgaatctgtgtgctcctatattgggtgcatatatatttaggatagttagctcttcttgttgaattgatcccattctgtaatggccttctttgtctcttttgatctttgttggtttaaagtctgttttatcagagactgggattgtaacccttgcttttttttgttttccatttgctgggtagatcttcttccatccctttattttgagcttttatgtgtctctccacgtgagatggttcttctgaatacagcacactgacgggtcttgactgtttatccaatttaccattctgtgtcttttaattggagcaactatcccatttacatttaaggttaatatttgttatctgtgaatttgatcctgtcattatgatgttagctggttatgttgcttgttagttgatacagtttcttcctagccttgatggtctttacaatttgtcatgtttttgcagtggctggtaccagtctttcctttccatgtttagcgcttccttcaggagcttttgtaaggcaggcctggtggtgacaaaatctctcagcatttccaagatggccagataggaacagctccagtctgcagttcccagcgtgagcgaagcagaagatgggtgatttctgcatttccaagtgaggtaccaggttcatctcactggggcttgtcggacagtgggttcagcccacggagcagggcagggcatcgcctcacctgggaagtgcaaggggtctgggaattccctttcctagccaagggaagctgtgacagatggtgcctggaaaatcggtacattcccaccacttttccaacagtcttagaaaatggcacatcaggagattatatcctgcacatggcttggagggtcccacacccatggagcctcactcactgctagcacagcagtatgagatcgaactgcaaggtggcagtgaggctgggggaggggtgcccgccattgctgaggcttgagtagataaacaaagtggccaggaagttcgaactggatggagcccactgcagctcaagaatgcctgcctgcctctgtagactccacctctgggggcagggcatagctgaacaaaaggcaacagaaacttctgcagatgaaacgtctctgtctgacagctttaaagaaagtagtggttctccgagcatggagtttgagatctgagaatggacagactgcctcctcaagtgggtccctgacctctgagtagcctaactgggagacacctcccagtaggggccgactgacacctcatacagccaggtgcccccctgagatgaagcctccaggggaagaatcaggcagcaacatttgccgttctgcaagatttgctgctctgcagcctccgctggtgatacccaggcaaacagagtctggagtggacctccagcaaactccaacagacctgcagctgagggtcctgactgttagaaggaaaaataagaaacagaaaggacatccacaccaaaaccccatctgtacgtcaccatcatcaaagaccaaaggtaaataaaaccacaaagatggggagaaaccagagcagagaagctgaaattctaaaaatcagaatgcctcttctcctccaaaggaacgtagctcctcaccagcaacggaacaaagctggatggagaatgactttgttgagttgagagaagaagactttagatgactggtaataagaaacttctctgaactaaaggaggatgtacgaatccattgcaaagaagctaaaaaccttgaaaaaatattagacgaatggctaactagaataaacagtgtagagaagaccttaaatgaactcatggagctgaaaaccatggcacgagaactacgtgaagcatgcacaagctttagtagctgatttgatcaagtggaagaaggagtatcagtgattgaagatcaaatgaatgaaatgaagtgagaagagaagtttagagaaaaaagagtaaaaagaaacaaacaaagcctccaagaaatatgggactatgtgaaaagaccaaatctatgtctgattgatgtacctgaaagtaacggggagaatggaaccaagttggaaaacactcttcaggatattatccaggagaacttccccaacctagcaaggcaggccaacattcaaatacaggaagtacagagaactccacaaagatattcctcgagaagagcaactccaagacacataattgtcagattcaccaaagttgaaatgacggaaaaaatgttaagggcagccagagagaaaggtagggttacccacaaagggaaggccagcagactaacagtggatctctcagcagaaactgtacaagccagaagagagtgggagccaatattcaacattcttaaagacaagaattttcaacccagaatttcatatccagccaaactaagcttcataagtgaaggagaagtaaattcctttacagacaaaatataaatattttaatgacaatcccctcctcattggtacatagttagataatgattaaaacttaaaggattttcactgttgagtttgtaccactcaaggattttgcagtagaccagtaaatttaaaaacaaaaacaaaaacaaaaaacataattcatgttatgatactttagttcttagaaatgacaggttaaaaaatgtaccatattagaagctagacctaattgtacatagtcactaattagcttttctcttagctaagtcatgtatctttctagatattatttgtagtgcaaaatacccctgcaatgagtgtaatttatgcattggtaatgtatgattgcttctttcaagtctaatattttagaatccatgttgttaaacaatattaagttggaatatgggtgttacaaattcagatcagaaatatgtaatgtagtataatcatcccaaaatatgttgactctagaggctgtgcacaatggattttttaaaattacaaatggtaatattgaggtaaagtacataacttagtgtaaagaaacatggaaatttattgtttagtactatcaagagtatattaaaaggtctgcttaacttaatgaaaattatttttaatatcttaaatgcacccttagaaacaatagctattatctggcttttgaagtgatttggtaagatctttgttatcagagaaatattacatttcattttctccatataattatattcatttaataataattgactaacattgtttatgtacttggtgccatgcattgtgctagttctttaatgcattatctttcttaatcctgagagcaacactgtaaagtcaataattttatactcagttgcaccaatgagattgcaagactattaggatcagtataagaattctaagccaacatggatttgattcagaactgctatgtattgctacttctcaattaaaacaattctaagagaaatgaaacaattatcaatgaactgagccataagattccacgtcttatttttttaaaagagagatatcaaacatttttaaaaaatgttttattttcataagaaacattgcaattacaaatacaaaatcattttgcttcagtgagatcaaagaaggtttacatttgacagtatctgacactcaagtttcaaaagttattttcctgttattctgtgttttctgaatctctagtatctgagtagacagttgtgagagagatcaatagaatttttctctcaaggtgttattattttctaaaggagaaatagaaaataaataaaataaaaagacaggctgttatatgtgttctgcagtaattcttgaatttattcagaaatttccataataattttaatgaattaaataaatatactatcacgcattttggcaacattgagaatagcccccaaattttacatctttctctcaaaactggtttttttttctctcattttcttcatcagcggacttaatacaaactcagcaatttcttgtacagtatctgttttaactttcactgtgataatgagggaagtcattcaaacaaatcagctctgttgcctgggcaacacgtttctttcctgtgttcatccagttccagataggggtccattttaaccataagtaaagctatgtagattatatcccctaatgaatgatagagattttatcaaatgtgagtaatgaaaattgcctctaggagaaattgctctttatagagcaattgagtttagggttgagatgcaggattacatgaacataatctctccatacctattgaacattcattaggaaacattctctgagcacataagtaatgtgtgatgtatacagaaagatacagatccatgctctccaagaattcatggtaagagggggagatgagcaagaaaataaaaaggggaaagctgataatactttctcataagaaaatgataagtattctgttttcctattacaacgggccacagtggtatgagacagttaattctcatctctagcatgtggtctactcaccaaagccatgtctatatatactctgtggcagaaaaattcaaattctgaaagtgctgttgaatggaacagatcagacacagttttgtccatgaggcagcaaaattggctgaaattcaaaagtgccattcagtttcttccagcagctgtgttgtaagatcagactgaccaatttgaatagaagttttggctggaagttctcagaactattctgtgagagaacgtgtggaagcaaccccagagcaattgagacctgcctatgcgatggcaaacagcattttaatgatgcctctcccaataaactccatttggaaataacatttcttctgcctctaaactactcatattttattgcctgctatgcattcccttgagtctttgcagtgttcacatatatcatcttccctatgaaagagtagacacacatcatcacttatcgaaaattctcagacaggcttgcttgtgcataggcggtgtgccaatagatatttctagaaggaaataaatcatcatatatgtgtggaggtggcaaaatcttaacatctgaacaggaatttctcagtgaagtattctgtataggaatttctttcatatggctccagcaaaccaaattatattcttgtgaataattactgagtgataaaagcaaacccaaaaggaatgaaagtagtactgataaaattgacttaaaaagtatgtaggctatgtcataccacataccaattgctgtgagggggatgttttctggcatatgaataaattcatgtgagttgatttgaaaataaactattttgtcatcaaaattttgggaaaaataaatatgtactttattttcaatcacagcattagaaaaaaatcaaaattttctgttcctatttctccacatcctctccagcacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcgcccaccttttgacggggttgtctgtttttttcttgtaaatttgtttgagttcattgtagattctggatattagccctttgtcagatgagtaggttgtgaaaattttctcccattttgtaggttgcctgttcactctgatggtagtttcttttgctgtgcagaagctctttagtttaattagatcccatttgtcaattttggcttttgttgccattgcctttggtgttttagccatgaagtccttccccatgcctatgtcctgaatggtaatgcctaggttttcttctagggtttttatggtttaaggtctaatttgcagccataaaaaatgatgagttcatgtcctttgtagggacatggatgaaattggaaatcatcattctcagtaaactatcacaagaacaaaaaaccaaacaccgcatattctcactcataggtgggaattgaacaatgagaacacatggacacaggaaggggaacatcacactctggggactgttgtggggtggggggaggggggagggataacattaggagatatacctaatgctaaatgacgagttaatgggtgcagcacaccagcatggcacatgtatacatatgtaactaacctgcacattatgcacatgtaccctaaaacctaaagtataataataataaaataaaaataaaaataaaaaatgaaaaaaatcaaaattttatattctctttatgtttatgtggaccagtaaaatagtcagaaaaccactttggactggatgatacaacagttttcacctacagggacacaagtgtttgaattttctatgtacttggaaaattggggtcaagaaaatacatttcgtgcactcatctactgtgttttattttctgctcctggtaatttccttggtgttctttgtgtaatgtaattggcttgacttgattcaatactaagcctatatctctaataacagtgttatttgggatctggcaaggccttttcaattgtccaccctagggttggacacttaaaataaaaataaaagggacctggcaaatagagaatagccaagtcaaaaaattgcaagtgagatgggcttaactccagtaccctgacaaagctgaggatactatagaatagtaacatgctagaagcaaggggaaactgtctcgcaactcagctacctggatgtctcaaagagacctcatttgacttcatttagtggcacgtccagtggcgttgaaggcaaaggcaaagaaatctgttttcctcttccaattctgagaatcaaaatgctgtagactgagtttgctttgcagggtgggttctcatcttgggctgaccaccagatggccacatgtgcaccagtcccggaagatcattctcctggggccctgtctcctagggcaggaaccactcctttaattacaatcgagtggaagtcacaagacaaaaacagaacaatcagctgagacttttagaagattacattcttcaggagattttgatgtttttatttttttataataaaagttaaaatatccatctgggaaaagttgtatgaggaagaacaagacattttaatattggatacctcagtttgaagtgtgaacaaggggcatagagaaatgtgtatataaatatatatatgtgtatatatactatatatatatactatatatattttatatatatagtctatatatatgtagtctctctatataatatatatatatagactatatatatatagactataggcatagatgaaaggttgagattagtttaagatatcctgacattttattataattgttatttcaagtgacaataataaggatcaattaggtttataacaaaggtgataaattatagcttaatttaaaaaataattttaaaagtattatcaatccagagaaactgttgaactctaggtactcatcgaatccaagctctctcctttcaaaaagattataggcagagacatatcttctgagactaaaatccaatcactttcaaactttctagaaagttttcagaaggagattatgaatttaattaaatttaatctcagctaactcttcacatggcatctgccacatggataacaaggatcaatgcaaaaaacttcttatgagtaatatgcagtttaattgcaaaactgaattagtgataactttcactagaataggcttatttatggtaaaatgtattaacaaatctatcaagatttattgtaaaatcaaggaatttttttacagaaagccagagagtgtctatctcactcaggagcatggctcaggtgggtcttccctcctgaaaaatgtctgattctttggtactgacagatggcttggacacctgtcattccaaggactgttttcaatgggtcagctgatttggctggctagattgatttgctccttctgtatctttccatgtaagcatctttaaaagccacaaaaggataggaacatttgtaaatgacctttttacatattgctgatctcttttcatgttttagttttaccttccctctcattaatcacttctagttccatgtgtttttatctctttgtttcacatgttgtcttttactcaacttcttttgaaatgtagaactatcttttcagtaagataatacattgctgaaggaaagaagtgtcccacttattttttcaataatcacatattaggttgttataagagtctggcatgagggaaataagtagactccataaatttatactgttaagagtagcaacagacttaggggatgaaagcaggttgcttcgaatctatcacatccttttgttataaattacttagacaaatttgctttagattttatctgaaggggtgtatactagacagtataattaaaggaacattttttctgggtctagaatatggtaattacaactttgttggcaattaagaaaaataaccatggatcgtgctatttgaatgttgaattagaaattaaaattcttaatgtctgagaattattttcataagaagaggaaagttgctaaaattttatgtcaacaattgcccaaaaagtgtaacttagtgaatgattttagagattactggatgcatttattccagaatgcatgccagaatagcatttggagaaccatcactaagaggtttgttacatcagagactagtcaacataccagatagtatcctgttaatatttaacagaagtagaaaacttatttattgagtttgggagaaaagcaattcaagggtaaatttataaaatatatatatatttataagtttattagtattgaaaattaatgaaacaaatgggctgacaaacaaatgaaacaaatgggctgacaccaaaagaagttgatttttaagccgatgattcaacttagtgtagacatattaattaataaaagtaaaacttcatcatgatatgactacatatttaaatattactcatttatgaatggttaatatactggtacacaccataatttgtttcatattgatgatgtaaaatctcatgtaggaaaagtgtaataaaaccaccttggcctatgatgaaagaagtattaatgaaggggagtcatttttttcaatcactgggaagacagcccaaagggataaagcactatatatatattatatgtcagaatcaatcttaaaaactctatttcctgacctttgcaataaaacccagtcacctatttgtactcttacttagcaccttcataatatgtgctgtcatgtaatgttcttaccttaagtctgtatactgaaaataggccaatagcagatttaatagaaaaaagtcgagtgggtgcacacaaggccaaatctatttacaatttaattacaggatctagaatcaacttatgatattaaaaacctattatattaaaggttccatggttccattacattctacaaaccactgttttctcatttagcagaatatactcttcataacaactcttcaaattatgaggctaagaaagcctaccatattttctagtaggccagagagtgatggagaagttattcaaaatctgttgttctgatctccagctctgtgctgtttccacaccactgagcaaaagcagagtctgtggatgtgaggatgaggaggaaagactgtagactgcattcattctgagccatgtaaaagaagaaggcatatcagctcagttcaaagactttcattcctggttcttaatgttgttaagttctgctctgtgaataaaatcaaatataacaaaaataccaagtcacctcagaccttgaaatgaaatttcatggcttcaaaaatactaagccattatttcagcacgagctaattccttgccatgacattagggcataaggctttttcataatagttaaaattttcactctcaatgtaaatgttatttttgaaaatgagactaatgttttatgttgcctaacactggcaatatacttaccaactatctctgaggaatgcactgagcatagggatggttgtagaaaattacacaattgaggcctgaatgcacgtttagcactgtgggttacgctttgcttccaacaactcctcaatcattgtaaaaatttaagaaaaaaaatttaaatgctcacaaagaaaagaattcattcacatatccactatatcagagttcagcatttatactcattgtgtggttgttatatatttaagtttatttagtattcataaatgcctgcattatatgttcttagagaaataaaaataactatttttcttaaaggcatacaaacttataaagtgcttaataatcagtattacattttttctatgtttttttttcagtatagtgaatggttttatttaaaaaataatgttatgtttaaagtaatactttctcatgataatatgttatggttattgaaatttttaaaatacaggaccacagatactaatataaagtattagtaatataaagtgcagctataatcagacatctaattccagcaatgtagaagactacttgcccaaatagcctttgtaatacattacaaattaaagaataaaaaactggatacaaatatcctctttatgtagagttgagttgacaacaaagtaagaggaatccagagaggcagaaacaatgaattggacaggcactgaagccacagagccaagggctcacagcctccttgatcctccatagcccaagtatctgcatttaaatgggcttcacgaggaaaagaagagaaagtctaggtcctgagaaggtgggaaatcagtatgggaatctcccacagaaacaatttccaaaaggtgattttctctaggaaagaactaactatgaagagaagaaagtaaccaaagaatgagacagtggggaaactttgatgttttggcttatatggaaggaggaaaacagctttaataaagcatttccaatgacaggctggttacaaggcatcttttagactagaatccactctacttctaatgccaaaagacctaagcccagcattaactttaagaagctcccactggtgacccttcctagttatctgacagaaagaaggcctaaatcaaaacctcaaaaatcccacagatcaaattttattgattgtgatatcacaattttcaaagtcacatgaaataagaagatataagccattgtgagcaaattttagaagaaacaataaacaccagtgtttttgtctgttctcatatcgctacagagaactacctgagactgggtaacttataatgaaaagaggtttaattggctcatggttccacaggttgtacaggaagcatggctggggaggcctcaggaaacttacaatcatatgggaagtcaaaggggaatcagacatgtgctatatagctggagcaggaggaagagagagaaacgggatgtgctacacagttttaaacaacaaaatctcatgagaactcactcactatcatgagaacagcaagcagaaaatctgtcgccatgatccaattacctcccaccactcatcctccaacattgggggttgcaatttggcatgagatttgggtggggacacaaatccaaaccacatcaaccaataacaaagtagcaaagattccagatggaataacagattttaaaaggcaaatgatagaaaagtagtgaacttttattagtctaagacgaaacagactttaagaccaaaagcttttcttgagatcaaacatgaaagtttaattcaccaggaggggagaacaatcctaaacttacctaaacatagtaacataactttaaaatatataaagtcaaaaatgaaagaactacaaggagaaattgacatatctggaattaactttaagaaggtcccattggtgacccttctcaggtgtatgacaaaaagaagggccaaatcaaagcctcaaaaaatcccacagataaaattttattgatcatgataccacaatcctcaacatcacatgaaatatgaagatagaagccatctttggggtaatttcaatgcagctgtctttaatgtcgataggaagtgtgtgaaagatttgaaccacacaaactgcaaggtgaaactgcaggttatatagatatatctgcactgaagcactgtctacttcctgaaaaatatattgttctgaaaaatatattcaaaagataacagggattatgagaacaaagagttgtggaagacagtacaaaactatgcagctttgtaacaagaggaccaaacagaaaggaatacatgagactggaggggataatctgtctgcccatccagatatattcatgtgagcacatgctgccacagtggttgctaaaaatgctccagaacaatagagtggaaatgtattgaagttttgttggagcagagctggtgggtacaaactggcagttgggaggagcatgagccagcgtgctcctttagggtgtctgtggaggcagggcaatggagcaagagtgcagcacagtaggaagagggttgtggccctgagaaggaccctggcacttgtttctagttttcttaagatacatgcagtagtgcttttcctgccagcatggcagcaacattgaagacttctatttcccaataaagatatgatcctaccatcattctctcccctcttgtctaaaatatttgtggatgaaccaacacagtgtttactccattctaaactaactcccttattaacaaatcacccatgagtgaattcaccttacagaaactcacactgtggctgcagatagaacactgcactaagcaggtggagaaaatgtcttcctttcaaatccagtccataaaaccagtactggtattacatatattatattatctgatgacagcacaattgagttaataattggtaacaaaagaaatcattaaaactcctatatatttggaaattaaaggaaatcttctaagtaactcatggtttaaagaggaaatcataatgggaagacatataaatgtacacaatatggtaatatagaaaatattaaatataaaaatttgtatgacagagagaaatgtatagcctttaatgtaatgtgggaaatgcaagacttaaaattagtttgaatgttaaggaatgtgcagtagagggaaaaaatagttacaatggggaattaaaatggaaaacaaaggcacaagggagggttcaacaaagctgaagtgttaaaaaatataagatcaacgtggcaaaatattaataaaaaatagaatattaataaaaaatagagatgataatgcaaggacttttacatctgctacccctcccaacacacacatacacacacacacacacacacacacacacacacacacacaagactgacagataataaaaccaaatacttaaaggcaatgagagagttagtaatataggatggatctggtagaagattgcagtatatccgtgtatgctgtatgtgtgacccatttaaaaaatatattttttattggacacataatagttgcatttatttatggagtacatagtcatgttttgatatgtacaatgtatagtgggcatatcagggaaattagcatatccatttaacaatgcaacaggttccttttgccagctgcccagatagagccaatttatcaagacaggggaattgcaatagagacagtgtttaatacatgtatagccagctaaatgggagaccagagttttattattacacaaatcagccttcccagaaattcagaagctagggtttttcaaagatagtttggtaggtagggtgctaggatatggatgtttctaattggtaggagatgcaatcttaggggtgcagaaaatggccttcatgcactgaggccacttctgggtgagggtcacaggagtggttgagtggagagttgcaggcaaaagcctgcaaaagccagaaaagacatatcaaaaggccagtcttgggttctagactagtaaattggagaagttgcaaaccttgtgacctctggaataatggctggtaatcatttaactacacctacaacttatagaaactcatcctcctaacctggtggtctttcattagatttataaaggcagtatagcctgagggaggggctactatcatttaaactataaactaaatttctcctagttagattggcccaagtccaggaatgaccaagggtagtttggaggttaaaggcacatctctttcactgtcataattttctgactattataattttttacaaagatggtttccccatcatgtcaaacatatcattttttggtgtgttgggaatcattgaattcttcttttctaactctctgaaaatatatgataaagtgttttcaactagagtcatcctccagtgctacagaatactagaacatatacctcctttttccttaattgtccagtttgggaggattttgaccactgacttcaaggcattgtggggacattagtttgccgctagggattgccaaggtagtgaccagccactggctaagagtaaggattcacttgatgcagacagaccctcagcggggattgcttctcagcctcacagcatctccagcaccaaaattaatttagaatggcccggggaactagtgaccacagttgcagacagaagcaaatgtagatgctctctagagacatataacaccatctgaggctttaatttatttctgtaaaaactcttttcaaatgcactcttcaacccacaataaaaataaatcactcataggagaaggggcaagaaaacatgcctgaaaatcagagaaagaatagtcaatagaaatagaccaacagaggcttcaggaattggagttattagaaagaccctgaaaaccttggtaccaataaatttgaaaatttatataaatttaaaattttccaggaccaactcaaaataaaacaagcaatctaagtattaaagaattcaaagatatatcaaggggagggtgatgaggaatgactgctaatgggtataggtttatttctggggtaacagaactgttctggaattagatatcgaggaaaagtacacaaccttgtaaatacattaaaaacaatgaattctacactaaaagaacaaaaatactggacttttctccacaagcagaatagcttagtatgctcattttatatggctagtacaactgatctcctaatagaaaaggaatataaaaatatgcaattttaatcaaatacacagatgcaaagtaattaaattaaaaattagcaacaggaatcaatgatatataaaaatatcataggaaataactagtattggaaataactatttatccttattgagtttattatgcaaaaggaaggtattttcaacattagaaaaatatgtccttaagaaatttaaggagaaatacgaccatctcattaaatgcaaaagataataatttgatgaaatgcatcacttaggaaacaaaaagaaaagagcaataaaatacagaaaatatattttttcaaaaggctgtctctacatcaatgggaactcttcaaatcaataaagtgcattttcaaaagagctacagcaaatttattgaatagagaagaataatttttttaaatccctgtaaattcaggaacatgacaaaaatgtttaatttcttttcagtgtagaacagatgcattagctacacaaaaatagtgataaccctaaagtataaggaatataagaaaggaataaaatactgtcactctttaaatgagacattcatctatgtagaaaatccagaagaatcccaaactgatagatttaataaaaaaatagtaaaattgccagatacaaatctattcaatttagtgagtgacacttttatacagcagcattatcaaaaaaacaaaaaatatttaaaatgcctaaatattatataatatgcataataatgaataatgtaagacatataagacctacatataaaaacatataaagtgaataatgtacattacagaaaacttaaataagttgggagacatatcacattagtggaaatattactatgctaaagatataaattctgcttacattgttttaaatatttaaaacaagggaaaagtgacatagattacacacacagatttttcaagcactatcatacttagacctaatcaggggacatccctccatgggtcccaggctttgtagatcccacagatcacaaacaaacagacatgcttttactaaagagcatatggctaatctgtcatgcaggatccagaactcagttttcaaaggaagactcaggaccctaggcctcaaggatgtgactaacaccattcacacctaagtaaacctttcttcatatctattctcctctatccgtaaaacaagatatgtttttcctgaatgcagttgtaaaccaaaagtaaaattctaagcaccccccaaccaactgactggactcctctcagctaagggcattttaaggtaaagctgaagttctagttcaggccaagatgggaatggatggttgaacatgccttgttatactttcctccctttggaatccaggcatagctgaccagcattaacattgaaacagagaccttaagactaacaaagcagactctgtagcaataaaatgccaacatgacagatagcaggcccaaaatatattgccctgatgtattttaaaatgttcctgcaaggctgtctcttctggggaaaatctacattctagagagaatccccttctcttttcaggctttttcctgataaaggaaagaattaactaaagagtctggtgtatttttttatttttatttttttttgagatggagtctcactctgttgcccaggctggagtgcagtggcgtgatctccactcactgcaagctctgcctcctgggttcacgccattcccctgcctcagcctcctgagtagctgggactacaggcgcccaccaccacgtccagctaattttttgtatttttttagtagagacggggtttcaccatgttagacaggatggtcttgatctcctgacctcgtgatccacccacctcagcctcccaaagtgcgtatttttaagtctgataagaaacattttaaatctgttctctctgaagcaggctacctggaggcatcatctgcataataagaaccttggtctccacaaccccttatcttaacccagacacttatttcggttggttccaggtctttagataaactataaatgctttcaaccattgtcagtcagaaaatgtttgaattcacctatgacctggaagtgccacacaccccaccaccttgagttgtcccctgccttttcagacagaaccaatgctcatcttacatgtattgattggtgttttttgtctccctaaaatgtatagaaccaagctattgcccaatcaccttgggcacatgttcacaggatctcctaactcatatttggctcagaataaatctcttcaaatattttacagagcttgagtcttttgccaacgccattaatatttcttcttttaactatattaaaaatagggaggattttgaatatttaagtgcttgagtaagagaaaagacaaattaagtaacacattagacacttgccaattcatgaatggaatacgtttttagataacaaagtattcttaatcagtagagccaaatatccattttgtttactttatgttgtagcttgtggttcaagaagtattgacaattggcatagtatttgcaacagttatcactggcagctgaaaatattttgcagtattaaaaatttacactattgttaattatgtacacatataggactagatatgcatacatacaacatgataccgattctttatattgacaacaaaatgaacacaatagaattgcaaatagtgttatttttattaaaaatactataaaagtttattttcaaaaagttaaattctggtttttatttttattgaagtaattttatgcaaatgttatatatattgaggactaagctctgatttttttatcttacccaaattcctatctaaggggtctggggagtcatcccctacaaaccataaattctcatcagatgggttttatttaaccctatatatcatgactcactttccaatctgactctggcataacactatgagacaaggaagaaaatcaaaatatttgatttttgcatttccctgatgtcctttgtgggggaaactctgtatctgtaaagaatctctattaagatagctagttttttttcttccaggccctcccagtcctaaagagattaactaaaagtctagaaacttttaaagatctgaataggaaacatttgccatctgttgtctctaagggcagccactataagacttcaaaagatccgtggtctccacaatcttttatcttaacctgaacatttcctttctatcaatcccaggtctttagacaaactcaaccaattgtcaaccagaaaacgtttaaatttacctataatctggaagcccccccacccactttgggttgtcacctttctgaaccaaatcaatgtgtttcttaagtgtatttggttgatgtctcatgcctctctgaaatatatgaaaccaagttgtaacccgaccaccctgggcacattgtagtcaggccctcctgagtgttgtgtcatggaccatggtcactcttatttggctcaaaataaatattttcaaatattttacagagtttgactcttttcatcaacagtatattcactataacacttcatttaatttgaatagatggttctgaatatttaccaaaaaaattttaaaaacagatttgaggggaaagtttgatttcagcactaatgggtaaagaatttggatgttgttactctagtttttacaacaaaatacatctggacacactgaaaatcaatgattttttttgtacttaccaataaccgaagctgccagttttatcatcaatataaaactctggggagacaggccaatttggagatcgacagtcaagattgcttctgtggagaagaaggccctgaactacagacctatagaaaaaatgaattgttgatgttctcaaattggtgaaggcaaagtgtagaatagcataagaatgagaaactcatggtgctgcagttttagagggggtttcacttccaggaactgaccagattctgatggtaaaatccaagaaagagaagagggaggggaagagtaatcattgtgaaacaggtcttgagaaatcttcattagaaaacctactctacaaggcaaaagaccactacagttttgtatcaaatgcagaatggtatttctctcactctagttccctttagctttcctgcatcacctaagagaatatctctggagaaaaacttgtgaaggtcccagaccacacacagaggcccatttggaagaaaaaaatttcatcatcaggttgtagaatgattctcctctctgacccttcccactgcatcaacgcagctccagtaaaatatcagtagctagagttgaaagagctataagacacagattttccctgaagacaagtcatcggagaagccaaaagtcaagggaacaaggataagaaaaaaaaaaggaaactatgagagcctttgacaaccataactgagaaagtatttataaagcccaattcctagccaaattaacatatatcccaaaaggtaaggtctatttcatctttagtttatactcaatgcaatacgtccagcctccaaaaaaaatgacataaacaacaaccaaaaaaaaaaaaaagaaacaccaacaccattataagcaaaacacagtctgaagagacaaatcaaaaattaaaataagaatcagattatgacacagattttgatattatcaaatggagaatttaaaaatagttatgtttaatatggaacataacagaaaaatatagacagaaggttaatgaaagaagagtgatagaaactctaaaaatgaattaaaagaaaatgtaagaatcaagaacattgtaagagaaatgaagaatatctttgctgttctaataagtagacttgacatagccaaggaaaaaaatattacgaaactaaaatataaaaagcaaaaggaataaaagaaacaaaacatctaagaaatgtgagaccatttcaaaactattacatacaggtatgtggactaccttacaaagaaaaaaagatgatcagaaggaatatttgaaattatgatagctaagaactttcccaaattagtgacagataccaaaccacagatccaaaatgaacaatcaatgccaaacaaaatactaaaattacctatctattcctaggaatatttaaattgttgaaaacaatggtgaagagaaaatcttgaaataaaccagaggaaaaaacttcttaaatatggaagaacaagaataaaaattacaagagacttctcatcaaaaaccaacccagccagaaaagagtggagtgaaatgtttaaaatattaaaggaaaaaaattacactgacttaccgttctctatgttctgcaaaactatcctttgaacatgtagaataaataaagaccttcttagacaaaaactgagggaattcatcactagaaaatatgacttgtgagaaatgttaaaagttcttcagggagaaggaaaagaatataactcacaaatgcatacctgtagaaagaaagggagagcacaggagggggaatacattaagatatatttaatgtgttatttgtttaattcttggctgaaaatatagctgtttaaaataataatagtaacaattataaagtgattatatcatatagataagttaaatgaatgatttcaatgtcataagaggtgagagagtaattgggagtactctgttgcaaggtccctatacaagtaaagtggtttattgttatttgattgtggatttagatcagctaaaatgatatattatgaactctagggcaattactatttctaaaaatgtatggtggatatgcttggaaaggagataaaatgctcaattaaaacccactaagacagaaaaagaggggaaaataaacaaaagcaaatgcaacacattgaaaatgcttaagtatggtaaatattaattcaataattatttcaagtggacataatcttaaacataccaattaaaagacagtgagcttcagagtatacccaagtgtatgctgatacactatcagaaatccactttaaatataaagaattaaatagtttaactaaaaggatagagaaagatatactttactaacacaaattaaaaaaataaaaataaaaagactgggttagctatataaatttcaaggaaaaaaacccagacttccaaacaaggaagattatcaggaataatgatccgttttacaaagcaatttaacaatccttaacatgtacacaattaaaaagagagtcaaaatttgtgaggcaaaacttgatagttgttaaagataaaaatatgcaaatgtaagagtgtagtttgagactttatcacccttttttttaagtaacattgattaagcaggcaaaaatttcatttagttgactgaatagcactgtaaatcagttagttctaatggctttttatagaattatccatccagtggcaagagaattcaaattctcctccagcttatgtcgaacattcatgaagaaaaattacgttttgggcaacaaatacacattaacatatttaaaataacagaaatcatgcaaagtctattctcagacttcaatagagttatgccaaaactcaataacacagtgagatgtgggacatcctccaatatttgacgattaaacaacacacttctaaataacacataagccaaagtagatgactcaagactaacttaaaaatattttgacttaaatgaaaatgacaatgcaacttatcaaaatgtgagatgtggcaaatgcaatgtctagagggtgatttacagcattaacaacaaaattagagaagaagatctgaaacaataatgtcagcttccaacttaaaaactagagaaaaagcaattttagcctaaagcaacagaagaaaagtaaagcagaaatcaatgaaactgaaaacagaaaataatagaggaaatcaatgaaacaaaaatctgtttcttggaaaagattaatgaaactgacaaatctctaaaaagattgagaaagaaaacagagaagacataaattaccaatattactatgaaagaagggacgtcactacagaccctggaaaaaccaaaagtacattaagggagtaatactatatgtatagctttacacataaatgaacaagttagataatatggatcaattacattaaaaggacaaactacctcaacttgtccaatatcaaatacataatttcggagctttattactattaaggaaatagaaagtataacataaaaacttctcaaaaaagcaatctataggacaagatcgtttcatttgcaaattctacccaacatttaagagcaaaaatacaatgggaaaatgacagtctctttaataaacgttgtagagaaaacaggatatccacatgcaaaaaatcagcctggacccttatctcagaccatgtatacaatccaactcaaaagtattagagactcaaacataagactggacactgtaaaactactagaagaaaatagggggaaaactatctaacattggtttgggtaacttttttttttttaatttgactcaaaaaccacagtcaacaaaagcaaaaatagataagtaatgttacatcacagtaaaaagcttctgcacatcaaaggaaacaagagtgaacagtcaaccttcagactgagagaaaatatttgcaagccatacatctgataagggattaacatccaaaatacataaggaactcaactaactctaaagaaataaaacaaataatctgattaagaaatgggcaaggaaactgaatttctccaaagatacaaatagctaacagatacatcaaaaaaattcaacatcactaaccactggggagatgcaaactaaaaccactatgagatatggccttatttgtattagaatggttgttattaaagaaaagacaaaagacaagcattggcacagatatgagaaaagggaaccctcatacactaatggtgggaatgtaaattagtacaactattatggaaaccaatatggtggttcctcaaaaaactaaaaagagagttaccatatgatccagcaatcccacttctgggtatttatcaaaaagatttgaaatcaatatgtcaaatagatgtctgaactcatatgttcattccagcactgttcaaaataaccaagtgattgaataaacctaagtgtctatgaagggatgaatgaataaagaaaatgtaatatatatggaaaatgcaacactatttagccttaaaaatgaagttctgttgtttgtgacaatatagatggagaatattatgctaaattaaataagccagaaacaagaaagactgattccaaatgttctcacttatatatgaaatctaaaaagaaacgtttagaatagaatagaaaggtggttacaaaggctggggactggggagaatgggaagatgataatcaaagggtacaaagcctcagttagaaggaatacatttgctttattttttaaatcagtagcacaatatgctgaatattgttaataactgagtactgtacatttcagttttgctgagagtaaatttctcatggtctcaccatcaaaatagttgcatatttgaagtgataaatatgttatttagcttaatttagtcattttacattatattgaactgtcatgccactttgtactccataaatatattcaactataatttatcaaaatattaaaaaatgaaatgaacaccaattctatgcaacgtcttcctgaaaatgaaagaagataaaacacttaccaattcattttaatgaagctagcactactgttcccaaattagcaaaggcagaatcaaaacaagaaaaggcaaaaataaataaactacagagcaatatgtcttaaaaatatagatgtaaaactgtttttaaaaattttgtaaagtagaattaagcaacatatataggaaatatacactgtgaccaaggggtcttattccaggcaagcaggctgtttcaacattttaaaagcaattagtaaaatccattattttatcaggctaaaaggaaaaatcacctgaataataatttgacaattcagcacacatttatgattaataaatactctcagaaaattaatagtaggaaagaacattctgaacttaataaagaggatctataaagaaaaatagaaaaactacagctaacttcatacataatggtgaaagagtgaatctttacccttgagtttagacacaaggcaagatgtttactcttttcaatttttgtgaacatagtcctgacatttttaaacagtgcgagatgacttggaaacatatgcaaaagagtctgaaggaagaaataatattgtccctatttgtagatcacatgatcacctacatagaaaatcttaaggaatataaaaactaacttcctagaactaataagtaagttcagcaaaaaccacaaaaatacagatcaacattcaaaaattgctttgtatttctatatactagcaatacattgaaactaaaaataaaattccaatattacttacaattgctcaaaaaatgataaaatgctgtgatataaacttaaaacacctacaggactttaacccgaaaactcaatgattctggtgaaataaataaaaatgtaaataaagtcatactgtgttcatggattataacactcaaaatagtgaagatgtcattgtcaaattgatacataagtttaatgaaattcctgccaaaatttcaacttgatatgttgtggatatagacgttattgttgtaaaatttatagaatcaagccaaaaaaatgtaatagcaaaaacaattttgaaaagaaagaataaagcaggatggatcattatacctgattttcaagataacagtacacagttatcaaactgtgtggtatcagcagagggatagatacatagatcaatggaccggaagagatggccctaaaatagtcacatacaaaaatgaccaagtgatttttggcaaatattcaaaagcaattaaatggaggaaggatagtcttttcaaaaaatggtgctggtaacaattggatatcaacaggtaaaagtaaaccttgatttaaacttcactcctcatgtaaaagaaaaaaataaagaaaacttcaaaatggaacataaatttaatttcagcctttaactctataaaactttgagaataaaatataggagaaaatactaggacctagagtttggttaagacttcttagacatgaacaccagaagcatggtccatccaaaaacatcaatcaaaaatcaattaaacactagctttgaaaattctgttaagaagatgaaagacaagccacaagctggcaaaaaatagcttcaaaccacaaacctgataaagagcccatatctagaatttataaagaattctcaaaacttcactttaaaaaaacccactaattagaaaatggaaaaaaaaatgaagacacatttcactaaagaggctatatggatggcaaataagcacctgatagaatgttaaacatcattaaactttaaggaaatgaaaatcatcctagcaatgtaatgtcctacaatgttaggagagctaaagtaaaagttactgataactccaaatgctggtaaagagaaagagaaaacggatcgctcatatatttttgtaaggaatataaagtcataaagccactctgaaaaaaatgctttggcattttttaaaaatcaaaccaaacagaaattgaccatgttaaccagtggttgtattcctgggcatttattctagagacataaaaattcatgcttacacaagatccatacacaattattcataccaaattcatttgtaatagccaaagactggaaataatcaaatgtttctaaatagttgaatgattaagcaaacttttgtacctccatatcatgatatactttcatcagtaaaaaggaatgaactaatgatatataccaaagcttgaactgatatgaagaacattacactgaaggaaaaaggctgtgtcaaaaattgcatactgagtgatgccactgaatgacaaaaggattaaaatggcaagcagattagtggattgcgtgggttaggggtgtgtgtgtaactataaaggagtagtacgagggagttgtggtcatggaatagtttttcaaaatagttctgtaccttcatttggtgttggtaaccagaatctaaacatgcaataaaatggcatcacactatacacacactttgtaccaatgtcaattttctgcaatgatattttaccatacttacatcaagtgtaaccaatggaaaaaactgggtgaagggtacaagcagcctctctaggctgtctttaaaactccctgtgaatgtataaaaagtcaaaataacaaattaaaatgtgttacatctataaaaccatatcctaaatattgctactattagtatttctaaatattataaaaacccaacaagataaatttatatcacaaagtgactaaaaatggcatcaagcaatcacttcaacttttaaaaatggtcctttggatctctttttctgatagatcatatcagaatctttttgctagaataagaaaaggaggacaacagctaacagatagaagctgttgttagtagatgtggaaaaattgataagattggcagaaatagtcataggatattagacaaaatcagtgtgaggaaagatgcaggtgcatttggaaatttcagtgaaaagttaaaactgaaagaatcaaggttagcttggttagttgacaaaaatttaagaaatgctgacaaaatgtatactgttctctactggacatatatcaaaaggagttgaaatcagcatgctgaacagatatcagcactctcatgttcattgcagctgtatcataatagccaagacatggaagtaacatacgtgaccaccaacaaatgaatggataaagaaaatgtggaatatgtgtatagtggaatactactctgtcataaaaggaagggaattctggcacttgtgacaacagggatgaatgtggagggcattatgttaagtgaaatgagccaggcacagaaagacaaacatagcaagatttcactcttgtgggaccccaaaaccttgttctcataaatagaattaatcattctgtatatatcctgcaaaacatcatgttgtacatgacaaatacatacaattttatctgtcaatttaaaataaaaacaaaaattatgacataaaaacaacaggttttctaagaaaaaaatgtacagtgatctgtgagtgagtggaaatcaatcaacacatttttgttggaaaaaataaatatcaaggtcaactatgcttattattggaataaacttgctggtttatggggaatgtgttggctagtggattacgtgtgaaggaaaaagctcattagataagaagtaagtcaaagatttgaaaaacaattatgattctcttctttttactttgtaggtgttctttccctaaatgcatgggaagacaatggtataaaagtattcaaaataaatgtacttcggttttcttattttcctccaagtaaaatatgttagcagtttctcacaaaaacttcagccaaaaaaaaagaaaaaagaaaaaaatgtttctagcattatttaaatttaaagtagataatattctacccataaagaaattcccatagttaaataatctcttcttagtgagtttataaaccaacctaagatactaaagcccagtcatctaaaagagccgtgtagttgtctctgtcccacagtgtgagagatttttgaatggcattgggagtatggaggagaggttgtgccactttaagatggtacaattttatctggatggtttttccacattacacaaatttccttttcctagtctaacaaagagtgccactatagattattataatatgctatatcttgctcaggtgtactgaatacaaaagtaacacattaagaagataaaattttttgaatagaaaatagactataactgaacgtagacagacattccataatatttatttctaattagtgtcttagtgactaagttcttaaaccttctccttccaaggtatgattccggtgcatcatttttatacatttaaattttacaggtgataaaaagctctgaatgtttacagaaactttttaattgtaaattttttttttttttttttgagacgcagtctcgctctttaggccaggctggagtgcagtggcgctatcccggctcactgcaagctccacctcctgggttcacaccattctcctgcctcagcctcccgagtagctgggactacaggcgcccgccactgcgcccggctaattttttgtgtttttagtagagacggggtttcaccgtgttagccaggatggtctcgatctcctgaccttgtgatccgcccgccttggcctccaaaagtgctgggattacaggtgtgagccaccgcgcccggccaaaaatttttaaaacatatatttatatatacagatataaaataacctaatgaactgaaatgtagacattacacagcttcaagaaatgtcaacatgttgtcagttttgtttcttcctcctgtactttctctgggttatttggaagcaaatcctagatatcataaaaacttcctttaagtagttcagtgtgtgtatctaaaaaataactttttgatttacagcaataccactatcacaaatattgcttgaatacaaacaagtacttagtatttgaatttccccaattgttacagaatatcttgtaataatttattaaaatcagaaatctagtaaagattataaattaagaatcacacattaaatctttttttcctcactctatttttttacctttttttttcttgcagttcatttcttgaaagaaccagaaactttgtctgatagtgtttctcacagtcaggatttgtttgcaattgcttttctatggagtaggttaacatgatgctctactctctactgtctatatatttcctgcttatttgtaattggagctctaaggttgataaaattcgggttccattatttttggcaagaatactttattggtgatgtcatgtacatctatcagatgccgtgtgttaactttctctcttttcatgaatttggccatcattgctgatcattcattagatttcttatttcattggcattttgagatgacattcacttattccctagaatatatttaatggaaaacatcatcttatcaactattcatgtaacttgaaaaacagaccttatagaaaagacaggaaaaatgctcaattatttatctctactttcaatataatgatttttttcctgaactctccttcaaagaaggcaaaaggggattttattttagtatccatttaaattcatagttttaaacatatttaatccatcactgttaagattctcactgatgctaaaataatctcaaatttggccaataagaacttcttcatattgtctcctgagtctatataatatatcctaatagtgtaaggtagtgttttgtcttcttttataagagattttaagggttatacattacttgtcctgaaattacctatttctataaaaaaagatatttagatatgaaactctgggcactctggctactcattactactcaaacagtcttcgtttctttgcctattactagaatgatacaactttttgtttttaagataagacacatcatgagatcatatcctgattaaaattgttgagccatatgcataggaggaatcaatattattaaaatggccctactgcccaaagcagtttctagattcaatgctattcctatcacactaccaatgacatttttcacagaattagaaaaatttctaaaattcatatgaaactcaaaatgaacccaaataaccaaagcaaccctaagcaaaaggaacaaaactggagggatcacactacttgacttataactatactacaaggctattgtaagcaaaataacatggtactgatacaaaagtagatacataggctaacggaacagattaaagaacccagagattaagtcacacagcaacagccatctcatctttgtcaaagctgacaataaaaagaaatgggaaaataattcactattcaataaacgatgttgggatgacttgctagtcatatgcatgagattaaaactggaccccttccttacaccatatacaaaaatcaacttaagatggattaaagacttaaatgtaaaacctaatactataaaaatcctagaggaagacctaggatatatcattctggacattatttctggcaaagatatcatgacaaagactcaaaaagcaaccgcaacataaacaaacattgacaagtgggacctaattaagctaaagagctttgcacagctaatgaaactgtcaacagagtaaacagacaacctacagaacggaaaaaacatatttgcaaagtatgcttctgacaaaagtctgatatccaaaatgtacaaggaactcaaacaaatttgcaagaagaaaacaaacaaccccattaaaagatgagcaatgttcatagacagacacttcccaaaagaagaaatacacatgaacaacaagcatataaaaaatgctcaacattattaatcattagaaaaatgcaaatcaaaaccacaatgagataccatctcacaccagtgagaatggcgattattaaaaagtcaaaaaataacagatgctggagaagttgtgagaaaggggaacgctatacacagcttgtaggaatgtaaattagttcagtcacacgaaaaccagcttggagatttctcaaggagcttaaaacaaaactgccattcaaccctgcaatcacattactgagtacataagcaaaggaatgtaaattgttctaccataaaaacatttgcacatctatgttcatcacagcactattcagaatagcaaagacagggaatcaacctagatgcccatcagtggaagactggatgatttagttcattcgcacactgctataaagatagtacccaagactgggtaatttataaacaaaggagttttaattgtctcacagttctgcatggctggagaagtctcaggaaacttacaatcatggtggaaggggaagcaggcaccttgttcacaaagtggcaggagagaaagtgagtgcaaacgctggaaaaactaccatttataaaaccatcaactcttgtgagaattcatttactgtccatgagaacagcatggggaaactgcccccataatccaattactcagttgtaaatgaggaccagttggcaatggaatttctcctaatatcaagggtatcagaataatatctgatttccctgctccactttctcctggaatcactgctgacttcaccagggattgttgcagtgtgtggttcaggcttccaaatcttttaggtttgtgaggatacttcgtcaatattgttacagatgttcttcatagttttgtttgttcctttaattattcactaggtttacactgcttatgctattgtttcatttatttcagggatcaggggagagttaaagattttggggtgggtaaatctactattatctttccagacctcggtctcaatttgatagtatgctcaacagttagaacagcatcaatttaaaaatcccaattctcctttctgatataagaacaacctttgacttccatcacttctgaaaattcactaagtaactataatcttttgactgctgcaatgggcaggaagttgtaggtatatttgtaaaaacagttaatgctaaagatattggggttaatggaaagacaaactaaagactctcttggtatttgcagagagagctcattaatatgcctgttagacttttgcaatgagacatgcctagatatttccatttgaagaaagtaaattaacagaaaaggaaataagccatttttgctcctgaaatgcaggcaaggctttgcgtattgtttgctttcacaaggattccaagcacttttcttttatgaagttggttttgtatttttaatttcagcagaaggtgacaacaggctgaattgcttttctcaataccagaattcataatttctccttaataatgattgtggaataaatgacatttacttagctaaaaaatttaaaattccagtaagtctctttagttacatttgaaataatttaaattttacgaaccatcatgaatcctgaactctacttttgctttgtgacttcttagaacaaactaaacctatcacaagattttatatattatgtaaaaaacaattttgtaccaagagagctctcctctacgattagcaggagaggcgggaaacaagcggcacagaggatcctggagctcagtcaagctccatcctccccgacattgtctcagcccatagttaagcaacacttcggttcttcatgttggcctctgactcattccctcacccataagtactttatagcataatgcttaaacaaagaaaataagtttatataaactaatgcttaaacaaagaaaacaaatttatgcttaaataattttgatttaccagtttctaaaatagaggtatttcccgtgaaagattcatattccaatttcatattttttaatctcaaggtgatgatttatatttttctggattttttttccctaacaacgaagggtgataaatagaagaaaggtagccttaatgtaattaaaccttgataaattcaaacaatgtccactataaaaagtctttagggagtttatgaggtcataggatagtcttctctttccttaggaagttagagtaagtagaaagacaatttcctctcagtctgggttaaggctagtggtagagtaaaaagttctgatacacttatacttccagagttaatgtatacatttgttttgtgtttttaattttacaaagtgttttgaaatattgtggttctttaaaaatgtttttactctctagctactgatttatgtgaacctacattatatttaaagtcaaatatatagaaagaagagcagagagtgtgaatggcaatggcttgccatcagagagatactttgagaaagacaagttcagactgaatgttactagatgaggtgacagaatggttccaggtaaatggaagaaaaacaatattttttaatgtgtggcaatattctgttgaattttagtctctaggctgccacagtgacaaagatgaagctatgcaatatttctatgaatctgtttaggggctggagtaaagagcagttatttaggtgggtggtgtctgatgtcccagtgggcagacattctgcatctatgaagcttcttcaaggccttaagtactgcttttaggtttacgtgaacagactttacttttggcgaagagaagagtaaggtgatgtctcaatgtgaagaggaagttgcaaaaacagttttcatagtgtgccaacatgaactaaggtagaactatattgatgagcagggttaatgattcatgccagatgggatgataatgaactttacaattatgcagtaattcctcttctcagctcggaagtgcctcagagtacgcaggtagaacttgggaagcaatagggatcccactgcccagcactaacatatcagtctcaggtcatctgcccatggtcttgaggttctcactgcaaacactaaacctcacttctggagtgatgggggatttaggctgatacttgcttcaaaatgctccctcttaactggagccctccttcctctcgatggatcactagatagatacatagatagatagacacacagatacacacacacatatctacgtatatatacgtatacatatctacatatatatgtatacatatatacatacatatacatatgtgtatatatgtatattaatatttatatttggtttatcataaagaaaatgtcttctataagtctttgaataaagctgatgctctaagaagatgtatcctaggccaggtgtggtggcttacacctgtaatcccaggactttgggaggcagaggtgagtgaatcgcttgaagtcaggagttcaagatcagcctggtcaacatggcgaaaccccatctctactaacatagaaaaattagctgggcatggtggtgtgtgcctgtaatcccagctacttaggaggctgaagcaggagaatcacttgaacctggcaggtggaggttgcagtgagccaaaatcatgccactgctctccagcctgggtgaaagagtgagaatccatctcaaaaaaaaaaaaaaaaaacacaccaggaaatgtattgtatttattctgtaggtttttatggaagcttgtatattgatgtgaagcccccaaatatgtacacattccaacttgtgaggtgtgggagtggttagtcattatctactctgtatctttccattaatttgtttgtatagccatatccatatcacgtatgtattatgatattattactataataattactatataattatctattatcatatattatctatttatattaccatattatctatttaaagaaaatataagcatgtaaataaacatagaaaatataagcacatatactaccttttatttatttatgtgcttatagaaaataaataatgtatgtttttagaatagcattgcatagaaatcatgaaattttctttgattcatgcaggacttacagagcatgtctgttgagatctatgagtttgtctgttatttctactaaggttttgaaatagttttttgaatattgacacaaaataaataaatttgacttctgagagttaattacatgtgagaattagtaaactgttgaacaaaaaacatgtatctatgaaatatttaagaataaattgaccgctaatggtatatgttcagataaatgagtcctgaattatcttatatatttgaaagacctctgtgaaaattaattatattgtaacattttaacagtctgacccaaaactatgtgacagtattatctgacatttcaggttcataaaagaattgcaattatatatgcttagttagggtttgatgcaagtgtaggttttctgaatttatagatatttttgaataattcaattatggagtaacttttccctattttactaaaatttatctagatcaatttgatttttaaagatcctctcatctttctttccatctctactgtatccatcttagaaataaaaactctccggatttgaagggattttaaaatgcaaatgtctgtttgctgcatcaagcaattctactctattcctggataccactgattaaccatttttaaacatcttcagggacacagaactcactagttttaacacaacactttttgggcctactgtaagagcaaatgtgatgcattttaaggcgtttgggccaggtctcagggtaattaattaattttttttttactgttccatggacatacacacagattacatgttctagaatgttagattagagtttaaaactctaataagtttcctcttttcattttatgaaaaaaacaaatacatgattcaagaatgaacatatgattgaggataggaataactgatatattccctaatatctcctttttcttcattgagataaccttagaagactgaggaatcgacctttctgtcattgagctggggttttgggggaaggagaatatattagaccattcttgcattgctgtaaagaaatacctgagactgggtgatttataaagaaaagaggtttaattggctcctggttcttcaggctatatgagcatgttgctggcatctgcttggcttctggggaggactcagggagcttttactcatagcagaaagtgaagtgggagcagacatgcaggagcaagagacaagagagtagtgggaaggggagtaccataatttacaacacgcagatcttgggagtacccactcgctatcatgaggacagcaccaagccatgagaaatccactcccgtgacccaaatacctcccaccaggtcccactgccaacaatggggattacaattcaacatgagatttaagaggtgacaaatatccaaatcatgtctgagaaggcttttagtaagtggggagattctttttttcactgtgtcaacaggctcaaagtatcaagggaggcctacaaaatccaaccttagatcctcttgttattcatatttgtgtttcatgacactctaaaatacaagtcatgagcttcaaaaccatatccatctgattccaaaagtctgtgaatgtcctacctcaagcatatatatttttaaattctaggttgagcatgtttaattttctgtttccctcaggaggactctggttactttaaatttcaatataaaatttagctgttctgaacatagggagctctattagcacagcagacattctcatgggctccaacctgaatatctaccgcatccacaaatatatgaatatttaccaactctttgccaatgtaagaccacataatggttagtcaagtgtcaagatattcaggttaagaaaaacttgcagtctcaaatatgcttggcgatcacagaatagatgctagatacttatttcaagtgtattatcctataaacctaattcaaagagagaaaaggatagatagacattctacaaagctaggattaattttcatttgaaaaattttattgtacagtttaaagtatgattcatgttaatataagtaaatgccatttttacattttttttccattatcattcttgcaacaaaagttttattatgttttcttggttggatcagagcaattacaactctcaaagtgtctaggaatcatctcagtgcatgtgtacgcagcaataaacatgcttcattctctgggtcagtcagattgttctctctcttccaaatggcctaagaagttaacagactaaatgaaggtgacttgaaaatcatgcttggggcttctctcacactcctgaaagcacactgatctggagttttcagtgtctcacaattccttgatttgagacagatcaccagactatagattctttggtttcttctgcttttttaagtttgatagttaaataagtagcagcatggtatggagggaggagcagaaactgtaaagtgaatgtaaaatagcctgagtgtggtggctcacacctgtaatctcagcactttggaaggctgaggcgtgcggatcacctgagatcaaaagatcgagaccatcctggccgacatgatgaaaccccatctctactaaaaatacaaaaattagctgggcatggtggtgcatgcctgtaatctcagctacttgggaggctgaggcaggagaatcccttgaacccaggaggcggaggttgccatgagccgagattgcaccactgcacttcagcctaagtggcagagtaagagtccatctcaaacaaacaaacagacaaaagaaaacaaaacaaaaaaaggatgtaaaatagatgtaaagtcctcttctcattgtgacctggggcttgtcagccatccctgtgagctcaactttcttatatgtcagtcgtaacactatagtgatgagaatattcttgtcttgtggtagtcattatgcgtgatagaacgtgtaagtacaactttgcaaactatgaaaactttgtcgattattaagaattacatcaatgcctatcccttttgtcctcaaattagggtaaccgctaaacaattataatttcaaaagccatggtcaatataatagccagatgaaggctttatctattttgtaattaaagaaaaacagtggaaaacattaaataatccttattaaaatgtattaaaatctctcatgcacagaagtaatacagacctgatactagatgcataaaatgtgaaactattaataatgggtaagtagatattgtctgatcatttaaaactggagtagaaatataacatccttaatctgcttattctttggtaagttcctagggctatggtaacaatgatccacaaactagatagcttaaggagcagatacaaggggacatcaaaaagtgtgtggaaaaatggaattaaaagacaacaataaaaatatcaatcagctctacttctcaacataagttccatcaagtttaacacacttttgtaaatgatgataccagccatttagtttatccataaagacctgaggatcctgggaatagaaccaagtcaatccactcttcttaacattactaagtgaagaaacattagtgtctttctttttttttttttttgcttaattagaaaagaaagaaagtcagaaggagccaaatcagggtcgtaaggtggatgcctaatgatttccctcgaaattgctcacaaaattgcccttgtttgatgagaggaatgaataggagcattatcgtggtgaagaagggctctttggtgaagctttcttgggtatttttcttctaaagctttgggtaactttctcaaatcactctcatggtaggaagatatcatgatttgaccctccagagagtcaacaaataaaatgccttgagcaccccaaaagaccaatgtcatcctcttgactggtccactttggcattgactaaactacttcaacctctttttagccattgcttcaattgtgctttgtcttctggattgaaacactgaagccactgttacaattctttaagcaaatgcttcaggatcttgaactcacttgttaaagatttccattgaaagttcggctcttgtctgtagctgatctggacacaaagggcttgtcacccactgaatggaaagtttgcttacctttaatttttccatcaggatttagtaagctgaacctattaaggtgttggctattgtttctgatcttagtcattggtccttttccattagggaacgaacaagatgaatattttctgcacgatttgtgtatggtctattactgcaggcttcatcatgaacattgtctcatcccttcttataatgagttatccactcacaaactgcttatttctttggggcattgtccccataaactgttcataaagcatcagtgatgttaccattcttccacccaagtttcaccataaatttggtgtttgttcttgcttcagatttagcagaattcatattgctttgataggggccattttcaagctgaagaaagcatcatccttcttagtgcctcaaactagattttgttctgtcatgttatcttaagttagtgcaacttactttggtgcaaaaaaattgaaatctatgaatagattaaaaaaattttagagacaaatactctgtcacccaggctgcagtatagtggcatgatcatagtttaatgtaacctcaaactcctgggttctggtagtcctcctgcctcagcctcctgagtagccaggactaacggtgcattccaccagtcccagctaaagtttttagtttttttttttaatttttattttgtagagactgggtcttgtcacgttgcccagactggtcttgaagtcctgggcttaagtgatcctcccacctcagcttcccaaagtgttggaattacagccgtgagccactgtgcttggtcccatgggtttttcataatactaattttccatgagctttttgaagaccctttgtatttattgtctcataattttgtaggcaagaagtctgagatcaagttgttggcagggttggtttcttctgagagctatgaaggaaagatcagttctgggactctttccttggcttatatatggttatggtcgtcttctccctgtgtctcttcacatcttcttccctccatttgtgtctttctctgtacccaaatttcccctatttataaagacatctgtcatattgaattagggtccacacatatggcttcattttaagttgattagttctgcaaacaccttatctccatataagctcagattctaaggaacgaggagttaggacttcaacatttgcataatggtgggggagggaaattgtcaacccataaaatagtctatgtttaaaagcatagcccccaaatcaaacctccttatttgataactataaagccttcttgacttgtcaaataaaagtgacaagtctctccatatttgactttcaatttctcttcagccatattattttaaactcaattcccccaaggacaaacatgttcttatacatctttgcatttccaaaagttgatttacttgtcccaaagattttttctttgcttgacatcttcataaatctctctgcataccactttcctcagtcagactattaattctccagtgaagcctttttctaacacctacttcagccttaatgataaattctccagattacaaggcctctctggtctttgtaacaagtttatgctctttgaaatgagtaactctatctctatctagatatatccagagaccaccacaaaaataaggtacagaatacacggcaatcactaaatatatgttaaaagaacaaataaaaagagaacaaagtaattagagagatagaaataaagatggtggtgctgctgattatgatattagcaataattcatatttcttgagtacttaccatatgccaggtatgtgctaattggtttataaattctattctcactttacaaataaaatgttataatttggctaaatatcctgcctcagcttacaaagtgactagaaagagatgccaaaagagaatgacatcagcatggtggccatcaaggtaacatcaaaattcctgtggagcatgggagcccagtataacaccatatagagtggagcatggtaccctgtatctgtcacactgtatctcctactagatcagatcacagacaggagaaacctcttcctacaaggaaaatacaagctggagacactcattggtcttcatcactgccagatacgaatggtaactgatagaggaggatcttctagtccttacaggccctgagttcagtgtgaaaattgctggaaatctgcacagttgcaacccatccccagggcaggagtcctcatggcatttgcaacccgtatgacctaagaagctatggcacagtcttggacattggagcagagttctgcatagcagcaaaactgcatgcacctgtccccaccaacagccaggccagaggcagtcctgccccataagctggcctcacctcagcagagaggtttgggggcagcccctggactcacatgtacctgcccctagcttgacagcttcctagaggtaaacccatttctctagaggaactcttgctcagttgcttaacacatgcacacccacccctgccccttacagaccaggcagtgaccctgacaattcagaagagcctaccacaaaatttgacttccatgcctgcatgtgtcctaccaatgactagtccaccacccttgccactacaacaccacagtcacaaactgctgtagcctaggcctataataatctcacacatcacaatcaagggttgtaactgaagcatctgcacagagaacatgctactgagttcacccagaaccaaagccaatgctacattctcaaccaacatcctaggatccatttacaggaaaaagctttttcctatgaaagttattccataaattggaaaaagaaattgttctactagatacacagatatcaaggtagggacacaagaaacaaaaaagcaaaaaatataacaaccacaaaataacagggttctttgtctctagcaacagatcataaatgaaagggtatttataaaatgcttgaaaaagaattactaataatgatttcaagaaaactcagggagatataagaggatctagaaaaaaaaattcaatgaaatcaggaaaacaattatgatatgaacgaaaaatgtaataaagagatagatactataaaaaacagaattgttggagctgaagaatttaacaaatgaaataaaaatacaatagagagttttgacaacactagatcaagcagaagaaagaatctctgagcttaaaagtaggcattttgaaataaccctatcagaaaaaaatttaaaaaaaggaaagaagaatgaaaaagaataaagaaagcctatgtgatatatgggacttcattaagcaaacaagtattcacattatacaagtgccacagaaaaagaaaataaccaagtatagtaaacatacttatagctgaaaagttcccaagtcttaggggagatatggacatccatgtctaagaagctcaaaagttttcaatgatttttaacccaaaaatattctttccaaagcacattataatcaaaatgtcaaaggttaaagacaaagaattctaaaagctgcaagagataaatgtcaagttacatataggggaatttccattagactatcagcatatctctcagcagaatctctgcatgccaggaaaaaaattgatgacatactacaaacactgaaagataataaacaaacaaaaagaaagcaaacaaacaaaaataaaaaatttctcacagccaagaatattatatccagcaaagctattcttcagaaacagcaaaataaagaccttcgcagacaagcaaaaactgaggcaatccatcacaattaaaatgaccttattagaaatgctaaaaaaggaaacaaaaggataataattaatattatgaaaatacaaaactcagcagtataggtaaatgcataaccatacccagaattccctggtgctgtaatagtgctatgaaattcttcaatattacagtatgtaggtttaaagtcaaaaaggtaaaaacaccaacagctgcaattaatgactaaggaacacatagaagataaatatacaaattacagtaaccaaaatgcaaatgaaaagggagagggaaaaaaagtctatagtatttttatgtgaccaaagttaagttgttatcagcttaaaataggccactatacctataagacttttcatgttaaccttatggtaaccaaacacacacacagacaaaattatagtaaatgtgcaaatgagaaagagaaaagaaacaaaatttagcattacagaaaaccaccaaaccagagaggtaaacaacgagagaaggaaaaagaaacaaaatatctacaaaacaaccaagaaatcgttaacaaacttgcaggagtaattatttgcctataaataataacatgaatgtaagtggattaaattttccaatttaggtttagagtagttaaaaggataaaaaacaaaatcccactatatgttgcctataacagatgcacttcactgttaaacacagacagactgaaagtaaaaggatggaaaaatatatttcatacaaatggaaaccaaaaccaagcagagatacgcatacttatatcagataaaatacatattaagtgaaaaactcagaaaagacaaaggatattattatataataattacataactaactcaacaagaatttacaacaattatgaatatgtatgcacccaaaacaggtctagcaagtattactagacctaaaaggagagttagatagaaatataataatggtaagagacttcagcttcacattttcagcaataaacagatacttttagacagaacattaataaagaaacaacagactcaaactatacgatagatcaaatgtacctaacacatatttacagaacattccatctacagctgcagaattccaagttttcttaactgcatatggaacattctcgagggtagattacatattaggccacaaaacaagtctaaacagatttaagaagatggagataatatcaagtatcttttatgaccacagaagtataaaactagaaattaacaaggaagacttcaaaaaccttacaaatacatgaaaattaaacagcatcctccacattaaccaatagatcactgagaaaattaaaggagaaatttaaaaatttcttgaaacaaatgataataaaaacacatcatactgaactgtatagaaaataacaaaagcagttctataagaaaagtttatagcaataaacatctacatcaaaacaagaaaaatatttataatcaacaacctaattgtataactcaaggaactagaaaaacaagaataagttaagcccaacattagtagtggaagggaactaataaagctcagacctaaataaacaaaatagagactaaaataattcataagatcaactaaacaaagagttgggttttggaaaaaataaacaaaattaacaaactcttggttagattaactgagaaaaaaagagaaaaaacccaaataaataaaatcagagataaaattgaaacatgattattaagatcacagatacaaaggttgcacacaaagcagaatgccagcatctgcttctggtgagggcctcaggatgcttccatggtggaagttgaaggaagagaccacaaatcacatggcaaggctgagaacaagagagagggagtggggaaatgccacgttcttttaaacaaacggatcttgagtgaagtcattaccactcattactgtggggaagacacaaaggcagtcacaagggattcacccccatgactcaaacacctcccaccaggccctacgtccaacattgacagtcacatttcaacatgagatttgaaggggacaaaacattgaaccatatcagacagtaaaagacatttctcaatagaagaaatacacatggctaacaagtacattaaaaagtgctcatcagtaataatgagggaaatgaaaatgaaaaccacaataagatacaccctcaatccaagtagaatgtctattatataaaacccaaaagaaaacaagtggtggtgatgatgtagagacaggggaacatttacacaccgttggtgggactgtaaatccgtacagccactgtgaaaagcagcacggagattactttaagaattaaaaatagaggccatgctcaatggctcactgttattccagcactttgggaggctgaggtgggtggatcacctgaggccaggagttcaagaccatcctgaccaacatggagaaaccctgtgtctactaacaatacaaaattagccaggcgtggtggcgggcacctgtaatcccagctactcaggaggctgagacaggggaatcatttgaacctgggaggcagaggtgactgtgagtggagatcacacgattgcatttcagcctgtgcaacaagagtaaaactccgtcttaaataaataaataaataaataaaaataaaggtagagctaccatatgagccattgggtataaatccaagggaaatgaaattggtatgtcaaagagatttctgctctcccatgttaattgtagcactatttccaaaagccaatttatggaattaacccatgtatacaaccatggatgaatggagaaagaaaatgtggtgtgtgtgtgtgtgttccatatatacacacatatatatgtatacacacatatatgtatacacacacacatatataaatacacatatatgtatatatggaatggaatactattcagctgtagaaaagaatgaaatcttaccatttgcaacaacatggatggacctgaagaacattatgttaagtgaaataagccagacacagaaaggtcacaagatctcattccatgtagaatctaaaaaaaaaaaaagttcatctcatagaagcagggagtaaagcgaggggagtagggagggaaagatggagagaggttggtgaatgaataaccattgataattacaaggaataggttgtggtattttactgcacaatgtgatgaaaatagttaacagtaaggtattatatattggaaaacagaaacgagaggattttgaatattctcacctcaatgaaatgatcaatgcatgaggtgatggatacactcgataccttgatttcatcattatacaatgtatatatgtattaaaatattacattgtatgccataaatatgtataattacaagatttcaacaataaatttaaaataaatgcacaagtatgatgtcagaattggaaccatgaagatgaaactcaaagactatattctcgatcaatacaaatttttaactactaaagaataaaacccatgtaagatgttttggttagatggtacagtttattttgcagaactcaccttcatccgtgtaccttttttgaaaactcaaagattactaaaagagctttgaaatatcatccttatggtttgttttatagcctgagttttacaattcacatttaaactccttggtaattttttaaggatttttcttctacttgagtctcaaatttcttatgaactatgacaagactaaaagatactgagtgagaatagaaaatagaaacaaacagggccaggtgtggtgactcacacgtgaatcccagcactttggagactgaggccagtgaattacttgaggtcaggagcttgaggccaggctggccaacatggggaaaccctgtctctactaaaaatacaaaaattagccgggcgtggtgatgcgtgcctgtagtcccagctactcaggaggctgaggcaggagaatcacttgaacctgggaggtggaggttgcagtgatctgagattgagccacgagccactgcactccagcctgggcgacagagcgagactcctcaaagaaaaaaaaaaaaaagaaagaaagaaaggacaagctgctgagtctcttgcgcaagacttctgctgctggaggcttgataatctcttttattgccacttttttttttttttttttttttttgctccagacatttttatcaccttctggtaatttttcttcacttcacttcaatctgaattgtagcctttctgaaagtatttatcactgtgattttgtttgctgtagcttattaaatgcccttttggtcctttttaattgacctttttaaatatgagctcatcttagagaactatctttatatctaaaattagtccttagaagttcctagttgtatttcttatcagggtcacttgtaattataatgtcagacttttagaatgaaacataagcatttgtcacatttagccatgattggtattcttagcactgaactggtttccttaactctagtaagttcctttctaatttataaattatgtcaagtttctaatgttttggattaaattctaaaggatattatcacactttccaaccatgtctgtcatcatgcacattagtttactagggctaccataacaaagtggcactcagtaggtggcttaaggacacagaaatttatgtcctcatagttctagagactagaggtccaaaatcaagttgctggccatgttgtttccttctgagacttgtgagcaagaatctgctctgtgcccctctcatagcttccggtggtttgctggcagttcttagtgttctgactagtaaaagcatcactctgatctctgtattcatctttacatcaagctctccttgtctgcatgtttatgtctaaatgtctcctttttatcagaacatcatttgcattgaattagtggcccaccttactccagtatgacttcatcttcactaatgacactgcactgatcctatttccccccaaaatgtcacattctgaagcactgagggctagaagttcaacataagaatttggggggtggggagacaccatgcagtctgtaacatcatgtcacttgacacagcaaaaccactaatgttttccattaccccgtaggacaggcaaaccctaccttgcctataagacctatcacaaggtgtctgtaaacagtgttatgatagaccacctcttccattagcccttatcctcaaatacttgtctattcaccaaaaacaaagcatgttgtctgctttctgacactgccttgttgctctatactttgcctgcttgtatgtatgtcattaggatttctcttcaccgacatagcagttaagtatgttccatgtgtctttttgtttatacattcccattttgctatatattgtgagtataaaaaaaacagcagccaagcctttcatgtctttgtaacacccacagggcccataaaagtgtataccacatagcaggtactatatattgttttctttaagagatgaaaaataaagaataaaaagtgaaagactagtcattatactaaactaatctacaataaaatgtttaaaattttaacattttgatttaaaaataatattaaaatatattaaatatttaagcctaaacaccttattaatcataacaccatttattaatgtatttttaactaatatgttctaaaactacatgaatgtgagtatggataaaacatgtcttcaaaaatttgcagactggtaggggagatggacaatatataaggaaatagcagaattgagggaaatccattccaaaagcattgttttggaaaaaaaattatatttaacatgtttaataaatattttgtaagaaaattttaaaaagaaagttattgtaacttagaaaattaagggatcttcactcccagaactgcatttttaagaaatcaatggacagacccactccacaaccatttaactgcttaactggaaaaaagggtgtgtgtgcgtgtgtgtgtgtgtgtgtctgtgtgtgtgtagtttctaaaaattgtcctaagagcatacgtcaaatggagaatcatttattcaaggaaagctactaaatcttaatcagaataacaataatctgtgacatttgagccagctgcctgctaccacctctgtgttcagttccatgtgatggaagagctattctgaataagtatggccaagaaggcatggctttgtagcccccctgctcccctcttaggagttcagtttaaaccccagaagaggcacacccaccagcatgaagcacccccaccagcagaagcacacccaccagcagaagaggcacacccaaaacccttcggcttgtgcagcaggagctctttctgaggcaggcatggttaaaattgaggctcccttctcccactgaacatacactcgttaagaaaagctttatccaaggaattgcagatgaaaaatactggaccctattgtccaaacctagcccacttatagggtgtagttttcttgccaggaggagaaaactaaaaaggacaaatgctgccatttacatctagcaccctcctcgtagagtaggggtgcccctccgtgaaaagcagaaaattttccctgtccccatgtgtggtgcagagtttctgccaagagtgaggcatgccataaggacaaagagcctcacagctctccctaagtgaagtagtgttctttgaactaatttcgaagggtgtttcagaaaacaatgtagatttggttggtgagcagttaagagggggtaaaatggtagaccagctacaagtttaacacatttgtgcctgagattcaatctttttgaatttttgcaatcagtccttggcgatggccttgagcagtatgatataaataactctcacatgcttagtgtttcaataatggaacactagacataagtgggaagagagataaccaggaaagaggacagctaaggagccctcttcagttaagagcaagctcaaagaaggacaaaataaccctactgccgcaaatggagctccaaacttaattgaatcagactgtagaacaattatgcccctgggtcttgtcaaaaataataaagcaatcagctagcaattaatggaagccgacagctaggtgtgaaaccaatagaggcagagcagccagaaagttaacatgaaatcaaggaaagaaacagtcaaaggaaatctggaaaagccacatccattactttgtccaaggaatctgtgcacatgagcagtaatatgtcctctgagtctgcacatgcaagaaaacagacttcgctgaacaaatctagcctagctagtaacaaatgaaacaacagcagcagcaagcttggagtgcagaatcaatatgcagagttgctacaatatattatttaaaatgctgagttttcactgctagatgatccgaaagcagtttcactgatgaggatgctaatactgtatattttgagtgtttaaataacactatgaaatgtgagagtaggaaatattatattactaatttttctgaaatatgctattttaatgtgtatacaaataaaatatatttttgatgaaacataaaatgttcacttttcagaaaagcactgtaaaacatgcaaagagacaagaaggtgtcatccatacacaaaagaaaatcaagtgatagaatttgtttttgaggggtcatagatgtagacttcaaagcaattattgtaaaaatattcaaacatttaaaaaattacataattaaaagatggtatgatgataatatctaattaactagagaatatcaacaaaaataaattttataaaagaactaagtgaaaattctagagttgaaagtagaataattaaaacgaactattcactcatggggctcaatagtatatcaaaacttgaagaataaacaatctatgaacttgaagagacaaggatagagattatatcatctgaataacacaggaaaaaaagaagaaagaaaatgagcagagtctaagagaaatgtatgatgccattaaatacataaacttacacataatgagattaccgcctgatgagattaccagaagagaggacaaagaaaaaggagcaaaaaattattttaaaacatagtagttgaaaatgctctaaatctgattaaaaacattaatttacacaccaaaaagttcaacaaggtctaaacaggaaaaatgaaaagagacctaaatctatacatatcacagtaaaaatgttgaaaggcaaagaagaaaatcgtaaaaagattaagatacaaagggatcaccataggattaatagatgacttctcattatttacaaggacattgccatggaatactgaagtcagcgtaatgacatattcaaaattctgaaagaattatgaaccaagaatcttatatcaggcaaaactagcttttttcaaacattaaaggagaaaatcagtcacagtggctcacacctgtaatcccagcagtttgagaggctgaggcatgtggatcacctgaggtcaggagtttgagaccagcccggccaacatggcaaaattctgtctttcctaaaaatacaaaaattagccaggcatgttggtgtgcacctgtaatcctagctacccaggaggctgaggcaggagaatcacttgaacctgggaggtggaggtggcagggagccaatgtcacaccacggcattccagcctgggcgacagagagagacgctgtctcaaaaaaaaaaaaagaaagaaagaaagaaagaaagaaagaaagaaagaaagaaagaaagaaagaaagaaagaaagagaaaataaagaagaaaagcacatttccaaataaacaaaaactgaatttgttcctagacaatccatcttaaaagaacgactaaagatgtatggttttccatatgatatatatggatcttggaagttgtcaatttcattcacactataagaaaaagctgaacaaactgaaaatcaaaaactcttagatccttcagaaaactgagacaataggagaaattgctgccacataaattgaagaagcaggaaggtaaatgcagatgaatcacaatttttttggaatataaacctaggagaagaaattttcatgagacacagtctggggttgggaaaccgaagctgtaattgataaactggtggatgagtattaatagttccaaggagtacctgtcttagaagggtttcccacacttttatgtaagttttgccactgagagccctaccaggttttcaccaaaaagattggagaaaaaatcccttatgcttctggcagagggagaaaaaagcaactgttttgaaatacacctgggacattctgttcttaacaagaattaccctcaaaaccaaatagtttactagagtctaacaaatggtttttaccagagtttaagcaactgagaggaaggaaaatatccaacttcagcctctctctagatttcaatgtggcagggggaagaacaatactcaactgcaacccactccaaacttccacattgtattaaggacatacctagctctagtcccttgtagcatttctgtctcaccaaagcagaggagactgaaaaggatttgttaagtcacaacacagaggcacaagctcactaaaaaacagaactaagcacgggactatagtacacttctccacacacaacttacaaatgcatcactaaagtactgttgaatgcaggttttttcacccagtacatcacatccagcttttaacacacacacacacacagacacacacacacactacacagtattctaaaaagcaaaagagagtttgaaacaacaagaaaaaataagcataagaaccagaatcaaatatgggaggaatggtgaaattatcagaccagaaatgtaaaataaatatgactatcgtgttaagagctaatggaaaaaaaaccagacaatattcaagagtagataggtaatgtaagtagagaaatagcaattctaaaaaaaaaaaaacaattaaaaagaaaagcaagaaattaaaagtattgcaaaagaatgaagaatacttttgatgggcttattaggagaatgaacatgattgaagaaaggagatcatggaacatgaaagtttttctgtagaaacttccatactgtgggataaatacaatagctataacacatgcataatgggaatactagaaagagagagaaaaaaaggagcaaaatatttaaagcaacagttactgatagtgacaactcttttacaagattaatttcacagagcagactacatacccaggaagttcagaaaacaccaagcacaatacattgcaaaagaactacatctaagcatattatattcaaactgcagaaattcaaacacagatcaaaaaaacatgaaaaagtgaggtaggggtgacaaccttatctgcagatgagcaaggataataattgtatcactcttgtcatcagaaactatgcaagcaagaagaaaatcaagtaaaatatttaaagttttgaaaaatgaattctcatcgatttagaattccattcaagtgaaattattcttcaaaagtaaaggagaaataaaacttttccagataaataaaaattgtggatattgttgttagtagccctatcttacaatgaatgttagttcttcgaaaaataggaaaatggtataggttagaaaccttaatatagttttcaaaatgaaaagcactagagaaaaaataagtaaaggtaaaaattttttttattcttagttgatcaaatagacaacagattactactaatctgttagttgctactaattattagcaacaatgtacccagtggatataatttatggataagtgaaatgaaagtaatgacagaagaaatggtaaggcaaaattgggaatattttctattaaggtacttgcactctctgaaaagcagtacattataatttgagagtagacttgcattagacgtaaatgtaaattgcaaattctagaacagccaataaaaaagtgaaaaaaattataactgacatgctaaggaaggaaagaaaacagaatcacataaaacattcaattaaaaccatagaaggctgaaaaagagtggaggataaaaagacaaacaaggaacagaggagaatagattataaatatatcatatatgaatgtaaatttattaataatcactttaaatgtcaatggtctctatgcacctattaaaatatagagaatttggcaggggtccctaaccccagtgtatgtgctcagatcacagtaaaattaaactggaaatcaataacataaaggtagctggaaaaatcaccaaatactagaagattaaataacatatttctaaataacacatgggtcaaagaagaaatctcaagagatgtggaagatattttgaactaaatgaaaaatagcatactaagatttgtagaatgccatgaaagcagtgattaaatgtaaatgtataacattgagtgaccatattgaaaagaagaaagatcaaatcaataatctaagtttccagcagaggaaactatagaaataagagcaaattaaatccaaagtaagcaataataattaaaattagaacaaaaatcaatacaattataaacagtaaatcaagagaaaatcagcaaaccaacatctgtttttttgtttttgtgtttgttttgagacggagtgtcgctctgtcacccaggctggagtgaagtggtgcgatctctgctcactgcaggctccgcctcctgggttcacgccattctcctgctcagcctcagagtagctgggactacaggcacccaccaccacgcccagctaatttttttatatttttagtagagacggggtttcaccatgttagccaggatggtctcgatctcctgactttgtgatccactcgcctcggcctcccaaagtgctgggattacagacgtgagccaccgcgcccggcccgaaatctttttttttaaaagatcaatgaaatcaataagcccaggctatctaaaaagaaagaaactatcaagctgtgaaaagacatggtaaaactttaaatccaaattactaagtgaaagaagaaaactggaaaaacaacatacaatgctactccaaatatatggcattctggagaagacagaactgtagagagaatttaaatcacttgttttcagggattagaggaaagagagagatgcattatcacagaagggagaatttttagtgcagttaaaatactctgtttaatattaaaatactccgtttagcagtctattttataatggtggatacatgtcattatactcttgtccaaatgtatgtacacaagagtgaaacctaatgtaactatgaacttttcgtgataatgatgtgtcagtgtgggttatcaattttaagaaatgtaccaccgtggtgggagatattgataaggggataggctatgcgtgtgtggatatggtacatttctgtaacttctttttaattttgctgtgaacctaaaattacttgaaaaataaagtctttaaagaagatatatatttgaggtaaagacatggagtacaaaaggaagaagacaagatgataagacatatagaaagaaaagcaaaatgacaaacgtaaatctaaccatattagtaatgttattaaatataaatggattaaataaggtaataaaaaagcagatattatgaaaattaattgaaatggaaagtgtctctaggagacacaacttagattcaaagacacacgtaaattgaaactaaaatgacagaaaaagacatataatgcaaatgatgatcttaagatagctggtgtggctatactaatagcataaaatagatttaaaggttaaaaaatttactactaaaaaagtaacttcatttttaatgaatttaaaattcatggggaggaaataacaattataaaaattataggcatcttacagaggaaacacataaagtgaaaacacaagtttgaatgaagaactagacaatttcacaatagtagctggagacttcaatacaggtagagcaagcagaaaaagcacaataatgcagaagacttgaacagctctatgaatccttgctaaccccaacagacatgtgtagaacacttcactcagtgattgcggcatacacattcaagaacacatgaaacatctgtaggacaaatcatatgctaagccataaaacaagcttcaatacatgtaagaaaattaaaaccatcaattgttttctctgaatgcaatggatgaaaagcagaaattaataacaaagaagatgtggataacccacacatatatgaaaattaaacattaagcattctcgaataaacaagatatcaaaatgagaattacaacggaaattagaaaatacttgaagatgagttaaattaaaacactgcataccaaaacttacgggatccagataatgtagcgtttacaaaaacactacattatagctgtagtctattatattaaaaagcagaagaatctcaaattaataaccataattttatcttaagaaaccagaaaatgcactgggtgcagtggctgatgtctgtaatctcagtactttgggaggctgaggcgggaagatcgtttgaggtcaggagttcgagaccagcctgaccaacatggtgaaaccccgtctctaataaaaatacaaaaaaattaattgcatgtggtggtgcatgcctgtactcccagctactcagggggtggaggtaggagaatcacttgaatccaggaggcagaagttgcagtgagcagagatcgcaccactgcactccagcctgagcaacagagcaagcctccgtctcaaaataaaaaaaaaaagaagaaagaaaccagaaaaatgaaagtaaactaaacccaaaacaagcagaataaggaaataataaaatggaaacacataaaaatatagaagagaaaaataattaaaaaaaattaatggtaccaaaagttgatactttgaaaacacctgcgaaattataaaacatttaaatagagagaagacttgaattattcgaatcaggaatgaaaaggagaacatcattactgagcttgcagaattaatgaagaaggtaagagaatactataaaaaactctatgtcaacaaattagataatttagataaagtggacacattaccagaaagaaaaatataccaaagtaactcattaagaaatacaaaactagaatagacctataaataataaagagttgaaccaataattttaaaaacttcttccaaggttaaaagctcaggtcaaataatgttactggtaaatccttccaaatatttaaagaaaaatttacataaatgttttacatatgattctaaatatttaaaaaagagtgaacactcctaactcattctgtgaggttattaataccacaatatcataaccataaaaagacaacacaaagaaataaaattaccaccaaataatttttatgaatatatagcaaatatttgcaaaacagcaccagaaaatcaatcccagcaacacatagcattatattccacaacccggtatcacatattactagaataaaaagttggtttaacattttaaaatcaataatctaatacatcatattattggaataactggaaaccaccggattttcttaatagatgtagaaacattatttgtcaaaatataacaccattttatagtgcatacactcaggagactggacatagaaaacaatctgatcaaccttataaagggcatctataaaaaacctatagctggcaatattcttaataatgaaaaaccaaagcatttcttggtaagttctggagcaagaaaagagtatttgcttttgtcacttctattcgaatttgacaggaagttctagtaaggcaattcaccaagaatatggaataataggcatccatattggaaataagtaataaagctatttttattttcagatggcatgatattataggtagaaaatcctaggatctacaaaaatttagagttaattaaaagttcagagagacattaaatcaattgtatttttataaagtagtgatgaaaaacctttaaatgaaataaaaaaacaattacatttacaatgatatcaaaaaaatgaaatactttggaataaatttcatgaaagtggtataaaacatatacagtgaaaactagaaaaaaattaaaagaaattttttaagaaacctaaatgaatagaaagacataccatattcatagatagtaagaacactgttaaaaaagctatactttacacattgatctacagattaaacacaatttatatcaaaatcctagctttttttttttgcaggaattgatgagctaatgctaatattcatgtggaaatgcaaaggacctagaatacccaaaacaatcttgagttaacagaacaaagttggaggactcacatttctagattttaatactcacttcaaagccacagtgagcaagaagtataagactggtataaggaaagacatatataaatcaatagaatagaattaaaattccgaaaaataagtctcacatttatgccaaattgattttcaacaaagatggtgagagaattcagtagaaaaatattcttttcagcaacttatcctgaaacaactagttatacgtaagcaaatgaatgaagttggatcatgtcctcaaatcataaacaaaagttaacttaaaatagattataggtttcaatgtaagacctaatactataaaaatcttacagagaaaatagaagtaaattttcctgaaatttgattatgcaatgacttcttatgacatgaaaacaaaaatacatgtgatgaataaatataaataaattaataaaattaataattttggtggggcatatggtaccacaacagaagtgaaagacacagaattatgtgtgtgtgtgtgtgtgtgtgtgtgtgtgtgtgtgtgtatatatatatatatgaatgatacaaatgttaataagaaattaaataaagcagtaaactttctccttaagctaaccaaaaaaagcgaaagagaagtagaaatcattgtgtgattcttgccccccggttttgagccacagtgctactcttcactttggaaactccactttaagcatcagtgactggaaaaatcccctgaagccactccccttgggtattttccacttgctcagacatctctgtgtaggaacgttaacaagatcaccacgccccagagaagctgtctgtaaagaacatttatatttaagacaccctttttttttcatagttactaaagattttcattctgctatccttaggacatactttaaattcttaaaaatgataaccatttctcatttgtcaccatatctaagcaaatagtatacagtgtaatgaagttctaaattttctttcagatgtttacaggtttttcttttatgcctttactgtgttattaaagtttaaatgtatgaaggtttttttagggttaacctaaataattttatatagcagaaaaagtatttttaaatcatatgtctgataagggatttgtagccagaatatataaaaacttctgcatctcagtaataagatgaaaaatgacctagttaataagtgggtgaagcatttgaatagatatttctccaacaatagtgtacaactggcaaatatacacatgagaagatattcaacatcgccagtaatcagagaaattcaagtcaatctatgagctatactttacatacacaaagccggctataataataaagtgataggcaatacctacagttggtgaggttgagaaaaaattagaatgctcatctattacagatgagaaggtaaagtgctgcagccatatgaaaaataacttagcagttcctcaaaatatcaagttcccacatgaagacagcaaggcttattcaaaattcaaaagtcaatctatgtaatccaccatattaatgggctaaagaaaaaatatatagtagtatcatttgatgcagaaagcacatttgacaaaaaaattcaacacttgttcatgataaacatctcatcaatttaagaattaatgagaactaactcaatagagagaatctacaggaaaaatagatactgctaatgtattcagtgatattgtgagttctttccctagaaatcatgaacaaagcaagggtatacatgctcaccacttttattcaatacagtactagaaggtaaagtcacacacattggaaaggaataaataaaactattcctgtttaccaatgacgtttttgactatatagaatatttcagtgcatctgcaggaaacttccagaaacactatatgagtttagcaaggttacatgacgcaagacccacataaattgatttgcatttccatgtactaataataaacatgaggaaacaaaaattgaaaatacaataccatttaaaatgtatccacaggaaaattatttggtaaaaatttaacaaaacatgtataagatctgtatgctagaagtcacaaaatgttgctaaaatgaaatcaacctatatttaaataaatggagagacatattatgttcatggatccagaagtaatggaagattcagcacagtaaaggtgccaattcattctcaaattaatctatagatttaatatccatcaacatctagcaagtttttaaaatagacataagaaagacatattttttaaatagacataaaataaacatatatggaaatgctctggtcctagagtagccaagacaatcatgaacaaaaaaagagaataaagtgagaagaatcactctaaccagtactgacctttaataaatagctacagcaaacaagacagcatggcactggaggagggagagatacacagatcaatggaacacaattcagtagagaacctaagaatacgtatacatactcatacatattcaattttttttttttttaatttttaggcagaggctccctctgttgcccaggctagaatgccgtggcaggatcttggttcactacgacctccgcctcctgagttcaagcaattctcatgcctcagcctcccgagtagctggaattacaggcacacaccaccacacccagctaatttttttgtatttatagtagagaagaggttttgctatgtcaccctggctggcctcaaactcctggcctcaagtgatatgtctgcctcggcctcctaaagtgctgaggttacaggtgtgagccatcgcacccagcctcaaccagtttttgaaaggtacaaaagcattttatggaaggtagggtggccttttcaccaaatgatatttgagcagttagatttagtgggccaagtaaaaggggctaaaccttacatcttatacaaaatttaactcaaaatgaattactggtttaaacatgaaatgtaaaactattcaacttaaagaaaatatctttgatatctaaaactgggctaagaattcttagtcctaacattgaaagtatgattcataaaaggaagaattcataaattgggctttataaaaattaaaaatattcaccatataaaatacctgtttaggaaaagacaaactacaggttgaaagtaaatatttgcaaacaaataatataatatctagaatacataaagaacacttaaatttaacatggataactgagaaaatttgagcaaaatttgttgattttattactgtcataattatggtcatgatagtgtataagtttgcccaggtgttaccactcggggaaatgctataaagtgtaaactacgtctctctatattcattcttacaactgcttgccaatctaaaattaatgcaaaataaaaagttaaggaaaaaaaattatgtgccagcaaaattgcgttttaacatcctccacagcaacctcaaagtatggtactcacattggtacatacaacccagcagtccaaatatgtatatttatgtgtaaacttttagtactgaccacgtacaacagcttgcatttggcaaaaagataatttgaaatagaaaataaagagaaaaaaaacagagttttttccttcaaggattctgtaaggtagtcagaaaataagacacatacaaatgactgtggtacaggcagtatgtggggagttacataaaagacgtatacacatttactctatgagcttaggaggaagatagcaatgctttttggaaaagttcatggaacacaggacttctgcagtaaactttaaggacaaaaagattttttcttctttctccatgtgtttttaattcttgtttaatcctttctttatcattccttatgattgaaaataatttttaaaaagatttttccaagtataagttagtaatggggtaacttcagggtaaatccagcatgaacaagaatatcaaagcagaaaacatgagctagcagaatacaatcagcctatttcttccaaagcaagagctataatatatgatgacagcagaaaaagatgcaggccagattttaggttttgaatgccaggttaagaattttatttttgtcctatagagtgacagacgctattaaaagtgtttcagtggggccacacagagatgaaacaggctatccaatgaaaatgtgtatgtgaaaactttcagtcctatcatagatatagaaagaaaaagaaacaagaactataaaaagagaaagctgtactgtggatagttctctaacaaaatttaaccaataactctcttatcatcttgctggatcttcaaaaaagtttatgaattcaacacgaaaaatctgttatgattggagatcagagaggtatctcataattttgctgtcataatcttccaagtcagaggaattgagatctgcatggcctttgaaggaactaggttgataagctagatttgagaacttttcctccctgtgaagtcaatgagggaaggaaactcactcctattcaggtctctgttgtcattgctttgcatagtacttggaacataataacagatcaacatgtattttgagtgcattatgaatgaagacaaacatgagataaaatcaaaaggcttagcacatattgattctgagtgtaaaagagaaagaaagacctaaaaacaaagagctgttcaagccctgtttctggtaagaatagagtttcaataaagaatcaggaaagtcacagccacaccgtgtgaattatgagccaatcactgctcagctgtttgcgatgcctttgggtatagttggaagacgataaaagttactctaaatatgtgcttgctgcctctgtttttgccatttacaaatactcagagacagaaaaatagatgaatctgattattttttctaaaggagaacatgagatactctgtaccaaattcaaataaaaaatgagtgctttgagattgcatgattaaatagaataacaacatccctggcaaacgtgattaagggagaagattatagaagcatgtgagaaatggaaagtgttattaaaaatatgtcagcttttggtatatcatccctaaccctttcagaagatccattattatgccaacaaatttcgtgtaagaataatgatagtgacatttactgaagaactacaaacaatataactttccattttaatgtttcatatttctcatgtttatctaagactcagaaaggttttaggtttgtattcaaattcaaggtgtttttattcacttctttttaaaattagtaaatattttattttggcatctgcataaagtctgaaattttatgaaatgttctgaaaatgaataggcagtaagttttaatgggctgtagctttttaagctgtttttgtggctgattaaatttataaggttttatttcatatctatatagatttcttataactattggctttccaaaaactaaattatcaggcaaaaaattaaggtataattcagttttctttcatcgggatggttcaactgagctttttagagaggtagagagtacattcgtatgacagttgacctcctaaatatttcatcctgaaaattccattactaagattctctgggaatctctgggaattctctgggaatgcttttgtttaagacataaaatatacatacctggtgttatgatatgaatgcctgtgttcccatgaaatgaatacattgaaatcctagctccaatgaaggattaggaggtggagccttttgaaaggtgattaggcaatgaaggcaaaaccctcatgggtgagattaatcccctcataaaagagaccccagggagctcttttgtttttttgaccaggtgagagtacagctagaaggtatcatctatgagccagaaagcagccctcaccagatatcgaatctgcctgtattttttattggacttcccagccttcagtactgtgagaaataaatttcaattgtttatcagccacacagtctaaggtgttttgctatagcagccaaaaggaactgaaacatttagttatatatatcatcaatttggtaattatttgcaaactgttgaggttttctcaaatgtttatttggctagtctgcattgtatttccaagaattaccctttctgtgtgtttctggttacagtgggccacaggagatattcttctgggacagttcaagtgtcaaagtgaagcagcagcttttttgtagctcacatatacatttgctttcatgcctgcaactttctgtctttccctggatcctctgtcagcttctttgattcctgggccaggtgtgcacagaactttgtgccataacaaagagacctggtgctgtaaggcaccaggacatgaagattgttcacagcaaaaattggcactggcttcagccttccctgaggacttcagctcttgcttgacgggtatagatggttcttgttctctttggctttctatgcatagttccctcccaatggccacaggatacccgtggactttaagcactagtatcagactagaagaaaagagccatgaaccttgatttgtatcatgtacatgtgtacgatgtatcatttatatcatacaacttgtaattctacactttctttttttatagacagagtctttctctgttgcccaggctggagaacagtggcacaatcatagctcatggtaacctcaaactcctgggattaagcaatcctcctgcctcagcctcctaagtagctgtgactgcaggtgtgtgccaccatgcctggatacttaaaaaaaaaaaaaaaaattctagagacagagtctcgctatattacccaggctggtctagaactcctggcctcaagcagtcctcccatgtcagccacccaaagtgctgggattacaagcacgagcatatttttaaatattagtgtttattcaaattttttataattacaaataagaaatagttatctgaaattgtcttgggagaatgatgaaatttgaatcaacatggtaaatggttaggatgctgatgtttagaacagttttaagatatttttaacaaatcttaggatgttatattataagggctttgagggaaataaaagcagccttcagaatacaattgtgaagtttcatactaagagcctcatacaaacacttaatccaaaatggttcaaaatgttttgaaaaacacaagttctgacagaagtctgcacaaaatccacatactttgtcattccttcatttgacacattgatgtggcatctataacctgtgccaggcactgttctaggtctcgggttatataaataaccaaaagagaaaaataattctgccctcttgagcttatactcaggaaagaaataaaacatatgataactgcaatagtaagatgctgtgtgtaggttaagtcattttaagcattatgaataaaattgaaagttgttcggtgtcatgggtattggaaggattggaagcactaaataggagcagatgcatgatgcagtttcaaacagaatgatcagtgtaggcctcctggggctggcatttaaacaacaatttaaagaaagagataagagggttaacaatggtggtgacgaatatcttaaattctgggaataatcatgccaaggtcctaaaatgagttttggactggtatgtttggtaaggaaggaagcatgtttgactgaagccaaagagggagaagagtgatgagagaaaagtcagatatttaatggaggatgtcctggaatggcagtatgaaaagacttaggaatcatcttatttatttagaccctttttgattcatttcatcaaaactttacagttttttacatatagattgtgcacctacttaattaaatatttatctaattatttccttttttggttctatttcaaatttcaattgttaaatgctggtatataagagcacaactgaattttgtgtgtcagtttttgttgttgttgttgttgttgcttttgagatggagtctcgctctgttacccaggctggagtgcaatggcgagatcttggctcactgcaccctcgcctcccaggttcaagcgattctcccacctcagcccccctagtagctgggattacagatgcaggccaccatgccaggctaatttttgtgtttttagtagagacagggtttcaccatgttggccaggctggtctcaaactcctgacctcaagtgatccactcacctacgcttcccaaagtgctgggattgcaggtgtgagccacagcacccggcaatatataaatcatgtaccctgcaaccctcttataattacttataagagtattttttgtctattattgggattttttacatatataattatactatctgtggaaaaataaaaaaaaagtttttacatttcttttcaatttgtatattttaaaatttccttttcttgacttattgcattagatgagacttccagtacaatggctaatagcagtggggagagaggacattcttcccttcttccccatcttaggataaagacacctcatctctctgactcgtgaagtatgatgttagttgtaggtacttttggagatgctctttattaaattgaagaaatctctctatattcctaatttgctgaaaggttttaatcattgatgggtgttattttctcaaccaaatttctgcatgtattgatatgatcatacgattttatctttagcttgctgatgtgattgattgattacataattgattttctagtgttgaactagcgtcaaatatgtgggataaattccactcggtagtactatgtaattcttttgattatttcgattacaattctataatcctgttgaatttgatttgccaatatttttgaagacttctcacctatatttataaattatgctgcagttttccttttttttataattctttatctggttttggcattacggtaatgctggccttctagagtgaattagacttctatattttggaagggattttaaagaattggtgacttttcttccttgactatatagtagattttactagtgaaatcatccaggtctggtattttaaaaaattattagttattgatttattttcttaaatgaatcaacactctaatagtgtttgtcttttaattgatatttagacaactgatatttaaagtgattacttatatagttagattacctacaatatgtgtaattgtttttatttgttatatttgttctttgttattttttaaatctttgtcttttttctgccttctctgatgttagtgaatatcttattacatgatatttcttttcctcttctagcatattagtttatatctttaaaaaatatttttgtgtttcttctagagtttgcaatacgcatttacagtaatctaagtccggcttcaaataacattataacacttcacaagtagtgcaggtaacttaaacccctgtgtaaaacatgaggtgatttttctctattcttcaccattagaaattgcggtgctggaggtagaacccatgaatttgtggagctcctaccccacctaagtccgggcccccaggcacctttaccttcaagcttcaccacattcagcccccagcaattcattagttactgtggaaattttcctgcaagatatggactccagcgactactgctctaagttgatcttgactgtaagattccctgcatttgcttgtcttttcagattttagggtggcattttgccccatgaccaccattcttacttggatctaagaaaagataacttgtttctctttgctctggtttctcttgaggaggatggagtgatgctttcagatccccagtgctgaaatcagaagtcctccaactaacaaatatttaatgtgtttatttggtaaccaatgtctattttattttttaacttattttacttctgctaaattttgaatctctacatattttatttcaatatataacaatacctacgtaccagagacatctagaagcataactcatttaaagagcaagaactagggagacagctgtgatttgccacagtacaggcccacggcattctgcttgtttgttaattggtagatgatggaacagttcagtgagtcattgccacactacagacctacaagctctcaacactcacaactgtgatacagctagaaaatgttcttagcagtatgctgtgacttattctaaattcgtcatcagcattcaacttaggttttagcacacatatatgtgcaagtaaattttatatatatatatatatatatatatatatatatataaatcatatattaactaactaaacaaaaaaatacaggttcttgtactttaatcttccttttgtaatatacctagaaggcaatgattttaacattctggaaggaaactgtcattgcttttttcctcttcattttttgtaaattaaaagcaccaggactcatttgggcaagacactgattaaaccctaagcctaaatctatgttgagtttttaatcatttcatgctatggaataaatgtaacaagcactggtgtattcatctgcctctctacctgaagtattaaatatcaaaaataacatttttatacataaagctctagaatatacaaattattctaaattaaaataagtttgtcttagccaggaaacacagtgagacctcacctgtataaaaaagtaaaaaattagttgagcatggtggtgcattctttttttcttttcttttttttgagatggagtcttgctccgttgcccaggctggagtgtagtggcatgatcttggctcactgcaagctccgcctcccaccattctcctgcctcagcctcccaagtagctgagactacaggcacccaccaccacgcctggctaattttttgatttgtagtagagatagggtttcactgaattagccaggatggtctcgatctcctgaccttatgatccacctgcctcggcctcccagagtgctgggattacaggcgtgagccacagcacctggccaaagtggtgcatttttgtagttccagctactcgggagcctgagatggaagactctcttgaacttaggaaatcaaggatacagtgagctatgattgcacctttgcactcccgcttaggcaactgagcaagaccctgccaaaaaaaaaaaaaaaaaaaatgagtttgtctttcacagaacatctaaactggaaacacattataataatataatgaataaatctaattatggtttaatattcttttatactcaattaactactgtggctttattagattacagaaactttttcagacacagacaaattatatgtatttttgaaatatttggtaaatcattaaatgaaataatttcttatcgaaagtaagggagacctatgtgatttcaatctattttgaacagagttgaaaataatactatttggctgatagttgttataaaatggaatccaaagcaacattaaacaattgtgtgatatgatcttacattggtataaatagatattcattctttgtgcagaggtgtaggtattctacaaacttttcccaagctccatttccaagttgtatacttaatgcatcaaaaaatcataaccttttctgagatattattctcttctgtcttattaggaagacacctaatcaggatttgtataaattaagtttttattaattttatttacatgtactcattattttaattaattataccgtattaattttatcgatggttatgaaaggtacctaatcaggatttacattaactaggaagagcacgctggctcacacctgtaatcccagcactttgggaagcctaggcaagtggatcacttgaggtcaggagtttcaggccagcctggacaacatggtgaaacccagctgtactaaaaatacaaaaattagccatgcttggtggcgtatgcctgtaatctcagctgctaaggaggctgaggtgggagaatcacttgaacccaggaggcagaggttgcaatgagccaagatcgcaccattgcactctagtctggccacagagtgagactccatctcaaaaagaaaaagaaaaaaaaggacttatattaattaataaaaattaattccatgaatttttctttctctataattttaaggaaaggtgtaattttctctcattgttgaatataatatttttcaaagacaaagagttgcttagttatttataggtctttaatccttgtaactgcagagattgttttcaactggctttgtactttatgtctgtctgttggctttggccttgttctttctgcctcagtaaaagtataataatgatgcctgcctaattgaaatggaaatctcttcagaaatccctgtgattgaatttattgtgaatcataaacaaggactctttatgacatacaaaactttgcatatggattcatagttaaatgtttaggctgttataggtggcttatttatcaaatttagtgaccccttttagtattctctcaatcatatgtttaggggaaatataaatggaccctaaatcagtaatctcaaacatgaactaaaggagtctatatgaaaaaatgctaaaaaaaaatttggaaaaatgtagaatttttttaaaccttaaattgaatcaagtacagttacatatctaaagaaacaaacatcagacatctttcaattagccacagtgtttcagataaggccaatatttatacctttaacttaacttaaaaaattcatgtctaagagagcagtttacagttattagactggcatttactgctatataaatttcagaaatgtttataacattatcgaagtcctttgagggatcattttgatattgtcattgttacaaagttatagaaataaaggctaacacagttcacatcataatttagaagaagatgagtacaagatacgagagtatgctttcaaatattttctcacatctattctttatgcaatcaattaatgaatatttatcaaaagcttaaatgatgcataaaaaatgcagaaaaccatggtcgacacctaaataatttacaatctaattgagaaaaataagttgatttcacttatgaagcatgggtatttgacaaaagcaataagagtattggtaaatccaaaaaaatgctcataagaaatcaataaacatgtggaaaatggccttgagaaaactcttttaaagatgtttttgatttttggttcttgcttcttggtactaaatgaaaaacaaaatctgagtaaagcattatgaaaatttgaattaatatatttgaatatcatcttgattaactttaccagtgtgtttgtatagttattaattgtataacagactgaataagtagaacaaagttttttcaactaaggctatcttgtcattataatcattttatgaaatacatttatcatatatgtgtttatgtgcatttttaaagtatatcatgtaaatttaaaaaaatatttgtttctctgccctttttgagttactagttgggacagatgcttgtatcaaaaaatagattaacaagagaaaatcaaacaagtttattaaaatgtgtatatcatgcatacaagagagatgacccagataaattactatattgccagagtagatctcaaagaggtcactttgactttgggattaagtaccatcccttgctgaaacaaagaaagaagggtatgaggaaagggtaattattgggaaatagccaggaaaagtacagtgaaaaagaacaaagtctgttatgtggacttcaatcaatgccttccccactgataacacattttagagatgtagtcatccttctcttcctggagcagagagggagacacccttacaaatggatatttccttatagatgtaaacttctcttacaaaagggtaacttctactctgttttcaaagcttctcccttgtctgatgtttctcaaaatagtttgttccaaattatttatatatactaaagagacatatttggggtagcatattctggcctcctacagtcatattttggctggtgagtgataggcgtgagccctctcatttttccatttgaaaattctgccagaagtttcacagtccaggacatgagttggtggattatctcataatttgttgaagaggcatttctatggaaataaaagaaaaacaaatgttaatagttagagcaaagtaaaaaccaatttctgcatttggaggacagtcagttgaaaaaatttctagatgtgggttgggcttaaaacatcttttgcaatttaaatgtctcaatgttccagtgaactttctgaatgacctacatagctgtaaacaaaaacagaattaaactctgtaaaatatttaaagaggtttattctgagccaagtaagtgaccatggcccaaggcatagtctcaagaagttataaattggttttgtatgttttagggagacagaagacatcaatcaatatatatgaggtacacaagcgttcagtctgaaaaggtgggacaacttgaagagggggtgcttataagtcataggtggatacaaggattttctgactggcaattggttgaaagagttaagttattatctaaagacctgaaatcagtagaaaggagtgtctcagttaatataaggggttgtggagataaattgtagatgaagtctcataggtggccacctttagagataacagatggcaaatttttcctgtctgacctttaacaggtgctagactcttgctaatccattcaggataagaaaaggacttaaggcccagcaaggtggctcacgcctgtaatcccagcactctgggaggccgaggcgggtggatcatgaggtcaggagatcgagaccatcctggctaacatggtgaaacccagtctcaaaaaaaaaaaaaaaaaaaaagaaagaaagaaagaaaaataaaaggacctagaaaagggacgaggattctctacagaattttaatttccccattagaagacagaactgcaagactatttcaaaatatgtcaaagaaatatgttttggggtaaaacctcctacatgttatgtggtgctacactagagtcaggttggaatttggtatcctactgcaacaaagagtctgttttgtcagtcttaagatctctgttttaatgttaatgctggtcagttgtgcctgaacaccaaagggaggagagtacagtgaggcctgtctaaccctcacttcccatcatggcctgagctaacgtttcaggtttctttggaatccccttggttcataggggggttcattcagttagtaggaggacttagaattatatttttggtttacataacaatacattcaagtctatccacacatgagctgttgtagcgatttctctgaagtttttatcaatctcttcaccttcagcttgcagggcttcaggaaaaagacagttttgtttttagtgatttgaagtcagaagagtgagagcaaatgagaaatgctagtttggaaagtcatagtgagatattggagaaaaactggaagaattccgaatccagtttactttatggataggtaacagtagttcaaggacaatgaaaaggactagaatctaataggtatactataatttttctctctacattcacctccatttttaccaaaaataatcatagtaacattggtttctttgcaaattaaaagtagtctcactaaacttcgagtatttatataagtgagcaagagtagcaattgaacgtataggatctgttaaagtccactttgctggaacttatgagatatagcaaatacaagttttaaaccctcttaagtttagaaagccaagccaaggaattgacattggacttcatctacaatacttattgacagagcaggagcatcgccatcttggacaagcactgccattttaaagttcaccttgatcaaaaactgcccaaatccaaagggcatcagcctaatggctaaggtcagcctgaccataaacgacaaataacatctctgaccagaaacagtctaaccataagataaaccccttccccaaccagagacataccagctcccctctggccagagaaatgtcagccccaagataacctcccctccaaccggagacattccaaccccacagtaaacttctccctcacacagaaaatttctgagcctgtaataagctctctcaccctaaaaccaataaatactgtcagtttgtaagagagagtgctcatgacaaaaatcggccagaagcccctctcacgtttattctccaaaataaacatgtctttcactgttgagccatttttcatgtttctttcttctttctttaactcttacacctatagatatgggtaaattccttacctgaaagttactcaacaaatttactcaatttataaggccaggaaaactttttagccaggtgctagaccatgtttttcccccaagggtctctgttagctatataaagtcaaccttatttccttaaaactgtctgccccgtccctactgaaaatacaaaaaaaaattagtcaggcatggtggcacacgcttgtagtcccagctactctggaggctgaggcaggagaatcacttgaacccaggaggcggaggttgcagtgagctgagatcgtgccactgcactccagcctgggtgacagaagagactctgtccatctcaaaaaaaaaggaaaaataaataaataaataaaagctgtctgacaatatctgtttctatgtacattcctagtatgacattccatccaatccttggtaatgcaaccaatgttaccaattgtgtcctgttacaaagagaacagattattattgaactcatgcaaataaccatattgccatgaaaataaaagtattcactaagagtttctaaattctggatgaattgggtagtaaacaaatggtaaatgcttcaacaatcgtttttacaaatgtgtattttaccgtattgctccaagctgtagtttaaggaaaaagaaagggaaaaatgtttccttgaagccaaaaaataaaacattaagtaatcaacagtgtttgaaacaaaaaagcgacaaaaattacaatcatcctcatcagttatttcagtctcatataattaatttctgttgtgcttaatcttgggttagcaattttatgaatcctgcttttccatgagagttcaggaaattcttacctagttcaacgggatggttttaaagttatcagaaacatgtaattgttagtcttttccaagaatttccttaaagacaaagcacatttgtattatagttgctcacaaaatatttcaggaaagaatcagagaaaaatgattgtctgcagatggcaaaagattttacatggccattgttgaaggtctgatgaatgtacattataatgcaattgacactcatcagtataggaaatataggaatatggaacaaaactgatttttgtgtaaattcacattttattttatatccgtcaattccagcatcctttagtattagttctccatttatatattttcagtgctcaccctatttacttttaaaagtttctcattcctgagaagttcatcttgaatcaactcttaactgagtacattacctggccaaatcatttcttcaaaagggcacatagttctgtatttcccaagctgttctggttgagaaagttgtggttttcttgatgtaggcataatatgatactctgggatcacacattattttgtttttaatcaactttatattttataagattttcagatttgtggaaaaacttaaaatatattatggagaatttctaaatgcccctgcacacagtatcgtttatgattaacatagtatatgaatatggtgcacttgttaaaattactataaattgttggtacattagtataaagtagagtgcatacttattcagatttcagattttaacttaatgttcttgtcccagtccacgatgccttccaggataacacatagtatttattcatcttgtctgtaacggtgtcacagacattctttggttttgatgaccttaacatttgaggaatactgaccaggaattttgcttttattgttttattagaatttgttagatgtttttcttatgaatagataaacatattcttatgaaatgataaacattttctattcttatgaatagaaaaacataagatgtttttcttatgaatagattgagattatagatttttcttatgaatagattgagattataaatttcagagagcaagatcacagaggtaaattaccattttcatcccatcatctcaagcagacataccctgaacatgccccatcattgttgaggctcatgatgcatctctactgtcttatttcattgttcaaatgttctgactttggccattggttgtcctttcagatgggtcctttaacatccacctgtcaatgtgtgctttggttttgctgttgttgttactgtttttaagcacttccttacttcctggaaccacaaaatgctccaatttcatcttgcatatttcctgtcctctgaaatcagccatttctccaaggagtcattgttctttttacaggaaaatgggtataagcttcttgatcatttgctacttggtgttatttcattgtggctcactgacagagtaaagaacataaatgtatttattaccactgaactgtacactaaaagatggtaaagatgttaattacatatatacttatttatatctatctagatatattatctcaataaaaataaactctcctatatccttaaaaaaggaaatatatgtgtatatattcacatttttgcaaaaagcaacttatcaatgtttattttttttacttttaaaagtatttgtttgcttggaaatgttattttgagcctcagtgtattccttcagatgggcaagttctcctttcatttcattctgttttttattatttcatttgtgtgcttttattacattgaattaagaagtagatgagaaggtatctagaagataaagaacagcaaatgtttctctccaggcacccttggtctatgcaatcttacttatttcatgacacttcctagtccagtttcaggccagccgccctacctctcagaacatttgtcatttttctcactatcaccattgctaagctcaacagcagccaatcctgtatctgcccatatccacacactgccaatggtttcctactacactattttctcctcactaattaagaattaaatacattatttgctaggaccaatcagcaagtatatggtgttttgttttgtgtgctctaggtatgatgttagagccatgatcatgcaactgcactccagcctgtgagacagagtgagacacggtcttaagaaataaaaaggaaaaattattgtggtaacaaaaaagagcaactcctttgtaggaaatacaaacaaaagagggtatcttctttcttaggaaatacacacttaaaatttgaaagtaagctgcatatatcatgcaccaacctctctcatctcattatttctgtcattcatgtctgtttatccatccatccattcatttttatatatgcacagataaatgactaaattgagttcatcaataaaaatggcgacttctggacagaaataacaggtaatttaaaactttttctccaatggaatttacaaaaaccataagggcgtcattcttttttaaaatgtattatatccaacaataaaacaatatatttccaaaaaaaaaaaaacaaaggtgcttattaacgtgacaatgaacaatataattatagcaagtataaaacattttcctcagtaacttgagttatgttgttttctaagtaaatttgtttcatcaataacatgctactttatttctttttctatttcaatattatgttttcacaattgccattttgtttttacctcacacttgaacccttctattctaccatttattttattctaacattatatacacatgttttggcgttttttctcactatatgtataacttctctttttcctatatgaccattctgttctgttttctgttctatccatttttatgtgtgccttatgattgaggtgagggcagtagtgttcagagaatgggaaaatctgagcagaggagaccaacaaaaagcataccctctttgctagaatggcagatctttacttgccttctcatgatgtattctctaactgctttctactgctgtttgtttcaacctatgtgggggctgtatctgtcccaatgtgacaaacacctgggttttgaatgtgttttctttgcctgaagtcagtgtatgctacaagtgtgctctagtctgcagtcacttgtgccatttatgatccctgattcactcatttctccccaccagtcacttcgtttctacttctatccaaatggggaaacataatgatagtaaccacatttttctcttgatatttgtattaggaggaattccacaaattgttaccacatacctgtgtggcttcaccattgtgaaggaagaatgaagacctaagctgagccgggttgtcggcttcaacccaacattattgtcgttgttgttgtttcctcttccttaatagttttaaatgttaattgcactatgttaaaattctgttgtctgggttaaggttggggaatttgttgctgtgttttataaatttttgttaagttcataattggtgaagaaatactgcgatgcaggtttaacctgttatttcaatacagaaggcaccagaatatttttcaagccatacattgaggcttctgccccatgactcagctgaagcagctctgattgaggtcatcagtgccttcattaccagtcctgttgcttgttttagacctaattttaccatattgcactccagtacctagcatcattaatttctttttctgtctaaaaattattttttcctttcttatcaatggccttgttctctccttgccatgtgctgaccaacctgactgttactccagtcctatttgcttgtcttttttcctttgactcctaataaaatactgggttcccctagagaaccatccttatcctggctttctttctctccctgagctattacgtccatctgtatgttttcaacatctaactttttacttactgccccaaccataaatcaggttaagctctatctctcaaaatctaggcctactgaatacttactagtgaaacttaccaaaagctgtagttgtcatatttttcttccaatgttgttcttctcctagttcccttgtctttatgaataaaaacactcagatgagcagtctgaaagttaacgtcgttgccatctggcccttgattcctgagctttcatgcaaagttatgcaagtcactgactgcaaaacagcaccaggccaggggactgtctgaggctcaggtttcccaacaagcacaaaggtgccctggggtcaagcagcagaccatccccacttacaaaatgatgcccaaatcctttagcagtagcctgaattgcagttctgtggtcggttatctcctttctgcttcagtcatagtttaggagctcttcctcttatacccaacctgtcttcctgcttccacaattaccaccactggatccatcttccacattgtctgagcaatgattttaatccatactcctgagtaggctctctaccagttcacttgctccccaagaaccctcataactcatctatctcctcatggtagactctggtgacaacattccataccatgttttaaaaaaatactttatacaactttacttatgctcacggcattcccagtatttactgtgtcctttccacccctctgtgtccatccagctcatcatattgtgttttccaggctcattgcaaacgtcatctctatgaagcaattctgactttctgctattcctctgtttctcccttgctcccctccaaatatggcatttatattatagacctttggggactgtaagttatttacaaaaataccaggatgcactcacttattcatatttgtatttctagtattgagaaaaatgcctgctccatacattagtacaggggagaatggcattgattgaggaagcaattgttattagttctgaataagcacgcttaaaaaaataatttggtcttctcaaaaggattaagattgcacacatctacaactctcatattttttaaatacaaagatttccctccatatttttaattgttttacaaaaagagaaatacaactaacctactcaagtaacaaaaaaaaattaaatatttctaaatggcaggacgttgatttactggtctaattggtttatttgttctagagaatgtgtaatgtaatgtaaattatttccctgtaggtaaagacatctactatattgagaaattccacctattttatactgcctgtgagagcagaaatagcctttgcttgtcattttttaaatttactgacaaacccagcactctactcttgccgacattagatgaacaatgaattaaacagcttacttttgacaactcaactctctgaggacatgcagactcagaaacatcaaagatttcatgggatcagttttgtgtgtagagctatgaaatgtgttgattaaggtcatctggaaaaaaaaaggataggataaacagaatgatttttagttatatgattaaaggatgttgacatgtgaggctatttttgtcatttcagaggttaatgtacttaaagctttattcttactccacctaggaattgcatgttataggttgctagcattaattttcagtgtctcttctccttaaaataaacactacaattttatccttttcttggtgaaggcacagagctgtgtcctaaggttaaatgtgtttactaggaaaaatattaattccaaaaatattatttccaaatattagttccatttagttccaacatgtgaccagtttaaccaagaggaatttgattctgttgcaacatgttttacattttgctttgcaaagttcctctaagaggagcaaaatggtaatgttcaacctttagacttaagataaatagtatataataagcctgggtagaagactactatataaatatttcaatccttggttgtatgcggtatggaaaacacagtaacataaaattcactaatctgctatgtaatgtttatgtggatccagatgaagctgtgtcttcactagataatttatcaagtttactgatcttacagtatcatttactaagttatcaccgaatagaatgcacagacttaggacaaatctccagggtgcaactgcatcagtgcccatgattcttttgtagcacaatcatgcataacagcctcagaaagtggaagcgtggggtcagtgactgaagttgtacttcctcttgcttataccttagttatagtgagacagtgctgtgcaccattaaagagtttgcacacatcattgtatcactaacaccattgaagttcttgcatttttaattattcatacttaaagaaatattacagaatcctgagccgtttccacaaatgtagaagctagaatgtaaatgacactggactggaaattttgtctgttttgcgctttgctgtattcccagtgcctacaataaggactgatatcataaatgaacaaataataaatgtattattatttatgctcagcaaacagttttgaaatgaatattgaaagagaggagaagtcagatgtgtttgctggtggttacagtcaggattggtaccaggaaaaactgcagagttgcttaaggtcctccaccttcctttgggatgtctgtttttccccttttatagcaagggaatgcacggaatgtacacatagtaggctttggattccgcagaatgtcatcacagaatttgattgggcatctgttgaagaacatgaggaatgggttcctactgagtattgcaggggataggggtacaattacgttattttcaacttgaaggattcttcagttccttcagtgccagcaggattcctggatgactgctatccagttttatcttccaggaaccatagctctctatcccacacagggctggggtctctttcagaaacattccttcagcctcatgtttctcagaccctcttctgtacctaggttcctccaaatcctgcctattttaggtatctggagttaatgtaaaaaacaagccacttgatgtgcttcgtgagtcattacattatttctccctaagatactcaatacaactctataaaaaatggcttagctacaatttcagaatgccatttgcaatgcctaaaggtccttgaaagaggattctttcttctttttaatctcaagaatcgtagggtgaataatgccatttttcactgctgtgttctctacagaatgtgaggcctttgccgggaaacatcactgtttaggttcctggggtttaaggaaagtccagtctttggcaaatacctaatacttttagtttgcagtttccgaagagttttaggtttttccagttgtaatatccttgattcctaaatatagtcattagtatagcacatatattactttattgtccttatttatttacatttgcttattcctattcattcttcttgaggacaaaatctagtcagttatcatattaataataactgtactcatttaaacatttttaaattttttgggatttatttattttgttttgttttgctttttttgagacagggtctctgtttgtcccccaggctggagtgcaatggcgtgatctcagggctcactgcagccttgacttcccaggttcaagcaattctgcttcagccccccaagtagctgggactacaagtgcacactaacacacctggctaattttggtattctttataaagatgaggttttgccatgttacccaggctggtctcgatctcctgaactcaagcgatgcctatctcggcctcccaaagtgctgggactgcagacattgaccaccctatacatttatgtatttattcattcttgcatatgtggatttcattaaagtaataatcagtgagcatttgcagtgcaatcttgtcggccttgaagtttcagcagagaacaaaagacataaggtctctcctcaaacatcttgcctattcgaaagagacagacttatgtgtttatatataagagagagagacagacatatgtgtgtgtgtgtgtgtgtgtgtgtgtagaatgcaatgtcagataatgaaaaggactgtgaagaaaaacaaaacagggtagaaggaaagagtgtgaggtactatttttttaaagagtgatagggaaaacttctccaaggagggttatttgagcaaagacctgaatcaagtggggtaactattctgggaaaaactttttcaggtggaggaaaaagcttgtgcacgtgccatgtaatggaaaccttcatagtgtgtttgaaggccagtgacataataaatgagacagccaggtaagaaatgacctcaggaaagttgcagggctagatcgaggaagactttctaggatgtactagggatttggaattttattgtttgtatgatagagaatcaatgcaggctttgaaaaggagtaatatgataaaatgactgtctttaaaaaattactctggcaactgagtgaagaataggctacaagaaagaaaatgagatcgtagagaccaattggaggggtgacatagcaatctgactgttgcttgtgtcctagaccaaggtgtcatgaataaagctaagtagaaggcatagttaggatacaattttaagacagaaaagaccggacatgttgatggatctgatctatgtgagagaaagggagacatcaagatgctctccgttgttttggagtgtccaatggtagaggcatttattgaaatggagggaagttcatggtaggaagcagaatgaggaaaggtgtgtgtgtgtgtgtgtgctctaatgtttggtttgaaatgtctatgacacatacatgtataatgaagtagtcagtgggtttgaatctggaattcagggaataggttaatcctacagctgaaaatacggtatccatcagtatatagagacagcatttaaaaccatggggctggatgacatgtcagagagtcatgtggacagaagtgcagagggaggaaacaagccagatgagtaaggaagacagggtgttccaggttggtgcaacatttaactgtagttgagagcataatctacttgaatccaggacaggtcagtttgggtaagatatggaaagaatgaagggtgtaatgtggtatgagccaaaaggagaaaccaggcaatatgttagaaaatggatggtcaatgatgctgcggtcctgaggaacaactgaaggattttcaactgggaaattactgacatattcagttattttttttaaatctctctgattgaagtgtgaagactggttcagaaaggaaaagaggagaggcagatagactgttcagaatacttatagaaatacctgtgagggatgactgtgtctggcgcccagatggtcactatggaaagagacaagcaaaggcatgtgaaagacaatgagaagatgtgggttaggtttctaggttgagtgcttggaagaggtattactgtcagttgagatgaagatgaccagggcatgggagaggctccgtgagtttaatgtgctccttgtgaaaggaatgttttgatatttggcaacagaactgggatgtatattttaatatttagttatccataacctacaggtggcatttaaaactaaaataatgaatgagctctctctgtaagtttataacataagaagagggagcaaggggcacctgaggaaaagcagtatgcaacagcattgaaggagaccctagcagaggaggtggagaaggaggatccaaggacctgagggaagacacagtgggttctggccttggaagtcaactaaaaagtgagagcttcatcacaggacccctcaggagggtccagaattgtgttcatacaaagtgtttccttggaacaacctgcgtgtagcctttggaattcattatagaattgggacatccaggttgtcttgtcacgtgattgtctgctagggttatcatagccgagtactaaacactgattggtttaaacaacagaaatttgtgtccctgtgattctgaaggctagaagtccaagaccaaagtgttggcagggttggttcctcctgaggcctctctccttgcttgaagattgtcatctcctacctatgtcttcacatggttttccttctacgtgtctgtgtcctaatctcttcttatatagaaccagtcatattggattagggcccaccttagtaggcttctttttttttttttctttttttttttagactgagtcttgctctgccacccaggctggagtgcagtggcatgatctcagctcactgcaacctctgcctcctgggttcaagagattctcatgcctcagcctcccgagtggctgggattacaggcatgcaccaaaacgcccagctaatttttgtaattttagtagagatggggtttcaccattttggtcagtttggtcttgaactcctgacctgaagcgatccacctgcctcggcctcccaaagtgctgggattacaggcgtgagccactgtgccctgcagtaagctccttttaacttaattacctctttaaagaccttatctccaaacacagtcatatctgtagtacaggggttaagatttcagtatataaaactgtgtagtatacaattcagcccatagcacttagaccacacaaatcctacatttatgggagctgtgacttgaaaaaaaataaaaatatcttcagaaataattcaatatttgacatcatataacttttgctatctctagagaaaaacaatttatgctgtgacattactggaaagaacgtcttatcaagaaaaaattatgacctaaacaatgatgataaattaatttacgatctgttattaggaaatgtggaagattgaatcaagttgtgcaaataggtacacatgtctactttctcttctatcaaaactgtagaaaataataaaataaaaataatcaaataaatacacagaataaaaaagttaagataacctaatattattacacttaagattaagtaattcctaaaactgcgacaagtaaaaatgtcaaatagaccagtaagaacctctatatcaatttaattctgaatgtgtagttctaatccacattaaatagctacaagaagcaaaaaaggctcaggagtcatccaacagcttcaaagtattcttaagctttctatgccttttaaagagaaacagaactataggacatgtgtatatattaagagagatctattttaaggaattggttcatataattatggatactggcaagccccaaaatttgcagttgaagttcaaagaccatcaggctagagacctgggaaacagctgatgttgcacttcaagttcaaaggttgcatgctggcagaattcctatttatgaggcaggaggaaaagaaggagtcagtctttagttctttagttctagtgaggccttcaacagattgagtgaggcccacccatgttatggcaaatctgctttccccagagtccacagatttaaaagttagtctcatcaaaaacacttgcataaaaatattcaaaattacattccaccaagtatctgagagccatggctcagccaaattgacaataaaattaagcatcataatactctacttctcctctacattttcttatcagtgccagcaggaaaaattagtaaggaggtcagtggagcagatgtgcaggtgagtggttcagatggccactgtcctgccaatggctcaccagagccggacaacgagcactaaaaaaactccatccaacaccacatcacatctctctctcagtcaacagatacaggctgaagtcaccagatcagttaggtaagtagaatattcaacagacaaaccactttgtacatagtatatacctatggaggtactgtagtctgagaaggaaacaatttaagacaatacctacctccaagacattttgcaaatttagggaagaaacaaagaaattaaaatcaaacctaaggacaaagtacattcttaaggatacgttttaaacaagaaataataatcatgttttctaataatgataatccaggtcactgtaaacagatagaactacaaataatggcaacgttgataggaggttgaacatagaaaatgcttttggttgccaaactccatcatctcaaacattcataatacttctatatctctacttattccagaaaaatccatatatgtctttaatcattttgaagtttaccttaaaggatatttttctcctttaaaaagataggtaaattatttctttgaaatacgattttttatccaaacagagcagtgtttcattgaacatattgcagctgctttgatttagtagtgagtttccagttgccatcacagatatgttgactggagtcacctgcattgtcaagtcatagtttcttctttgtgccataagttaaaaagagatagacatgactgccaaaggttgtttgcatgtaaacaaacaaccttccagaaatttaactattctcattgttttagttgttctttaactgccagagtcagcatttgcttggctattcaaatgacaatttaaggacaatttggaatctgccaagagtttgccaagatacatatgatgtgtactgaacatatcatgcatagaaaataaagtgctaaagacaaggatatctttggacaaaatgttcctcatttgagcctaatttcattctagaggcttcaacacctaatgattgataacaaaactcttaatgtaaaaaagtgcacctaaagcatttaaatcctatgatggcatttgagtgtgtgcatagctcattaatgtgatgctaggctgggactctatgttaaagtgtttaggaagatttttagattttaaaatatttaatattcaatttgtctttcagtagaccactcacagctccccaggagagatggagaacaccatgttctgcattttaatgagaaacactaggtaatggaaagactgtgttgcaggctacaattgaaaaaacaaaacagtgaaagacagtgtggtgattcctcaaggatatagaaccagaaatactatttgacccagcaatcccattactgggaatatacccaaaggaatataaattattctactataaagacacatgcacatatacttttattgcagcacaatttacaattgcaaagacttggaaccaacccaaatgcccattaatgatagactgtataaagaaaatgtggcacatatacaccatggaatactatgcagccataagaaagaatgagttcatgtcctttgcaatgacatggatgaagctggagaccatcattctcagcaagctaacacagaaactgaaaactaaacacctcatgttctcacccataagtgggagttgaaaatgaaaacacagggacacagggagggaacaacacacactggggcctgtcaggaggatggagggcaaggggagggaaagcattaggacaaatacctaatgtatgcagggcttaaaacctagatgacaagttgataagtgcagcgaaccaccatggcacatgtaaacctatgtaacaaacctgaatgttctgcacatgtatcccagaatttaagtaaaataaaaaataaaaagacagagaaagagaaagaaaaagcaaaacgaaaacaaaaaacagtttattccatgggcattacatcacatttgaggaaattagttatcctgcttattaagtagtaagcgcaagaagtactccctaaatatttgtcccacatagctcataaatccatctggagatttgttgttcatcagttcaactctagatttcttaaaaatggggtccaccttatccatccctaaatttgtagtttttggcacagattagaatacatggcagtgcccggtatattttcatggtctttaatttcatggacgtaaatattttgtggaattaattatttttcgaatgggaaacatttgaccaatgagtcatgattgcacatgacagtatggttgtcctccttatctgcagaagatacgttttacaaaccctagtggatgccagaaagcatagatagtatcaaatcccaaatatgttatgatttttcttatacatgcatgcctgtgatacaagttaaattaggcagaataagagattaccaacaatcataataaagtaggacaattataacaacatactatttacaatttcacagatagatggctcattcctaccatagatcttagcaaccccagcacacaattttttttcttttccttattgagtcaagaagtcacaacttttcacttggaagcactttatgggttgtctttggcatatctggcctctctacttttgcactttggggcattacacagtaaaataagggtgacttggacacaagcaatgtgatacttcaacagtccagatggcccctaagtgcctcagaggtggggaggctacacagtgtggagacgctggagaaaaggagtgttcacatcctgggcagaacagttggagattttgttatgctactcagaatggcatgcaacctaaaacctattcactgttatttctggagttttccattgaatattttcagattgtagttactgcaggtatctgaaaccaggaaaagcaaaaccagagagaagaggggattattgtggtgtggtagcaagagaactgagttgcaggaggaagatttggttgaaatatgtggcttttttttttttttacaacaatttggttcgtttatgaggacactattacatagagaaaaatagaagtaaaatattgtttttgttgtcaaaaacagggtaatgggggaaggaagaagacagaaacacattatgtcacaatcctgttgaaaagctaaaaaaaaaaatccatattaagggccgaatcatcttgtcactggccagctttacacctgctcatccctctccgcaagataaaggcctgatccaacggcaatgaaacttttcttatctcccagagatggacaaatgatcacatctcagattagatcctaggttttgtctccaaatatcaggaagagtagagtagttatctgcctaagtatttatatttcaagaagtaataatacctggaaatttggaaacatctctaggttggaaagattcagatacatgagactatttggcttctggagagtatatttatattccaatggggtggagttagggctcagattcatgatgtttccaaagatgcactctcaagaagagtgagggaagctgccttattccctttgtaagcagagaaaactcattttcttcaccccctgcccatgcaatgtacagctagttatgttggaaaaatttccctcagctctcatggcataagataaggatgaaggcaaggggctgatgcacttattatttactttgaagtaataagtggtctgtctctgatccagaacacttcatgtgtgcaatcaagatacatttaataaagatgaatattaaaaacctaacaagcttcaattcaattttattaccctttggatcagagaaacagaacaaatggccatagatctactccttattgtatgtgaagagtgaaatgtttctagaggaagtgacggcaaacatttcctatttttgtgctgtatacacttctgtgtttcaggctagggtttctagcatgagctctgagaaatacaagcaagtttacttcatggacactttattctttggttggtatttcatattccttcaaaattgatcttgtagcaacaaaatcaaccataagaaataataggaaggtttaattttttataaagtattgaagttcacgttgtttttaaatgcctttgtttgaaagtgaaatacatatattgaacttgaacactcaaaattcccatggaaacaaatcaaataaagtaattacaaagtaattgctaatgttaagtatgatcaaatttaagttgtctcttctaggaccagtttacaccttgatagttttagcatggcaggtgtagatttaagggtaccatgagaaagagaaataccaaaagttttccgaagagacagggttttgttggtcaaccaggctggaatgcagtgatgtgatcatagctcactgcagccttgaactcttggactcaaaataccctcctgtctcctctttctccttcttcaacttcaccttctcttcctcctcattattgttattgttgccattgttttagtgaaaaagaaagaagggggaaaaagacatcatatattgaacatgtatcataagaggggcattcaagtaaactctttggaatcttacaaagttttcaaatagtcttttggggaacaaagagacatcatagggtaatggaatcctaagttagtgccaaattgaaatatttgagtcacatgtgcaactttaagttttctaggaatcacattaaaaaagtaaaagaaattgatcaaattaattataatagtgttttaatttaactaaattgatccaaaatattgaaatttcagcttataatcaatatgaacattattagagagggattttacatttttgtactaaaccttgtctgtaccatatttatttttattgggatctccgttagaactagccctatttcaagggctcagtagatacgtgtcactaggagttgccatataggacagaataggcctatggagtaagatcttacgtctacaaccaacttgcctgttctttaacccatttactaaactttggtgatattacctaaatgctttcaactttatctttcatagcagtatctgatatagggtagttgtaaagactaaattaattcatatagaacagttagaccaaagcctgtcacatattttcaattattatagcacttataattgctgaataaatttatttttaaaacactttttttgagattagttttagtatctcattcacaaaagaggaactaaatgcagagaagtccaataatctgcccaagtttgctcagttagtagctaacttttgtcaaatttattgtaattttccctaatgcacttatcttttcgaccaaaagagtattacgaaacagttgtagtatgcaagcaccagtttgtatacttatttgtttgcatccttcatgaagacttttgttagttgttaattaaacacatgcacatacatatctacatagtatacatttttgtgtgtgtgaatacacaaattcgtttgattcatgttggactgtcccagagtcctggaagagggtttcctgaaaaacatatcttaaatctgtgcccagccaataagttttcaagattattcttggtttttctttgcagcatcaaaatataagaatgggaaaaaaagtatttcaaagtacttaagttaaaattggtattcttctaataaatttcaatagtttgaaatttcttcttttagtgatagattaagtaaagcaaataaatttttcccatggaagaaaaaattaaaaaacaggagactgattaaaaaaattctgatataatttttatcagtattcattgtttctctgtgtggattcaagttaccatctggtaccatttccttttagcctgaagtaattattttagcattggttgtaaagcaggtgctagcaacaaattttatctttctttatcttggaatgtatttaatttgcctgtattctgaaagatagttttgttagatatagacttttcagttgacgtttttattttcttttaacactttaaaaacatccttctgctgccttctgacttcattttagtaatgagtagtaagagagctatattgtggtccccttgactagaaggagtaatttttgccttgctgcttataggatgtttcctttgtctttttcaatagtttgaaaagcctgtgtagaattatctaggtgtgtgtttttgtatgtgcttatcctatttggagtttatggagctacctagatgtacaggataatatttttcatcaactgtggaaagtttttattcattatttttccattttcttccttcatcactctctcctgcctctgcatctcagactcacattacactcatgtcattatgcttgatggtgttctaatggactatggggcgctttatttttctttttacattgtgtgctttcaactgagtgatctttactgatttaactttaggttcactgattctctattctagcagctcatatatactataaccctatagcaaaaaatgttatttcaatatcatatttttgaattccagaatttcaacttcttttttatatgatgtctatctctttattgacattctatatttcataatttatcatcatcatactgtcatttaattctttaaaaatggtttattttagttcttcaaatatacttacaataattgatttggagtctttgtctagtaagttcaacagctgtaaattctcaggaacattgattactgacacctttctatttttaagcttatcttatttttttctggaaactggatattttatatactgttttatataatatattgttgcaattttagattctcacatcccctgggattgccatttttgttgtttttctgttcatttattttggtcattcatttttacataatttgtctatactagttctctagagctggtctgccctgaaacatgtatttattgaagtttctgctctgttttgtttttgtttttgttttctgtttttgttttttgttttttttttttgagacagagtctcgctctgttgcccaggctggagtgcagtggctcaatctcagttcactgcaacctccgcctcctggcttcaagccattctcctgcctcagcctcctaaatagctgggattacaaatgcctgccaccacgcccagctactttttgtacttttggtagagacagagtttcaccatgttggtcaggctggtctgctttttttattattcttattttttaagcatgctttccagggattacctgcttaaacatatattgagtgacactttgctgacagaccggtgtgtggattggggaacacatttaatgtggaagcagtttataggtctatccagcttttaatttctgcatgtgtaaggcatcctgccccactaagggttcagttagctgggccctttcctgttgcctattaggtgtgcagacttccagacaaccaacagcgttgtttcatcaatgttgtgacatcagctgtgatgtgtttccccgattatttgccactgggatcactataattttgacaatgctctggttaaaggtttttttttcatacttcactcagaatcaagactgccaccttctgtagtgagtctgccagtatccatgatcatccctccctggttaaactaccaagcaaaacaccataaactccaaatgttcttactgagatttagtgaattttcttgaataaatgacttttagtttattaatggatttaatttaaaaaggaatgaattactgtcattttaatgggagtatgttacatatcttgggtgtgaactcctgagaagcgattaagttttgcctccattttctctctgtctttcatactctcataaatgatgcctttcagcatgttataacataacacgggggccctcaccaaatgctgagcagatacaagcactctgcccttggatttccagtctccacagctgtgagccaaagaaacttcttttctttataaatcaccctatatgcttttggtcaatttctagtgttctgaaataattgcttttgacgattgtgtccagttttatcattgctgctgtagaaaagctttgctgagatgcttacttagcatttccagaataatgaatacaagtttgatggataaaataactaatgaatgtattcatatcaaaccatatgccaaaatgtcttaaaatttctcattttaaaaaacatttaaattaattatatagtaagcacataaacacatatttatgttactactttgaaaatctgtaaatacgttagtagcatttctatggtctctaagacgaggacttttttcacaatggactccctgattatttattaagttagttaattagatattaacctccttgattcaaatagttcttgtttataaaagtgactgacttttaatcacaacattaaattagtttctgagagtaagggtgtttttaaattatgattttagaatgtcctcagtacatatagcaaaattaatatgctaaaatttctcaatttattatttgaatgttagatagtaaataaaggtaataaatatattttatgacatattcatagatacttaatatacaatggaatatgcttaaaaataatataaaacttatgattaggcctcaaattattttgcattggaatacataaaaataaaactacctaacctatataatatgtataatttcatagaacatattacatcttctagaaataagaaatatgtatttgtagcattttcaaatagtaggtgaatttacaatgcatatgctttggtcttctgcaaaagtctttttggtcttttgtttttattattaaatatataatttttaaaaaacgatttgtatgtcttaatgttttagcttgtgagattcattttatgcctgattgtagaccctagaacatcctcttctgtgagctggacatggcaaatgtagtcatttcagagtcaagaattacaatttcaatattaacaactccatttgatgtttttattttattttttaactttaaaaaagaatcatattgaattgccaagctgctttcttctatttctgctacgtacagtagaatgctgcaaatcacacaatagttatgccaaaacagatatgtttgcactttgctttaaaatcccacactggctctgtgctattgtttcaatgtccactccaaaactcatgttgaaatttaattaccatatgatggaattaagaggtggggcctttaagaggcgattagaccctgagggttgtgccctcatgaatggattgatgtcattatcatgggagtgtgttgcatatcttgggtgtgagttccggagaagagaataggttttgcctctattttctgtctgtctctcccactttcatcatgtgatgccttggccctcaccaaatgctgagcatatgacagcactctgaccttggacttcccagcctccagagctgtgagccaaacaaacttcttttctttataaatcaccctgtttgtagcattctgttatagaagtagaaaatggacaaagacatctaatctccaccatgacattacagcttcttttgaattaataattttttggattaactataatactgcacattgtatcaactgatttttttctgtagttaaatagactgacacattaaaacaaagatagaaaagttaaaactaaagtggaggcaaagatatgacaggcaataccaaatagaaagaaagcaggggtcacaaacatgatatttgacaaaatacattacagaacaaaaaaaagtatttaaaaaaaactaaaaagtttattttatcctgctcccacccacttctagttcttgacttatatctttattgtctgagcagatagctttttcatactatactctgtctaatatagccatcatttcatgatgatccaccatcggatagaatttgtgtgaccactatttcttatgtcgcaatctctcttgtcattttggttatttgaaccttattctctgttagattcctcgagttgctcacaggaacttttatttttattttttatttcttttgtttttgagatggagactcactctctttttgcccatgctggagtgcaatggcatgatctcggctcactgcaacctccacctcccaggttcaagcgattctcctacctcagcctcccaggtagctgggattacaggtgcggaccactacagctggctaatttttgtattttttggagatggggtttcaccatgttggccaggctggtctcaaactcctgacctcaggtgctcacaggaacattttattgagctcttgtatgttgaaaggagttggtcatagtctttatatttctcacattgtctttttattagtatcttaagtatattactgcattttctcttggcataaactatagcaatgaaaaaaatctaaggacagtctaattttctttctcttatggtgtacctgctcaatttttgctcgggtgataaaacagtttttttaatgtttgtttttaaagtctggtattttttactagaatgtgtcttcttggtgttggtcatttggatttggtttttccaggtttgatgtattattcaaatacaaattttaagttttgtttacattttaatttgtggaaagttctgtggatgtttggtttgtttgtgcttatgtgtgtgtgtgtgtgtgtgtgtgtgtgtgtctgtatgtcttccattccattattttcccattattttggtttttactttgtttttgtattttttccaatgtggaatttcactatatatgtgttagatcactttgtctgttactttttttaataatacctttttatttagtttatctaaaaaattgatgtaagtaaaacatataaaccaaaaattactcataataaagtttaaggttcaatgaattggatgttgaataagtaatatctggattaagaaatctaaatttcagagtctcagtaacccagtagctccaatttacatttatccaatcaccaacattgccaaaagttatacagcatcctgtgttatatttatttaaaaaaaaaaaaactgtttcaatagctttgggggtacaaagggttttcggttacatggataaattttgtaatgaattctgtgattttagtgtacccatagtatacattttatccaatatataattttttatccctacccccctcccaccctcccccttctgagtctctaaagtccattgtatcactttgtatgcctttgtgtacccataggttagctctcacttataagtaagaatatacagtatttgattttccatttttgaatactttccttagaataatggcctccagcttcatccaagttgctgcaaaggacgttatttcattccattttattactgagtagtattctgtggtatatatataccacattttctttattcattcattgattgatggacactggggttggttctatatctttgaaattgtaaactgggctgcaataaacatatgtgtgcatgtgtctttttcatataataactcctttttctttgggtagatagccaagtagcaagattactggattaaatggtagatctacttttagttatttaaataatttccatactattttccatagaggttgtactaatttacactctcaaaagcagtgtataagtgttccttttttaccacatccacaccaacatctattgctttttgactttttcatattagccattctggtacgagtaaggtggtatctcattgtggttttaatttgcatttccctgatgattagtgatgttggccattttttcttgtttgttagccatttttatatcttttttgagaaatgtctatttatgtcatttgcctactttttgatggatttttttttctgatttctttgagttccatgtagatttcagatactagtcctttgttggatgcatagtttgcaaatattatctcccattctgtgggttatctctttattcttatgattatttcttttgccatgcggaagctttctaatgtaatgaaatcacatttactttttttttgtatttacttttgaggttttaaaattatatctgtttttaaattttacataagggatatttacagtatgtgctcttttgtgtctggtctcattctctcaacatcatgtatatgagctcatcaatattcctgtatatagttattcattacttttcatttatatatggtgtttctttgactgaatataccatgatttaattctttgttgttccgctaattaaaatttgaactttttaaagctcttggctattatgaatagttctgacgaccaaggtgtcaatctcttgattaacctatatatgcattctcttgtacataaatgtatgcaggagactaatgggtcttaggatatgaatatgtccaattttagctactgccatttttccaaagtgattgtacctagggttatatgagatatttaagcactgttcaacacaattagaattgtatatatttcattattattattatttagctgattggactatatgtagtggtattgcattataattttaattcatattttctccatttattttttatttcaaaaaaatttcctctcttccatctttctgtttcaaggaattttctatttttttattttcctcttagcctttatgtctgaaaaaagtattttatttatgaaataaaaaatattcctgtgttttattacttgatttttgtttttaatcctaatttatatcttcattttacttttcatcatcttcttagctcattttgaaacattaggtcataattttcatcaatttatgggcatgtcctatgctaatgttgcctctaagtacattattctgtcttcgatgtttttcttgtatcagctttatatgtaattcaattataacttctttctgttcttcatttttgtagacatcatttatttatagctgaacttttaggaaagaggttacaaaaggcttgtttttctagcttcatggcattagagatctttctgttgccctgtgaattgttttaaaaggcactgtcccacattctgagatgtcctggatctgttctaacatttcagctttccctttgcccatatttttcttactccttcaatgaaaatatatgttgctagaggtttctctcagctcagggctttgttctgaagaaagctttgactggacagtaagttcactcactccagtgatgctgcaattgcttccattgtctgttttgttttatcgttgtcctgcaaggaatctttggaagcgctcacaggactcagatggtcccagcaccttcagactttatcagagacccctttcactctggtattaatttgaaacaaaaacacttcaagtttcatcttttgttctcaaatcagtccattgtacactccagagagttcctattagtgggattagtttttctttatttagttcttccatagtcgtgagaggcttctctgcttctctctgcttcctccactcagacgctaatgccatgcaaggcctatagagttcacttgtattttcttcttgaccaagcaagcacattggggtgtgtatagctatcttacctccttttgtgtggtcattgttgtagatgttgcccatattttaatattttatgtataaaccactcttctcattttcagagggatttaagaatgttaaaaaatctacattgtcaccacctccatcttccttctgttttcttttaagatttgtaatattccaagttatattaaatatatagtcagctgggtagagcacactaccattaatttaatgtcattgtttctaatggattatatgtcatacctactcatttatgtgttattaaatgcttaataaaataaaagttgctatcatttcccaattgtccatagatattggtgtcttctaacaactggctcttaaagtcagaaacgctatttagacatttttgttcttgctaactttctgccctcgttttcctggcaaatgatttccagagctagatagttatacaaatgatgttttgtttttttttaaatgtttctattcataaactagatttttgtgtgttataactaggaagcaatagttttgatctacacatcaaagatgactttgaaaggctttcctgatagaacacaaatgtgtcttcccaaattctaggcatttatagtcatctggaaagagctaatacttagaagaaataaaaaaaaaattttctaaagctattttacaacattcatagccctttactgaatttaatcaagcttaaagttcagaagatgaagaaagccacaagcttttggttattgttatatatttgaaagggcacctaggtttaagtttctttcgaaatctgtgtatcattttctaaagcaaaaatgacaggatttcatgataagagggaagccgcgtatttactcttttctctcaggtttttgagttcctaaatattaaatagactttgcctctttcttttttaagacaaaaaaaaaaaaatcactgttctgtaaaaatgtactgattatttcaagaagagaaagtcagatggttttgattccttcggcccacatagttaaatgcaaagctaatgctgggaaaacaaatgaatttcgtatcagatgttattttactgtgctcatacttcaacgagatgagtgggggattttgacatgcaagctgcattcattaatttagggcaaattgattgtatctttcttggtaataaaacttcaaaaagctacagaagaggcaggtaacattgagggctggaacaaatataccatatcttagtagcggtttaggtatgcagctattttaaagaagagtgacattggcttctgagagacgaagtggagattaaaggaaaatgtgtatctaatttagctttaaccagttatcttccaaaagtttttaagaccttagaagctaagaattttaatacttagtatcaaaaaaaacctttttattgcaacaacaaattaattcgctgtccgcaaactccattggtcagtgtccaaaaaatattggactgagacaattaactggaaaacattgtgttttaacttctgtggtattaatatcaaaagtaaaaaaattcagtgtctatgtgcgtaaaaatagtcaaacagcccattttatttaatcaatattaattgaaactcaatctgtgtttgagcacatccacttgcatatgcatctatctagaagatcctcgtacatctaagcttacagtttaaaatgaccattgtccttcaagttggtcgcctggggaaggagtttacctactcgaaccatgtggcattgtttgaaatatctgctttgttttatctcaaacttgttacctggattattctctagttttattaaataaaataattattgattccttggagtgttataaaatttcaatttcaaagaataaagattttaattgctaacaaaaattgcagaaatgcatcctgaatgcagttctaagagtagaatttcaagaagcttaaacagtcgcaattttatttaatataagtatcctggctgggcttggtggctcacgcatgtaatcccagcactttgggaggtcaaggtggatgggtcacctgaggtcagaagttcaagaccagtctgaccaacatggagaaaccctgtctctactaaaaatacaaaattagccaggtgtggtggcgcatgcctgtaatcccagccactcgggaggctgaggcaggagaatcgcttgaacctgggaggcagaggttgcaatgagccgagaccatgccattgcactccaacctggacaacaagagtgaaactccatcccaaaatgagtaagtaaacaaataaataaataaataaatgtaagtatcctttgaaagtgagtctgtgaagctattaaagtgtttttacataagatttgatatattggttaaacaattagtattgtgagataagatatacataccagtataaaatacacatttcccatatataaagaatgtatgtgtataattgaatcatgaaatgtcatagctaaatggggtcttacagttaatctatttcagcgttcaattgccacctcctgcctttagacaaatgaggacaaaagtccagaaaattttatttcaagatcacacagctacttaaggcctgagccaaaattaggtcctgacttctgattcattgcttatttcactgaggcatgattctttctaaaaatattatgagccttcctatcaacttaaaattactgtttttaagttctgtttttgaaaatgtatttctttcattttatacttggctatctaaggtttgtgttccctctgtgtgttctccatcatcccattcatctcacatagttaagggactgtggctgcagccaagcctgaataattggatacctctgtcagcattcattatcagggcctgcagaacccacacagtgtgccactttaggaaaggttatgttccgttgtagacagcaatatgtgtgctgatcaaccaccaacttcacattttaaatgcagagcctaagtgcttttataatcatgttttgatgaggtgtgtgtttatgtatggcttttgacagaaagccttttcttaacaggatcccttgagtggatacattgagtaggttgtgtgcctagggttacgaatcatcttttacatacaaacgtcttattcttaaaatatgtatttttgatatgcataatgtgactgaaaatataaatgctttgggcctatgtaccttgaaattctgaaaatatatttcaaaatcttaaattgttatccactacaacttgttcaattctctttatatgtatatttcttatgaactcaacaaagaaaacacttaagaatgtaggtaagcgttggaaaactctatatcttgagattattctcaaaaatattctgtagaaaatacatggaaatacactttgtatagtttttgactgacccaagagtaatgtgaaatattcaattaagttgccagggtaaccaagtactagtctttgcatttaatttctctagttcagttatttgatatttgtgcattgtctgttctcctgggatcactgcagactcttaattatccccattaatggagaggactggaagaatagattctccttaataacagtaaagaaaggtagtatgcatatgattttggaatgtattttgtgaagaatatgtttttgtatgtttttaaaatagaaaaaaatccagctgtatgacaatggacaagttacatagtctgctctgggtttcactgtgggttcagtgttcctattttgaaaatataaaaatttaatagtaaatccaaagctattagagtgaatattatctgggatttcagtgatattgtaaaatattaaaccaacaaatgcttttagttccccccatctatcttttctggtcaattccccgctagtcttatttccaaggagagggatgcttagtgattgtctcaaaataacacagatagatggccccaacgaaagatagcttatttctccaataatcttgatatgaaattttggtataattttttaaaattctagataaaacataatatttttatgcataatgaattcagaaatatgtaaggtgagtaacagagtaaaattgaaaatccaagcagtagctgtaagctggcacttcagctgcctcaaggaggaaagagattgtggaaaaagtcagtctttcactcagtagccaagggtttgggttaaaaagttctacgattatgaaaaatttcaagcctatacaaaaacaatgaaaatagcataataggccacctcatacccattactaaacttccacatggcaaaatatgttcatctctacgttttctcaattcctaacatgccttccaggattattgtgaaacaaaaaccagggaacaatacaatttcaactataaggttcttcactgggcgtatgttaactatgagggctttaaaacataaatataataaaatataactatcttacccaaaattactaacatccagttaggtttcagatttgaggaatttaaagtttaacaatcatgtgcagtcagatgccctatgtttgtggattgggagaattaatattgttaaaatgtccatactacccaaagcaatctacagattcaatacaatccccatcaaaattccatggtaatctttcacaaaaatagagcacacatggggaaaggacagtctctgcaatagatgctgttaggaaaaccagctattcactgcaaaagaatggcactggacccttatctcaccccatatacaagaatcgactaaaaatggagtatagtctgaaatgtaagatctgaaactataaaataattcaaagaaaaacttagaggaaaagctgcatgatattggctgaacaatgatttttttgaatatgacaccaaaaagcacaggaaaccaaagcaaaaatacacaaatggggtttcatcaaactagaaagcttccgcactgcaaaggaaacaatttaacagggcagaaagacaaccatagatagagaaaaatatttgcaaattgtatgctgataaggggttaatattcaaaatatggcaggaattcaactccatagcaggaaaacaatcctgtgaaaaaatgggcaaatgatctgagtagacatatctaaaaagaagacatacaaatggccaaaaataaaagaaaaaatgtgcaacatcgttaatcatcagagaaatgcaaatagaaaccaaaatgagctatacctcacacaagttaaaatggctattatattttcagtttattttataatgccaaaattatattaaacgtatttttaaaaactggtttttgaaatatttatcttttatatacttgcagctactgtaaattattttattctggagaacctaaacagacataaaaaacaatgtaaagaattgacagtgatcaatatcttcttttacctccctttatcataatttgttttccagaaatatttaaaagtaagttttgacatcctcttacttctgcctcaaatacttcagtgtgcatatctgaaatacaaggattgtttttctacataactagcttggcattatcatgctttaaaaaattattgataaaagatttatcagtatttaatacccaatcttatatatatcttttaattttccccatgctatcttttcaatcttagtttctccatttaaaacacaaacaagcccttacattgttaggtacacccacagccatgagctcatccagtcatcccctctaggccccttcagtggacagttacttattaaaactgaggtgagcattctgattcgaatctggtttcagtgtttttatttaattttcttgagttgattctttcatctttactccctcatactatatgtcttgtttttttttaattccctggctcatttaaagttttcctttttatctcttgttttgatcaacttgattgggacatgcttcagtgtagctattttcatttttcttgtgcttaagctttattgagattcttggatctatgaatttaaaggtttcaccaaatcaaacatttcttagcctttaaaaaaagtccctgttccctcttttactctaggcattccaattaagtgcatagtgactggagtgcctgacggagatgattttcagtgaaagactttgagagccttattaggcacaccaaccagtcatccatttgaataaagtatattgggaggtatagatggagatctgaatctcatgaaagagtttcacactttttgctatttcctgaaagtgtcttatcatttctaaaatcatgctcttctttatgttatttcatgaatctgaaatgatctatatcaccccttcctttaccccatgtcgaaatgtaaatgataattataggacaatttcaaattttatttcttttaaaagatttgtgtaatctccccagttaaatgtgacctcttccaactctgcatttggcttatgcctcttttgagcacttttactttacctagtgttgtaagcactggtgaacttttctgtctactaggtgatcattaccttgagagcaagacaatgtgttacagtttttacgccccttatggtactggttctaactatagtgttttgatagattgacagcattaaactcattgattataatttatttattaaataattcatcaaaaaattaattactaaatattgcgaatggattgccttattttaaaaaatgaatttaaaaagtcatttaactctgttataatattcttgtatatatattatttataatttctgaaatgcaagataagggatagagctgcagtggtcactgaggaatgttaatttatcttcagtttgttatgtctatggtgcagcgttcaatgcaattcaattttatttcccatatgttggctacggaaaaggaacaatatcattgctttactggagctaatgggagataatttatatgttgatatgagtaactacttttaaatttacttcataaataccttagtagcattcaaattttgtatgaactttattggcattccccacaaattatatagtgtatagtaaaagaaataaaaaataactgtattgatcatattatgcaacattgttgagaactatttaagagtagataaaaaataaaatgttagatataatgaactaatactataggtagtgaaaatgatagtggagaatcatattgaaatgttgagtggaatgacaaaatgcagattgcttcaataaagcagaaaacctgcagtgtagaactaaaatgaagcatacttcaagtatgtagtgattctaagaatgttttctttctcttggacacttatagtgaatatgccttcctaacaatctttcattcaaaaccattgaaaagaaaaacatactaatactaaggatgcaaaccatcaaagctctgctattgttattcccaccatgaacacctgcactgcaatcaagcacaattcacagatgtgagctgaaagtgtgctgataagcacatgtctacctttcagattttcattgaataaatactacctggaagttcagaaaagtggaaattgaatgtgagaagacttcactcaaaaaagaaaaatctctcaaatgtttttccccattttttgattcatatcacatttcagttgcttttcaagaaaccaacttttaaaattctacttttttctacagacatcatgtgacatggtaatttaattaacatcattattctttcatttatatttaatcttatctctcagtcttgtcactgcaagtgatcaattcaaaacatttaaaaacaatgaggtaaaatacaataaacttgtacagattttcctagcttacagaatttggtaaacacggtagaatccatgatgatgccagagcacatttgttagaaaaaaaagtttcagtttgatcatgaaagttgggtgcatattctccatctcctatgatgtcataccgtgtgaccacaatcatgtctacttaattcattttggatgttttgatgtacttgaatttagaacacgtctgtcggaaagaggaattagtgcctttactaatgttaccattttaaaatatgacaaaacctaattaagagtactgcaagttattgaaacattctttatgtggctttttgtttggtcactctattatatagcaaatctgtccaaagaatggaacttataaagaaattttaaaataatttcattttctgctgatggcaacctttttatgacctaggccatatgacaaagaatacacttaataattcagcaaatgatgagaaactaatatgttccaagcagtccagttagtactaaggatgtaattctaatctagataagtatacagttgattgcagagagatatgtacatagataatacaatgagaacttgtaaacacaataagagtatgcaatcaacaaatacatattgaacaaccactatgtcccaagcactgtgctgaaatttacatacgccaaaattccagtaatagtggaacaatatttctactggaaaatgtttaaaaaaatttatagagatagtacttaatctgcattttgaagataaatatgtttttaaatgaagatgagttcaagatttcactgctaaagaagcaatgattataaaggtctaagctgaatctagatttaaaaagtagtgagtgattgtcactgaagcccaagataaatggggaggagaaggaaaagctattggaggtgcttttgataaatatctggtagattccttagggggattatttcctttaagagaaatttggtaatctcattagccttttctgttctgggagggtaagcttcaacccagcccatagaggtctctactagtattagcaaaaacttgtatcctttgcaagctggcatgtaggtgaagtctaattgccaggtgacatagtttgtccagaacaatactgattatatgactatttctgaaatcatgattaacagtgtcccttttcactcccaaaagtttctttggtctgaagataaagtgcaaggttattttctatagaaaagttaacttacagagttctacacatcagccctttagcaacagtaaacagcagaagactctaagtggaaaagtaatgcacatgcctatccttaaagataatcctggcagcaatgtgaagaatagtcaggaatgagactgaaacaggatgatggtgtatgaaacgtgttagcacaaacagaaacaaaggagtttgaattagagcaatgcaagtgggaaggagaggaatcctaccataggaagaatttggtctttttcatgtcttctctggaaaagagctagaacacattcttactttccttttcttctctgtgtccttatgacatcgtttgcctattcatgacatcttgaactcatcttcatttaacaacatatttacctttcaaaatgcagattaagtactatctctatgacatcacttattgtctgagttgtttttttgtttgtttgttttgagacagagtctcgctctgtcgcccaggcttgagtgcagtggcgcaatctctgctcactgcaagctccgcctcccgggttcacgccattctcctgcctcagcatccccagtagctgggactacaggcgctcgccaccacgcccggctaattttttgtatttttagtagacacggggtttcaccatgttagccaggaaggtctcgatctcctgacctcgtgatccgcccgccttgacctcccaaagtgctgggattacaggcgtgagccaccgagcccagccacttattgtctgagttgtaattactacaggcttgtcttgctccctggacttgagagtaggaactgtctcatgtcacttttgctagtctgttcttgcagctgttctcaacatgtgcacggcaatctacaagtatgtgtaaaagaatgtttgaaggtaattatacaattgtgccattgtggaaagcattggatacaatgcctaactgcataaaaagcatcggtatttctttaacttgagaacacatactgacatgctcctcgtggcctgaatcttgtttacctccctaaagctccatctgttgaattttccaactcattttctccagggaaagaaagataatgcctgattcattgccctccatcacttcacagcagagaactaatctctcaattactcacaatacaaatggcgctgtgtgactcccacggtaagactctgccctatttttctccaaaggatcttaatgggggacaaagatctgtgcttccaataccactgggaaaatttccttaagtagatttgagaaactgaagcttttctgtcaattcctgaattgtgttatctgtggaaatttagactatagagccatgtatatcagttctaaagtgttgaaatacacattctatatatgtatatgcaacaatgtgtttacataaaaaataatacatgcacatccatcctatcatcaaccttctattttaatatacctctctttttgaggacttttcaaggtggtattacatatattttctatttcaattctataattcttacgttttatcaatagaatacatatatgtgttctacctgtgtatatatctacgtatgtatatttatatatatatgtatgtatatgtatatgtgtgtatatacacacagaacacatatacacatatatgtgagtatatatatctatgtatacagatatatatacatataatgtatttcttctatttgtttacctagtgttatagctcctataggaaagccaagacaaaggctcgattctatttatttaacgatttttggaaatgatttcatatttatagtagaaatacatacttacaaaagtacaaaaattagctggacatggtggtgcatgtctgtaatcccagctactcaggaggctgaggcaggagaatcgcttgaacctgggaggtggagatttcagtgagctgagatcatgctactgcactccagcctgggggacaaagcaagactccttctcaaaaataaataaataaataaacaaaaaggaatgctactgatttttgtatgttgatgttttatactacaactttactgaatttatcagttctaatagttttttagggaagtctttaggttgttccaaatataagattacatcctctgcaaacaaggataattagacatcttccttttcaatttgtatggcctttatatctttatcttgtctgattaatctagctaatacttccagtactacgttgaataatagcggtgaaagtgggcatccttgtcatgttccaaatctaagagaaaagacttttttcagtttttccccattcagtatgataccatctctgggcctgtcatatattacctttattatgttgaagtatgttgaattttatcaaatgctttttcaccatcagttgaaatgattatatggtttttgtccttcattctgttgatacaatgcttcatattaattgatttgcatatgtggaaccattcttgaatcccacatggttatgatgaatgatctctttaagatattgttgaatttggtttgctagtattttgttgaggatatttgcatcaatattcatcagcaatattggcctgaagttttctgtttttgatgtgtctttgtctgttttggtgtcagggtaatactgacctgtagaataagtttggaagtatttgctcttcctctgtgtttcagaacagtttgagtaggattggtgttagtcgttctttcaatgtttgatagggtttagcagtgaagacattgggttctggacttttctttactgggagactttttattaaggcttcaatctcattcttcgttattggtctgttcagggattgtatttcttcatgtttcaatcacgataggttgtatgtgtctaggaatctgttcatttcttttagatttcccaatttattggcacaaagttgcttatagaagccacaaatgatcttttgaatttctgccatatcaattgtaatgtttcatttttcatctgtgattttatttatttggatttttttctctttttttcatagttagtctgactacagatttgacaattttgtttatctttcaaaaaaccaactttttgttgaattgatcttttgtattgttttcttcatttcaatttcatttaattcttctctgatctttattattgtttttttttactacttttgtgtttggtgttctgttgacatttctagttctttaggatgcatcactgggctgtttatttaaagctcttcttcttttttaatgtaggcacttgtagctataaatttttatctttgaactgtatttgctgtatcccacaggttttggtatgttgtgtttccaataccatttgtttcgagaaattttccaattttcttctcaatttcttcattgacccactcatcattcaggatcatatcgtttcattttcgtgtgtttgtatagtttccaaaattctacttgttacttatttctaattttattccactgtgctcagagaacatacatgacattatttcattttgttaaatgttttaagacctgttttgtggcttaatatgtgatctatctttaagaatgatccacatgctgaggaaaaaaatatgtattttgtggctgttgggtgaaacgttctgtaacattacacgaaatatacctgatatacatataggtccttttgatttatagcacagattaagtctgaagtttctttgctgactttctgtctgaataatcagtccaatgttgaaagtgaggtgttgaagtatccagctattattgtgtccaggtctatctctctccttagctctaataatatttgctatatatatctgggtgctccaatgttgggtgcatatatatgaacaattgtggtatcctcttgctgaattgactcctttatcattatattaccttatttgtctctttctatagttttatcttgaaatctattttgtctgatataagtgtagcaactcctcctctttttttggttttaatttgcatggaacatatttttccatccctttattatcagtctatgtgtgtctttatatgtgaagtgtgtttcttgtaggcaacagattattgggtcttccctttttattcatttagccactctatgtcttttgactggagagtttagtccatttaaattcaatgttattattgataagtaaggacttacttctgccatttgttgttttcttgttttgtggtcttccttccttctttctttcctgtcttcttttactgaagctgactttctctggtagcttgatttaatttcttgcttttcaatatttgtatacttgttgtgtgcttgtagatttgaggttaaaatgaggcttgcaaataatatcttataacttattattttaaactaatgccagcttaacagtgattgtgtaaacatataagcaaaaagaaaactaatataaactgtacactttaactttgttcccccaatttttaagtttttgttgtttctatttacatcttattttactttttactgtctatgtcttaaaaatgtgttgtagttattatttttgatcagttcatcttttagtctttctacttaagagtagtttatacatcaaaattacagtgttataatattctttattttctgtgtacttacttttaccagtgagttttgtgctttcagattcagatgattttttattgcttattaacatcttttttttcagattggagaattgcctttagcatttcttcttttttttattattatactttaagttttagggtacatgtgcctttagcatttcttataggtcaggtctggtgttgataaaatccctcaggtttgtttgtctgggaaggtctttatttctctttcatgcttgaaagatattttcactggatatactattctaggaaaaaaggtgtttttttctttgtttgttttggtttgctttgttttgttcttcttcagcactttaagtataccatgtcagtctctcctgatctaaaaggcttccactgggaagtctgctgccagctatattggagctccattgtatgctatttgtttcttttctcttgctgcttttaggatcttctctgtgtccttgatctttgagagtttgattgttaaatgtcttaaggcagtcttttttgggttaaacctgctggtgttctataatcttcttgtatttgaatattgatatatttctctaggtttggaaagttctctgctcttattcctttgaataattgttctattcctatctctctttctactccctccttaatggcagtaactcttagacttgcccttttggggttattttctagatcttgtaggcatgcttcattgttttttattcttatttcttttgtctcttctaactatatattttcaaatagcctgtcttcaagctcactaattctttcttctgcttgatcaattctgctattaagatactttgctgtgaccaggcaaagtgactcatgcctgtaatcccagcattttgggaggccaaggaagcagattgcctgaggtcaggagtttgagaccagcctggctaacatggtaaaatcccatctctacttaaaatacaaaaataagccaggggtggtggcacatgcctgcacttccagccactcggggggctgaggcaggagaattgcttgaacctgggaaacggaggttgcaagattgcaccactgcactccagcctgggcaacagagcaagacttgtctggaaaaaaaaaaaaaaaagatactctgatacattcttcaatatgtcatttgcatttttcaactccaaaatttccactagattctttcacttatttcaatctctttgttaaatatatataatgggattctgaattccttctctgtgttttgttgaatttcctcaggttccctcaaaacagctattttgaattctctgtctgaaaggtcgtatatctctgtttctccaggattgctccctggtgacttatttacttcatttggtgaagtcttgttttcttggatgctgtggatgattgtaaatgttctttggtgtctgggcattaaagaattaggtatttattatagtcttctcagattgggcttgtttgtgcctgtccttcttgggaagacttacttgtaccctaagccaaataatgctgttgattttacagactcatagaggtactatgttggaggtcttggaaaagatccagaaaaattctctcaattaccagccagtgtcttggtgttttcctttattttctcagaaacaagcagagtctctttctccctgtgttgagccaccaggaactagggatgtggtgatgcaagcacctctgtggccaccaccactgggactgtgctgggtcagacctgaagccagcacagtacttagccttacccaaagcccttatcttcagggtggcaagatccccagtccctgaacatgtccagagatgctatctgggagccagggattggactcaaaactcaaaaactttaacaatttaccaggtgttctattctactacagctaagctggtgcttaaatcgaatactggggtttgaagaggaaaggcacaagtcttcccttagctattccagctagtgtctccttaggtaacatgtcaccctaacccacctgctctaagcccagcctagcactaggatttgcctagcaattgcagtctttgtatcctatactgcctttcaagtttacctaggaccccagagcccttcagcctatgatggcaaggcttgcagagaaacttccaactgctgggatgggccattcctctccagctagggctggtaaatattttccctccttgtgccggccctggctaatcccaatatggttttattctctgctgtagcagggcagcactgagtttgatgtaaagtccctcagttgctgtgctcttcctccccaagatgcacagattctgtctccacagtgcatggcattggcaatttatgccacagttgttggcattggcaatttatgactgtctcttcggccctcctcaatactctttccataatataaagtttaaaccaggtactgtgattgttcacatgattttcggttcttgtaatggtgcttttctgcatgtggttggttgttaaaatttggtattccagcatgtggtcggggtaggagggatgaacagtactgtgagcttctattctgccctcttgctctgcccccaaatctccttgttttggcttgcatttccctctttagttcctggtatattttgaacaacattcccttgtaggatatgccttttgaaaatattttttggcaatatttttccccaatatatggcttctcttctcatttccttgagagtgtcaattgtagagcagatatgtttaattttgctgaactctagcttatcaataatttctttcatgaactatgcctctggttatatatctaaaaagtcatcaccaaatgtaaggtcatttagattgtcttctgttattcctagaatttttgtaaacttgtgatttacatttaggtgtatgatcccttttgcattaattgtgtgtgtgtgcattttatacatatatatatatatatatatatatatatatatagacagagagagagagaatactgtgtgtgtaatacacacacacacacagacacagatagatcaatagaacagaataaataacccagaaatagacccaccaaatatatgcatatatacatatataaatatatatatgtatatcttgattactgtagttatatggcaagtcataaagttaggcagtgtcagtcaatccttcaactttgttctacaatattgtattgcccattgtgtatcttctgttttccaatcttaactttagaatcagtgtggtaatattcaaaatataactctctaaggcttctactggaattgtaataaatctataaataaaatagcaaagaattgacatcttgacaattgagtctatccataaatagaaaacaatactttattaatttagttgtttttaaattaatttcattcaagtttcatagtttttctaatatagatcttgaacatttttaaaaagatttatgctgaaatatttcatctttggggtgctaatgtaaatgatattgcatctttaatttcaaactgcactaggtcattcatggtatatagaaaagtgattaaaatttatatattaacttcatatcctgcaagcttgctatattacttattagttctaggagttattttgtcaattatagtattttctatgtacactatcaagcttgcaaacaaagaaaacttgttaaaacttgcttaaaaagcttgcaaacaaaacattcttcaaatcagtacaccttttatttccttttcacatagtattacattagctaggacttcctgtatgatttttaaaaggaatggtgataggaaacatctttgccttgttcctgatctcagtggaaaagcttttggttttctaccattatgtgtgatgtcagttattctgtaaatgttctttttcaagttcaggaggttttcctctatttctagcttgctgagagttttcttcatgaacagatgttaaattttatcatacttttttttgtgtacacatagataagatcatgtgattttttattagcttgtgaatatgataaattacaataattaattttaaaatgatgaaacagctttggagcctgaaatgaattccaagtggctgtagtgtatagttgtatacactgttggattttatttgctgtcattttgttcactgtctttgcctgtaattttctattcttgtaatgtctttatattgtttttatattagtgtaatacctgcctcaaatgagttggaaaatattttctccaattctgccttctggaaatgcttgtagaaaattggtataatttcttcctaaaatgtttggtagaattcatttggtagaagcgttttgcttcctgcttggaaaggttattaattattgcttcaatttcttttatagatataggactattcagaatgactgtttcttcttgtgtgagttctggcaaattgtatctttcaagaaatcagcccgtttcaccaacattgtcaaatttgtgggcagagagttgttattttatagtattttttgttattcctttaatttccatgtgatctatacttatgtctcctctttcatgtctgatattagtaatttgtgtcttgtctctttttttttattcctagttagcctagctactgttttactaattttattgatcttttccaagaatcagctctttaaaaaaattttctctattgattttttttttcattttcacaggcttttgctctaagtttattattttcttccagttacattgaatttcatttactcttatttttctaattttctaaagtggatactaatattattgattttgagctcacttttgttctgcaaatgcagtatatgtcctaaatttccttctaagcactgctatctctacatcccacacactttgaaaagtggcgtttttatttttatttactttgtttgaaatatttttaatatcttttgatctttcttttttgagccatgttttctttagaagagtgttgtttaatcctcaagtgttttgtgattttctagatatctttctgttattgatttctagtttagttccattgtagtgtgagagcatatattgtatgatttctgttcttttaaatattttaagttgtgttttatggcccagaatctggtctaactttgttaatgtcccatgtgagcttgagaagaatgttgtgaataccaattagatccacttgattgatggttaatattgagttcaactataagcttactgcctttatgtttcctgggtctgtccatctctggtagaggggtgtttaagttgcaaagataatagcgaattcacccttttctccttgcaggtctatccattttgccttacatattttgatactttgctgttagacacatacacactaaagactattaaatctttttagagagctaatccctttactatggttcagtactttactcctgttactttttcttgctttttagtctgctgtctctgaaataagtctttctaccccagctttcttttgatttgtataaacattgtatgtctttctgtatcctcttactttgaattgtgtgtatcttcatatttaagtgggtctattataaaaaacatatagttgatttttatatttttatccactctgacaacctgtgttttaattggtatgtttagaccattgacattatactggttattgataccattagataaatgtctataatatttattgttatttctattcattgcccttcttctttgtttcatttttgtcttccattctgtttctgcattttttatttcaattgcacattttatatgcttccatttactctccattcttaacatgtcagctccttattttttcacttatttttaaagtggttttagagtttgcaatatacatttacactgaatctaaagcaacttcaaataactacttctcttcacagatagttcaaataccttctaataacaaaatattcctaattcctctatctcatttcttttatctttgttgtcattcatttcacttatatataacctattattatgaaacacattgttgctattattattttaacaaacgttttgctgttagattgattaataataataaaaataaaagttttattctaccttcacttataccttttgtaattatttttctttatgcagatccgagtttctgatctatatcattttacttcactcttaagaacttcttttagcatattttgcaagacagggctattggcaacaaattctctgaacttttgttagactgagaaaattttagctttcacttttgaaggataattttgcaagattcagagtactaacttcatgcttttgtctgtcaactttaaatatttcactccactcttcttgcttacatggtgtattagttttttttgatgctgctgtaaagtaatacccgagactgggtaaaggataaaggtttaattgacctacagttctgcatggctgggaggcctcaggaaacttacaatggtggaaggggaaagagaagcaaacactttcttcacaaggcagcaggacagagagagcatgtgtgaaggaggtactgtcaaacacttataaaaccatcagatctcatgagaattcactcactatcatgagaacagcataggagaaaccacctcatgatccattcacctccctccctcagcatgtggggattacaggtccttccctagatgtgtggattttataatgtgaggtgagatttgggttgggacacagaaccaaacgatatcattctgcccatggcccctcccaaatctcatgtattttcacatttcaaaacacaatcataccttcccaacagtcccaaaaagtcttaacttatttcatcattaattcagaaatccaagttcaaattatcatctcagacaaggcaagtcccttctacctgtgaacctgtaaagtcaaaaacaagttaggtacttccaagacacaatgtgggtgtaagcattggataaatacttccattccaaatgggagaaattggccaaaacaaaagagctataagtcccatgtgagtctgaaatccagcagagcagtcattaagtcttaaagctccaaaataatcttttactccatgtctcacatccaggtcacactgatgtaaaagttgggctcccaccctgtggcactgcagggttcaacctccccgataccctcccctggctgctttcacagctggcattgtctgtctatggcttttccaggtacacagtgcaagctgtcattctggggtatggaggacagtggcccccttcttacagctccattaggcaggatttcagtggaaactatgtgtgggggctccaactccacatttttcttctgtattgccctagtagaggctttccatgagggctccacccctgcagcagacttctgcctggacatccgcgcattcccaaacatcctctgaaatctaggtggaggttcccaaacctcaattcttgacttctgtgtacctgcaggcaaaacaccacgtagaagcttccaagatttggcccttgcaccctctaaagcaacagcccaagttgtaccctgaccccttttagccacactagagctgtagtggctcaaatgcagggcacgagatcccaaggctacacacagcagccaggtcctgggcctggtccacaaaatcatttttcctcctagacttccatgcctgcaatgtgagaggctgccaccaagatctctgacaagccctcgagacatttttcccattgtcttagtgattagcatatggctcctccttacttatgcaaatttctgcagctggcttgaatttctccctagaaattttttttttctattgcatcgtcaggttgcaaattttccaaacttttatgctctgcttcctttttaaacataagttccaatttcagatcatctctttccagtaaaatttccacagatctctaaggcaggggcaatttgccaccagtctgtttgctacagcacagcaagagtgacatttgctccagttcccaagaagttccgcgtatccatttgagaccacctcagcctggacttcattgtccacatctaatatggtttggctgtgtccccacacaaatttcatcccataatccccaaatgtggtgggactcagttggaagtaattgaatcatgggggtggttaccctcatgctgttcctgtgatagtgagtgagttcacatgagatctgatgtttttataagggggtttttccccttttgcttggcacttctccttcctgctgccacatgagaaaggatctgtttgtttccccttccactgtgattatacattttctgaggcctccccagccttgctgaactgtgagtcaattaaagctcttttctttataaattaaccagtgtcaggtttgtctttatttgcagcatgagaacagactaatacaacatcatcatccgcattttggtcaacaccattcaaaaaatctctagaaagtttcaaactttctcacatcttcctaccttcttctcaccctccaaactgtttcaacctcttcctgttacccagttccaaagttgcttctacaatttcaggttatctttacagcagtaccccactatcccagtaccaatttactatattaatctgttttcacagtgctataaagaaatacctgagactgggtaattgataaaggaaagaggtttcattgactcacagttccacatggctggggaggcctcaggaaacttacaatcatggaagaaggggaagggggcacagtaaacttcttcacgaggtggcaggacagacagcatgtggggaggaggaactgacaaacacttataaaaccattcgatcttgtaagaactcactcactatcacaagaacagaataggaaaaactgcctccatgatccaaccacctccctcccttgacatgtgaggattaacaattcgagataagatttgggtggggacatagagctaaaccatatcatgtgatttctgaggagaaacaggatataattcttttttttgcttctctacaggtaatatttttctagctattttccaaaatgtgtttctatattttttattttctaaaatataaatatggtgcactaggtatttatcatgtgtgtgtgtatgtgcacatttgtacgtacatgctatataactgtcagggaaatcatcggctagtagaaattgaaatagcacacagacaggtgggcagacacatgtggtacgcttgttgtattttttactaagtgtgtctttacagcagcacaccttgtggggctggtgtaccctctaaagtaaagtgaagtgtgtctaggacatctgattttgactgagggaatcagaagaaaaatctctgatacagtttgcatgaacttgagaccaaaacgatctttaattagtgttccaagctagagaaacagccctgagtgaggaaaaggcatggtatttttggaaatttaaggagagctagcaagtctggaagaatcaaacaagagaagaaatcctgcagctgagaatcagatgatacagtgtccatggtcagaatttttccatttcagtctaaatttaccgagaagccattggcaatattcaagcatagtcttggcaggtgagtgcttcatctgggtacttatggacaatagactgaatgatgtggttaagagaagtatctgcatgagagatagcagtagcttgaatcacatggtgcttgctggtatagagaaggatactgaatcaaggtatagtttgaaggtacaatggacagatttgccaggagattctgtgagtgagagggaagatttctcaatttctttacgtcagaacttataatgagaacaactgggtagctgaagatgctataatctaaagtggagaagacagcagaaaaaagtgttcatttaaaatattttaattttcagaatttttcagaagtcagtcatgcctgagctaaggaaaaagatgcagatggcaaatttttgttttttaaaattatagtatcagcaaatggaatcacaaaggtgaatgtagaattctgaggccatgctgttaagtagttgcagatccataatttaattctaagcttctctgactctcaaatgcatgttcttgactattgagctgtggagctagacaaccccaaaatttttatgaaatatgaaaaatgttctgatctttccatctattcaaatgagctaccatgttgtaagcaccacatagtctgtttatgacatacatattattcctattcttttccccaatcctgcatgtgattgtcattattattcattttttccagaagaaaaaattgagttttggagagttaaaaacttattgggtcctcatttcttgaatggctttcctctacagtgtgccctcgtgtacatccatggcccccaccaggcaagaaaacagagtccccacttaggagaaaattattacttaagccttgtttttttttttaaaatgtgttttataattaatactaaaataaatttcactgaggtgtgaatcaagtttgtttgggaaataaaatattaaaatacatggaatcgtgtataatgtttgacaacatctgcatgcttacttaatcacatgatctccctgatggaatcagctcttaagttgagatctgacaccatcttatatagataatgtatgtcataggcatacatggctcagctactgaggcaatcttctctctgtaaaattaaaataaaagttttgccagcaattaatctccttagccgttagaatagattatacaccagtccttggagtgcaaggaagtgagcatgtgagagtgtttgaagacctggcactaaatgattacaatgtcaccaggagagagctcagttacaaaatagtacagttggagcagcttatttcttctcaagtacaattactttgttctcagaaccaatgtaatcattggagcacgtttatttcttctttgttctcacattgtgagtatgtgttagcatgtagcctaatgcaaatatggtaaaatatattatatttgaagctagctagcaatagtttgatatattttcagatatgaagatataaaaaacaaataaaaaacttttaaaaagtcattgctaactttgtaaaaacgtaatatatactcaagactcagcctgctgggctcaggttctggccctggccccatcacagaacagctgtgtgacttcgatacaataacttaacctctctgagactatgtatcataatttataaaatgggaagagtgaaagtgtctacctcacaggtttgccatagagattaaatgaattaaccattattgataaatgttaataatggtgtctaatacatattgaatgtttaagtgtttgtttgcaagtattttcctgacatttttgaaatatatgtgttttatatgttccctaaacttttgtatatcttcttacctcatttattagccacaatttgatcatctgaattcctagctgaataactggtaccatgtttataatacttcagcttctcctagtgtttcaaagctacctcctgccatattttgctatgaatgtactttcttatttcttattatgctggaaacagcattacctagcagtagcaaaacatttcttatggaagaggaacaaatatatttcttgttgagattgtagctgcaaaacttctctcgcttgagttcccatcatgagaatggcgttatcagagaaatacagaaccaaaatctttatgaggccaacgttgtttccaaacatttcttaacgttcccttgattgaccaaaataaactaactaataataaggaatcaaatcctccagaaaaaaataaaaatcaaattaaagaaggaattaagactactaaggtaattcttaggacaaatgaaatcaaattgagctctcattatctccattaaagtgccacatggatgcatacaatcttacatggataatgtacataatttagattcttgtcaaaaaagacactgcagcctctgcctcccgggttcaagcgattctcctgcttcagcctcccaagtagctgggattacaggcacccatcatcacgcctggctaatttttgtatttttagtagagatggggttttgccatgttggccaggctggtctagaactcctgacctcaggtattctgccctcctcggcctcccaaagtgccgggattacaggcctgagccaccgcgcctggccaggagcacatttttctaaatcaagcatgaagacaaaagtgcacatggcagcccccttgaattcagcctcttgccatgagccaagaatctatgtataccatgctggactcttgagttacagaactgaaagcaaataaagcaaagttgttttaagccagtaactttgtggtgatttgttatggcagcaaaaaactaacaaaaaccataacaaaagcaagctgccttcagctttctctgatgagtttctcccctgtaattgtcctgttctgcattgtttgcctgggattttgtcctcatttatatctctgctaaaaaaaaaaaaaaggaaatagcagccctcattgctcaaaccagtgtatggttttcactactcattttaccttatttctgtagcaattgaagactaacctgggagaacatgctgaaaggtaggaaataaaaacagcaacatagtgtcaaagtccagaaatgcccattgctgtgctatctgggcaaattactcaacctctttcaatcaaatttctttataaaataataaagaaaaatgagctttccttataagattgtgtggattaaatgggataatagactgaacaatatttctccaagcagcttaaaagccatttttcaagggtgtttttctaacctctaaatcttcgaggctatgctcactcaatgcacctcttctcctgcacttattgtaacttgaaaatatagttaattgtgggaatgtgttcatgcccaactcttctgctagattatacttacaaaggagactatttttgttcactgtaatattcctgtgtgtggtgcaggacctaaaaaatattaggtagtcaatatatatccgttaaataattgaacattaagaatgtgtctaggatatattaagtgttcaaacaatgttgatttccttccttacttgaccttgtcttgtttatcagcatttagggctgcattttgtgttgtttcttctccttgttctattccttctggtttcatgtgctttctctttttattagtttcatattgcagtcataacagataaccacaaacttggtggtttagaacacccacatatcatctcaccactctggtggtcagaagtctgagcatacaacatggctcaacagcatccactgctttgcttatcggaaaactgaaatcacacgtcagcagagcactgtttcctgttcaaggctccggagaaatatctgcttcctagttcaatcaacattttggcagttgtttgtggtaggaatacacattggttataggaatgaagttcccatgttcttggtggctatcgccagggcactgatcattgtacttagaagtctctttctgtctgtgttcatggcccctatatctcaaaaccagtatggttgaatcaaatccttctcacacttggaaaccatcagactgctctctctcatatccttaactccaatgggagggagttcctacttttaagggctcctgtgattagactgtgtccacttggatactccagggtaacaccaagaacactcttacaccaccgcatggcaaggcctctagctttctgacctctaatgccagctaagtcatagccactgccaattctatgcttttatgttttattattttattttattttattttattttattttattttattttatttatgttacccttatgggatcacatcacttgggggaaacaatttctacattagtcaaggtaagtcatgttatataggtatataacaatcacaaaattccagtgccttaaaacacaaaggtctttcagatgttctattcttcctgtgtcttccgaatccaccatctttgatgtacacctgtactttaacttcaggaagggtgagatgaattaagtattatgtgttgggtatagaattgggaatatgaattttatccacattccattggctaaaactcaggccatggtccctgcaaactgcaaagaggactgggaaatgtaatttctcttaatgttccaggggaaataaaaaagaatttggagaccatagagcattctcttcatcctgtagactctttccaattgaaaagatttctaaacatattcccttctatactctgaatctgtattcatagattttctctcaacatctagtcaattccccatgtttctgtgcactgcctgctgtttcttctttccataatgctctatccctgtttatgtgaattgagaggtattattcaattatcagtgccaattgttttgaggcactggtagaagatttatgaggttcttctagattgtctaaaccagaggtggtcttttttttccttatatttttaacaaaaacctatttatttacatgctgcatatcaaatgaaacatagttatagtttgtcttttcaaaatgtagttttcttagggcagaaattatgtctgtgaatgcccagcattagcgaagttccttacatatggtaaacccacactatgtttgtttgtttgaaggcttaatatgtaaatgaatgtcctaataaataacagatttattgaatgtatttgtcttagtaataataactcatgcttatcttgaccttgctgtgtgctaggcatgagttttccaaaatgtagaaactaaggcactgaacagtgaaataactccataaaatcatggcctaaggagtagtagagatgactttgaacccatagattgtggccattgagtttgtgttctttactactatatgtctgttaatttcagcattattaaagaaaataactttttatttctatatattatgtgtcagacattataatcattgctgttgctctttttatcttcaaaagttccgtacagaaaatgtattgatagtccccctggcttttttccctgcattgcatcagattagaaaaatgaggaatcaggctgcttgtttctgctcttacatgtaaatgacttggcagttgtcactgtcttctctgcatcaagaacaagtgaacaaactgtatagtgacaactcttcttctaatcacagagaaaaccaccacgcctaaaactggagaaacaagtgaatacagggaaccacagcttactaggagcagaaaccatcattggtgccaataaattacagagaaacttaaactataactgatgaattggtggttgctcaatgtggactagttggaagttaaatctcctagaggtcaagcctcaaggggaacactgctctttcatgagttttacctccaggagactcaccaggttatcactgtaacaatctgagaaaaatttctacccgtttcctgcaaggaaaggagaaaagcaaccatgtttaaatatacccagagcattctgttctgtttaacaaaggtctcccctcaagaaaaacctagtttattagaacccacctaacatggaagaagggaaataaccccttgaagacccctcaaactttcctgtctcacctatgggagatgaaagaaaagctgagatgtatttgttagggtcgcaacccatgggcacaggttcactgaaagactgagacctagtcagaaggttatggaatacttcctcctttctcacattttatcccacatcaacaaggctgtagcataataatagtgaaatatagttgaaaaatttatgaggatataactttatttaagaagtgtcttttaggccgggcgcagtggctcacgcctgtaatcccagcactttgggaggccaaggcgggcggatcatgaggtcaggagatcgagaccatcctagctaacacggtgaaaccccgtctctactaaaaatgcaaaaagttagccgggcttggtggcgggcgcctgtagtcccagctactcaggaggctgaggcaggagaatggcgtgaacctgggaggcggagcttgcagtgagccgagattgcgcctgcactccagactgggcgacagagcaagactctgtctcaaaaaaaataaataaataaaaataaataaataaaaataagtattttttgagtttgcatacaaactcaaatgcaaaaagggagacaaaaacaaggacactggaggaaatggaaacttccggcatctacagctgcagcaagcagtaaacacagcctaactcctggcaagacaaatgcaatagctcacactaatgatctactcacatcagtttcttttaccagggcatcatgtctggctttcaataaaaacccagaaggcacggtaaaaggcacataatacagtgtgaagagaaaaaactagcaacagaaccagaatcagatatggcagagatttttgaattaatgaattggtagtttaaactaactatattatgctaagaagtataatggaataaagttgacagcatgcaagaaaagataggtgatgtaagcagacagctgaaaactttaagaagataaccaaaagaaaatgctaaaaatcaaaaccattgtaatagaaatgaaaaagttacagtctttcatgaaattattaaactggatacagctaaggaaaaaaatagtgagcttgaagatacgtctatggaagctatctaaactaaaaattaaaaataaagactgaaaaaggaaacagaaccgtatacccaagaaatgtggaacaatttaaaaaggggtaacttatgtgtaatgggaataccagaagaagaagaaagaaaacatgtaggaacagaataaatatttaaaatgataatggctgagaattttccaaaactaatgacaggtaccaaacttcagatactggaatttcagagaaatcaaacagaatatacagaaactaaaagcaaaacaacacaaaatactatgcctaagaaatattttatagaagctgcagaaaatcaaagaagaaaataagccagagaaaaaaaatcaccttacttagagaggtataagtataggaattacattggacttctcttagaaaccatgcaaagaagaaacaagtggagtgaaataattaaaatgttgaaaatttcattaaaaaacacacccaactggaattctgtatcaagttaaattatccttcaaatgtaaagaaggaatgaaactcctcagtcaaacaaaaattggggaacatattttcagttcatcctccttgctagagctataaaagaaattcttcagagagaagaaaaatgatatgggtcagtaacttatgtatacattaaaaaagagaattaaaaaataaataaaaacaagatcttgtttatatttaatttagctaacagctcttctgtgaaataataataacaatggtctatatgctgattatgccttatggataagtaaaatgaattacagccatgttataagagataaggaaggtgaggttttgaatattctactataaaccacatgcattatccatgaagtgttttagtatagtagtcttatattagttttaaatgtatatttctaatattagggaaatcactaaagtaaattgaaaatataaataaaattgatatactaagagggaagtaaaaatggagtcataaaaagctcaattacaacctgagaaggcagaaaaagaggggaaaataataaagaaacaaataaaaagggcaacaaacgaaaagcaagtacatatgtagtagttattcatcctactatgtcaacaatgacttcaaatatgactgctctaaatatactcattaaaatgctctaaatatatccattaaaagacagactttctgtgtagataaaaataaacaagagtaaactatgtattgtgtacaagaaatccactttaaatataaggacacagataggttaaaagtaacaaaagaaacacagaaaaagagaagtatttagatacaaatccataaaaatacataaaggatctacactgtgaaatccacaaagctctgaagaaagacattaaagaagatataaataaattgagagatattccatatttatgggtgggaagaaatattgttaagatgttgatttttcctaaatttatatatagtttcaacacaatctcagtcaaaattccagcaaggtattttgtagatactaataaactgattctaaattccacatggaaagcaaaagcccagaatggctaacacaatagtgaagaagagcaaaacagaagagctgaagaactgacactatcttatcttaagagtttctataaagctacattaaccaaaacagtgtggtgttagcaaaagaatagacaaattgatcaagataacagaatagagaagtcagaaatagccctgcacaaatgtagtcaattgatcttgacaaaggagcaaagaccacaaagaaaggataatcttttcagcaagtagtgctgttaacaactggacatccacatgaaagaaatgaatataaatacatttcttacaatcctcacaaaaataaattcaaactgaatcacagaactaaaagcaaaacacagaatgatcagttttgataaattcctaagacaacatggcagaatatctagatgaacttaagtttggcaatgagtttatggatacaataccaaagcatgatctatgaaagaaagaagaaaactgaaaaattggacttccttaaaattaaaaacttaattttccctcactaatctattgattaaaagtagattaaaaatgatgcactctgtaagtctaggactttgtttttgtctgtacattatctctaaaatgtaaaaaatacttcttggtgcaaaataggtactaaaattgtttaatgacaatttgcagagttcaaagtaaagcacaaattgcttcacttgttcacacacaaaaaaattttacttttcaattgagacttaattcatctaatccaaacctccaaatgtgagatagttacaaatgaaaacaaagaggttaagattgtttgagttttacttaattcagctgcttttgttgttgtttggttgtatttttctggctacatagtagtttggccaactgtaggcaatgcagccttaaatagagaggtttagtaccaagcctccttaaagggatttatctctttccatatatattttttcctatagaaatatttaacccagtactccttttggaacattgatacatagtcagtactattaaaataggcaattaatattgtggagttcaaacatgggacaaataagagttggaggaatggtgactaacatattttttctctgcttgttccacaaatggtactttttcccccatctgcataatcagatttcaaatttaatgaatatttgctacagtcatttctatgtataatagtgagctaatatgataatatttattaatttattcaacaaatatttatgaaagtgtcctactgtttgctactcctttgaatacctaatgatgatagatgaaggaaatgaaattaggggaagattgacatgagtcataagacgtgtggctgaaaataaattttaataggaggaaagaaaaaattacccaactggggagaaaacattgtagtaaaaaatgtaatcatttaattctgtttcccaaatgaaatggactttaattcactacagggcaactaatattagtagggttaaggggaaccattagtggtgccagtttgtaggtgacagtagtcacctttgccttgtaaacttaactgatattgagagtcttaatagccataggaacatgacaagataattatcactgaagaataataacaagctaaatgcagataaagttaactttttattcattttgaactatgccagaaaatagttaaatagatgaccattttccaaaaccaaattttgtatgattgcctatttccatattttcagattaaatttctattccaaatattgtgcttttcatcatcatttcatccaagccactcttatagtctggatggctgtaaaaatggcataatcactatgtgtacagtagcaattttgtcattacttgcagaatgacaataaatatgtaacttgtttttgcttcaaagaaaaaatagacctgtataaaaggcaatttttttccttctgctcattttagttcggcatgaagtagtttaaaagtttccaggataatatcatgcacccttttaacattacagatgccaccttctggaagttacaataaatacttaagcacagttgtgaaaacatgccctctttagcttataaaatacttataggtagatataggcaaattcacctgacatcatcattgtgttttgcatgaacaataattgactccttacttctatactacgttttaaagacaagaaatgttcgtggtgaaccacagactaattatactctttgcattgcaaaaatagttctttaaacataaatcaatagattaaaaaaatgttttgctaagtaaggcaagcaagaaatatatttagaaagaagtattttggcttcaagtatttaaaacacatctattgtgttaacctgccaatgactcaatcatgttacattctaggtttttaaaaatctgtcattcacattccccccagcaaaactgaagccatgtaggtaagaacagaaaactaagaagcttgttaatagagaggactactcttcaaataagttaaaaataactttgcaagaaaaaaaggatcaccatagtagtatttatataaatttatttaatgcttttgttttgcctgtgagtctgggcatttagaagtcctaacatgttaaagtggaaagggagagcagtctcatctggtctaattccttctttccaaacctgaagcaaaggagttctagagatatggggccatctgcctggagctcactgacaaatccaccagtatcataattctgtttcaagtcaaaatcctcttttaaagaaaccacctgggattttactcccaggaaacaaaattgggatcaaaaccagaaaacaaacagagatacacaaatcaaaacaaaattttgtcactgaaatttttcctgcttcactgtttaatccccagtacttcgtgatggatttatgtcgctcataggaattgcacccggtcagacctgaacaagcttaacctcccagtgagtatacagctttcaaacccacactaaaaagtggggaaaataggtaagaacgaccatcagcattgattcaatagattacatggcattaattacaaagtagtttataaaccaaacactaaatggaagacgtttatatccttaccattagtgatttctgtgtcagaggactcacttgagtttataaaactgtattttaaggctggaatcctaaagtaagatatttctgtaagaacaatcagttagtgtcatagatattagtgtggttgaaagcaattagcaattgatttattttaattataaaaaaattaaaagatcacaaatacaaacaaaacaaagccaagcaaatcaatcttaacataaatattaatgatgtattggatttttaataaagaaatgtaaatagtgaacaaatagcaagctattagatttggaaagataagatttgggaaatgatttattgtagtgtattttatttgtagttgcatcagaaattacattaatcattgattaaattacatttatgattcttacgtgatcaccatatccatttaagagtgagcctattagataaaagccaaagcaattatcttactgattttttgaaataaaaaaatagtaataactcagaaaaaatgagatgcacatgttcttccagcatattttccaggcttaatagagttaaaatacaggccttaatattatcacaatagtgatgaatgtgcctgcttcccaggctagacaatttaggaataagatggctggtgttagtcatctgatcaggtagttaactccatcctcagctggcttttctctttactgacagactgtcacaatgtccattaacaatttcccaaaagcagcatggaaattgataccaagaacactgcaccttcagcctaagaaggtttagatttgagggtattgttttattagtaatccattattcaactgagttatagtcaattcatttttttctctgaatcctgatatataccatttttatatataccttatatatacaccatttttgaaagaaagcaaagcaacttactatcccagttaaaatggctttgttaaaaattacacaaaaaaatagcggcttaaaacaacgagaagatttatttagctcagagatctccagctggagcaaggctcatagaagatagcttgtttctgctccatggttggtagctggggctggtgcaaggctgccctgggaggcaggcagcctcacatctgcctcactgtttttcagggattccacacactccatccagtttcaagaggaatagaaataaactccatgtcttgatggggaatggaaaggcactggaagagcacatggaaacagaaatattactgtggtcatttctggatgatataatttaccacatctgccctctggccactacaacttaatggcagtcttcccacttgcaacactcactcatctgctcttcaaaatttcatctcattattgctcaaggcgaagatccagcacagatgcaggtgtggccaaggcttctcaaaaggcttctcacattggaattcttgagtactgcccctctggtgctgaaagaagctatgagctgaattgcatttcaccaaaattcatacatcacagccctaacccctagtacctcagactgtgactgtattacaagatacggcctttcaaggtgtgattaagattaaatgaggttcttaaagtgggccctaatccaatcagagtggtgtctgacctgaggaaatttggacatacaaaagaatagcaggggtgcacaaacccagggacaggccatgtgaggacacagggagaagcaagccaaggggaggccttgatagaaaccagacctgctgataccttaatcttggacttctagcctccagaactctgagacaatcaatttctgttggttgagccacccagcctgtgttacttttctaatgacagcccagaaaaagaatacagatttgaatcaaagagataagttatccccttctcttctgtaccttttatacaatggtggaacaggcacagaatagacatgacaggccctcctgttcagtaacagggaatgctggagactcacagcaattactagcccatagatattctgaaagctggcaaggtgcatgtctattccttgcctgaggctctgttttagtgcctgcgagtggtccacctgcttcctggctctgccctctaggatcctggctctgccttctagaaccctactctgccctcttgaatctttactctgtcttctgcatttatggccctgccccataaggtcttggctctgcactctgaatcatatttccactgtgccttacctgggaagataaaacatgtaaaacatatgttcctggttcatagggaggtgggtgtattatgcatatgttaaatcaactgccataattgcattaatctccactttatgctcatgattttctaattgatttatcaagatcaaacaaaaaataagcaatgactatagacgtttatcaatttttcagtatattttataccagttttctttttaaaatttcagtgttacattgtgatattcttttatctataaaagtctaaaattcaaattctgaaataatgcttttcctccaagtattctttttggttaatattctcaacctctctttcattttgactgcatttatctgatatcattttcaatgcagttaattttaaccatccttgctttagtttgacagtattattttaccaaatctaatagtgtttaatttcattaactgggtttagttatctctatcggtattatgtgaatatttgatcttctttcattcatgtcttaatttattaacatattatctggcaggatgacgggccataatgaagcaaaatggtattccaactgcccaaatacctatgacttacaggcatacgtcattttattgtgtttcactttattgcatttcaaagatgtttccttatttataaatcaaaggtttgtgacaacagtgcatcaagcaagttaatcaacaccattttcccaacagcatgtgctcatttcctgtctttgtaattgtcatgatatttcaaactatttcgttattattatatctgttatggggatctggaatccgtgatctttgatgttactggtgggattttttcaagtgccacaaactgtgcccgtatcagatggcaaacttaattgattcatgtagtgtgtctgctccaccaaccagccattcctctgtcttgctttctctcctggggcctccgtattccctgagacccaacaatattaaaattaagccaattaataactccacaatggcctcctagtgttcacgttaaaggaagccacgtttctccctttaaatcaaaagctagaaataattaagcttaatgagaaaggcatgtgaaaagctgaaataagctgaaagctaggcctcttgtgccaaacaacaaagttgtgaatgcaaagagaaagattttgaaggaaattaaaaatacttctccagtgaacacacaagaatcttaagaaaatggaagaaccttattgtggatatggagaaagcattagtgatctgtgtagaagatcaaaacagctacaacattcccttaagccaaaacctaattcacagcaaggccctaactctcttcagtaaagagaaggtatggctgaaggccgagagaggtatggaagctgcagaagagaaggttgaagtgagcagaagctggtcatgaggtttaaggaaagaagtcatcttcacaacataaaagtgcagggtaaagcagcaaatgctgatgtagaagctgcagcaagttatccagaagatctaaataagatcattgatgaaggtgggtacaataaataacagattttcaatgtaggcaaaacagccttaaattagaagatgccatttaggactttctcaaatagagaggagaagctaatatctggcttcaaagcttcaaaagacacaggctgactctcttgttaggagctaatgcagcttgtgacttcagttaaaaccaatgcttgtttaccattttttaaatcctagggctcttaagaatcatgctaagtcaactctgcctgtgctcaagaaatgaaaaaacaaatcctgagtagcagcacatttgtttgtagcattatttactgaatatcggaagcccactatttagacccattgctcaaaaataaaacaaaacaaaacattactttcaaaatattactgctcattgacaatgaacttgatcacccaaaagctctgatggaaacctgcaacaggattagcattgttttcatgcctgctaacacagtatctattccgcagtccattagaccaatgagtagttttatctttcaagtccaattatttatgaaatacatttattaatgctacagctgccaagataatgattcctccaatggatctgggaaaagtaagttgaaaaccttctgaaaaggattcaccattctagatgccattaagaacatttatctttttatctcctgagctattctagtggttgatccatagtaggtgttcaactaatatttactcctcattcattcattgcaagaaagtatgacgttatgagtctttcaaggaactttcaattcaattgcatgggtaagacatacgtacttaaatattcacatatatactttaaatagagttgtggggaaataacaaatttccgggtttcccagtgggcctgttaagagcccagccctcatgagtcatgaaaatatatatgatataatgttacaggatgtttgctttcacttccccaagaaacatttttacatactgtaaggttgagatctatagccaatgtttctttaatgatgcagttaattgctctgattgaaaaggatgataaaacttccttcatctccccaaaagccaactgagtacatcctgggataggtacctaggttagttaccaaggaggcagtgagactggagtcttatctctctaagtatttgcatttccaaaagaaatagcaactcagagaacccagagacatctccatgccttacaggtcagaaatgggaatgaggggtggttgagtggttatctggcccttggaaggcatattttcattccagaatgtgaaggtaggatcccaggatgctcctcatcccatctcaacagtgcaactggattctgtccctgcacccacccccactacccgctcctttctggagttggagggaaatgactaatgtatgttatatgtctctctcttacatgtgaatagagaaaatccattttctccatgacttgtgtatagctttccagctactcatataagtcatttgacctggctttaatttggtcaccgcaaggagtaaggtctgaggaaagcaggaccaatgcacttaatatttaatgtaggatgataaatcagaaatcccttccttgattcagaatactttctatgttcattcagaataaaactaataaagatgactatttaaaaccttgcaagcatatgacccataatgaatgtgacaagtaaagtataataacactgtatagacttaagacaagctgttcttacactgatttttccccttctagggaaggaatgtaaacagaaaaggcaaatgctttgtatttccatcatcatgtctattttatggacacaaggtctagtttaagttttgcctttcaataaccctgctgggctgggactttgtaagaagacatttcagtatatactcatacatgcatatgattacaacagcctaccctgtagattttattctaatttaaatctcataataaggattgcttaactgttataagtatgacgtgaaagaagacattttgtatcttcaagaatatgaagaatccccaacattaagaggtttactggccactaagtcaatggacgtactatttgtcttaaccagccaaatatcttactatatgatgaatacattgtccctaggtttcatatgtgaaaagttcacttttgttagaagaataagaaaatattttatgtattcaacacttaacaaattgtctgtggggacctatcatgttttgggaattgtgctaggtgctaagtgatgggagtctacacaggggtaagacataattctgcttcaaagattccatagtctagtaggacaaatttgcaaggaaagttagttttttaatctatatattttctttttttaattatactttaagttctagggtacatgtgcacaatgtgcaggtttgttacagaggtatacatgatctatatattttctatgtttttttaatctctccttattttttcagtgaaattaattttgttgaaaccagacctgtttggcagagtttctcagtttggattttgctagctgcacctctatgttattcttttttttacatatttacattgtctttgtatgttgtgtaaatgagtattcagttctagaggtccagtgagattcaggtctagtgtatgcttgagttttggaaaggcactttgctgtgatgctatgggattctttcataaggcatgccatgttcccttgtccccttgagaagtgacagtgtgctggcagccctcgcagccctcacttgctctcagcacctcctctgcctgggctcccactttggcggcacttgaggagcccttcagccaactgctgcactgtgggagcccctttctgggctggccaaggtaggagccggctccctcagtttgcagggaggtgtggagtgagaggcgcgagccggaaccagggctgcaccgcgtgcttatgggccagctggagttctgggtgggcgtgggcttggcggccccacactcagagcggccagccaggcctgccggccgggcaatgaggggcttagcaccctggccagcggctgcagagggtgcattgggtcccccagcagcgccggctcacgggcgctgtgctcgatttctcgctggtccttagctgcctcctcagggtcagggctctggacctgcagcccgccatgcctgagcctccctgcccccaccccgtgggctcctgtgcagcccgagcctccctgacgagtgccgccccctgctccaccggagcccagtcccaccgaccacccaagggctgaggagtgtgggcgcactgcaggggactggcaggcagctccacctgtggccctggtgcgggatccactgggtgaagccagctgggctcctgagtctggtggggacttcaagaacctttatgtctagctaagggattgtaaatacaccaatgggcactctgtatctagttcaaagtttgcaaacacaccaatcagcaccctgtgtctagctcagggtttgtgaatgcaccaatccacactctatatctagctactctggtggggacttggagaacctttatgtctagctaagggattgtaaatacaccaatcggcactctgtatctagctcaaggtttgtaaacacaccaatcagcaccctgtgtctagctcagggtttgtgaatgcaccaatccacactctgtatctagctactctggtggggacttggagaacctttatgtcaacactctgtatctagctaatctagcagggatgtgaagaacttttgtgtctagctcagggattgtaaacgcaccaatcagcaccctgtcaaaacggaccaatcagctctctgtaaaatggaccaatcagcaggatgtgggtggggccagataagagaatgaaagcaggccgcccaaaccagcagtggcaacccgtaggtccccttggaggctgtggaagctttgttctttcgctctttgcaataaatcttgttggtgctcactctttgggtccacactgcctttaagaactgtaacactcactgcgagggtctgcagcttcattcttgaagtcagtgagaccaagaacccaccaattccggacacacccttacatggtgttggcaggtattggtgatgactacctagacccatttcttattaaggatgcctgtgttgctcttctgattttgtcagttgttctcgtgtattcagtagaattagggtgttggagtttcttctcaagttgtgggagtttcagtgcaaaactggcaaagtcccgaaaaaccaggacaagttgggtactttgatggaacacttctacacacagaacgtcccttcactcaccatttggctacacaggtgtacagtttatacaggaaaggcgctcaagtagttttgacagaaatgatgaatgctacccttggagctttctagataatttgcctttagaaacattgtgtttatctcatttgattaatgtactttctttttatttttacatttttgcttttgatcatgtataatttcctaatggactttagtcaagcattcattgagatgttcttgaaataaataggctactacatggaaatatcacagtaaaacacacatgctggagtaaaaaactgaagagaaaatagtaaaaataagaaaaatatcaacaattctaaaactgcattacaattttaaaactgaggagttacaaagagcagagaacagctgaaagtttccttttcaatatcaggatatgcctggtctgaaaactctggaaaataaattctggagtaattggctgattaaggagattcttaaaaagttgtggctaaagtttgggaagttacttgatgatctttggtaactgggaaataaaactgaatttctgctgaattgggaaaaaatattggttcatatgaattaaaaataaatattgagaacctacaagttaaaagtactgtggtccttgagggaggagaggaaaaggaggaacatatcctgccatagagattttactgcttgtaattcagttgaatattaaaaagatggcacatgaagcataaccatgcttttctttgcaagtgagagtcatgtactcggagaactttgatctgaaacagacttcagtgatcttatttctagagatctcattttaggtattgtgaatcctatacccagaaaggtagacctaccgaaattaactgttaagggtaagtaaaattagataattagcttaagactggaaagcaattttcagaacagagttgaactaatgtgtccctgttttaattgattcttgaggaagggaactttaagtgctttctttgaactcctgggatcccccaggaagcacagttattcaaaacatctgacatcctccttatggtttttggttcgttctttctctttttttttttggacgtagtttcactcttgttgcccaggctggagtgcaatgaagcagtctcggctcactgcaacctccacctcccaggtacaagagattctcctgtcttagcctcccaagtagatcagattacaggcatgcgccaccacacctggctaatttttttatatttagtagaggcgggttttcaccatgttagtcaggctggtcatgaactcctgacctcaggtgatccacccgcctcagctttccaaagtgccaggattacaggtgtataccaggcttttggtcctttctgttctggtaattattcagtatagaagttaagacagctattaaacattttcagaagcagttgaaattctcttgccttgtcctacaatatttaggcttctcagaatgcctttattaaaagaacatttttcaaccattttggaagacagtgtgtcaattccttagggatctagaactagaaataccatttgacccagccatcccattactgggtatatacccaaaggattataaatcatgctgctatagagacacacacacacgtatgtttattgcagcactattcacaatagcaaagacttggaaccaaccctaatgtccctcaatgatagactggattaagaaaatgtggcacatatacaccatggaatactatgcagccataaaaagtgatgagttcatgtcctttgtagggacatggataaagctggaaaccatcattctgagcaaactatcgcaaggacaaaaaaccaaacgccagatgttctcactcatgggtgggaattgatcaatgagaacacatggacacaggaaggggaacatcacacactggggcctgtcatgaggtggggggaggggggagggatagcattaggagatatacctattgtaaatgacgagttaatgggtgcagcacaccaacatggcgcatgtatacatgtgtaacaaacctgaacgtagtgcacatgtaccctagaacttaaagtataataataaaaaaaagaacacttttagcattatcctactcactaaaattagcattgcaaatgtgcaggaatattttagtcttttttttcacaaatgcagaactcaccaatatcatgaaaaataagcatgccaccttgatgataccttgattcaagtcaatattccacttttatgagatatgacaagtgagtttgggctttgctccatacaattcataagtcacatacgtaatgagcatttatttgagctacgttgagcctgtcctgtgtgtggtgtgcttttatgttgtttccccacaatgggccaaggccagaaaccatttcttttcattcatacaaggtcaagttcaaccacaaaacccacactcattatggtagcaggaatggtgctttaaataaaaatgtgaaagagtgaagaattgatcaacgaagactgcaggccatccaggaaggcaagggtgaaggatttattcttcagcaacaaatcacatgcttctaagtgttcagtattttaactggtctcaaaagaatctcatggtgtttcaaaaggactaattgatagtttgtacctggctctcaggtgaggaagagacatgagccctcagcagggagtttccctatctagaaagggcagaccagtgaactattcacttgattatctccaaagcaggactttccatttcagagagctctgtgccttcttgtccatatccagaaagctcagccagcctgttctttctgcattcctgctgatggaaaccccagttgttctttattagctgttactaaaagtcttgactttcccttcatcacaaaggtgtaaaagttacaaacaattctttatgtctggagcaaatagtcacagatctacctttttattaaaaggtgctattgactctgtgcaaactaaagcatggtcaatctttctttaaattagagtctatcaaaaatctttgcaacatcatcacatagagttggaaatactctatgtaaagtatttttttccattttttgtactagattttaggccttttttggtatgggataacattttctatatattgtattatcattgaatcttgcgtgtagtagttaaaattaattagctacaattatgtattgtttcatgttgccctaaaagcaggaaaatcttacatcctgagagctgacattattgtctcttctgttatattagttttttttattgtcttataacaaattaccacaaatgtaatggcttaaaacagcatgtgttattctctctcagtttccacgtgtaaggagtccaagcacagctcaggtgggtctgcaggtcaggatctcacacggctgcagtcaagatgtcagccaggctgtgcttctttctggagcctgggtcttcttccaggctcacgtagctaaggcagaactcagctgcttgcagtggctggactgaattccccattttctttctaactaaaagtaataaaattaaaggtgaaataggcatacagaactgtgtcatctgactgtcttaaattagagcacaaatttgatactactaaatttcctgaaagctgaaggatatagggaaatgtagttagatttgagatgcacgtgtcttttaagaaaagaaaactcaccatccttgagaagcgtgcattgtttcagtcaaggaagcctgagttcggggaggtgtggaaggctattttaaatgcaagtctgtttacttttcactcctacactatttccttaaaacattctgcctgtcagagaattgtagttcaaatattttattttacaaataaagcaactgagaaaaaattaagccaagcagctatgtagtgaaacacttggaaattaaataattaattaattaaataaattaaatagtcattcactgattttttcattaattaaattgccacctccaatcgaaatgacaggcatatatttctaatttatgatatactatgaccagatgttatttactgaaaaatagaaaattgagatttgtaagatctcctaatgttctcctaccacccctgcctaaatttgataattatgttagtatttttgggtgaaatggcacttttaagttgtgaacttctttatatattcaacatgctttactatagaaaggatacatgaaaggcgaaattgatgaaccttttcaggttcaaaaaatatttttgttctgccttaacatttgaatgattggttgaaaatgttttgctccagaactttgaagatgttgtctcagtatcttctgtcatcagttgctgctgctgagaaatgtgatgctcaaaattttaaaatttatgcaagaatcagctgtgggatttgacctaagtctgtgagattcctatggtataagaggaaagaggatttcattttaagacaataaaaccctcatttttagcttcaactatcccaacagtacatttaatctgttcattgagaaagcttctgattctttgctgtgagcttaccgtggcttttagactgagctgattccagtctctgtgtgtgactgattgttctgagcaccagatccttctgagtggcagggagttcgttcacaacaccccatgtaatattgtcacagctcatagtaggctctggctttttctgctgcccaaatcctgtacttcctttttttgtttgtttttgttttttgtctgtctttcagcattttggggatggcccttgcaattctgattttccatccatgtgcagttttaactcggtgggtttgtttttttcaatacatttatgtcagtggggtctatagagggatagaagtcaaatatgtactgagttcaccatcttgacaggagccattcaagtcatttttgccaaacgacttgattcagcttcccagggaaggggttcaagcctctcttaacctgggtttcccatctcccttcaggattcctaatagagaagtatgagtcagggtgcctcacagtactgttgtggacagaaccagggatttagggcccaaaggcaaggttcaatgttgccatagaaataaatggcagtgttctattgagcaaatgctctatactctttgtcttagtccatttgtgctgctataacaaaatatctgaaactaggtaaattgtaaaggacagaaatttatttcatacagttctggagtctgggaagcccaagatcaagatgccggcatccgctgtctggtaaggaagggccttcttgctctgtcctcccatggcagaaagtggaaaggcaaaaagggacaatctctctttttcaagtcctttttttaagggcctctaatcccattcatgaaggaggaaggaggaaccctcatgacctaattacctcttaaaggccccacctcccattatatgggccattcagtttcaacacctgaatttcagagggtacccattcaaaccatagcattttttagtctgattctttatcttcataatgtagaaataactcattgggattcatggagacagattgtacagtgctggactcactgctgcttctcaaaaatccaacaacctcagcgtgacttttgggcctcaatgagctggacatgggttctgtttttccagtcttagggaatgcgtaactggaagggcttcacacttgtgttatatccaaaattgcctttgggccttagcacatgaactttttttctctccctggttggccttccctccgtggtttgcctgagaaactgcccttccttcaggagctggcttcacctccctcctgctcatttcccacgtcagccatactccttggtgtggagttgctccttcccctcagtcaccagggctctgcaaatgaggttgtgcttctccctggggtctccccctccacgactctcagagggcagcagtccagtcttctacatccctgtattcccacagtggggactatcctgccatgtagaagttaatcaacaattgccaagtccaactggatggaaacaaaagaacaggtttacacattgtttctgcgacgtgctttacagtatggttttattatgccactgaggtgatatgaattataaaagcagcagacacagttccaaattaagttcaaaatcacattctaaaatcaatacaagtgtccttggcatgtgggaattattatcactactcttcctgttaccaagatgaatagattttatattatattaacatcattctctgtgcagtaagactggacttcaaaggaaatggaccagccttgatactgaagcaggtttaatgttgtcagcttttgattatccttgtcagcacattcatgtttatctgttttccagaatgactttctcatgtcacctagaatatttctcagtagactgataactgcttagtggtgtgcctttaaagaatataaagtaattttatcttgtgttactttacaaatgatgaaataagcttcataagaaaaaaatactcatgggaggaaatctaatgtcacctgtaaataactgctagatgatcctggccagcatttcttgtcaataatccagatgacagatatttgattgtgtctccgttgagtgcatatgtaattagaagttttatttgttttccctttttgtgtttttttttactatttccttcttattttttaaaaatccaagtcccagcttatccataaagtccctttccagccactctgacataatgtgaatctcttccaaatattgattgtgtcccaccatgtggcaggctctgtgctgggtgctaggaatactgtgctgaacagctgggagcaaggtttctctcgggaacccataggctcttttcagaagcaccttgaactttatcggagtgaaaggtaaagaaacatcaaatagttttgccatacaaatgtactcctggatagttttcagtttgtttgcaagaacgctcacactcctacatctgctcagtattcattagagtaagtttttgtttttaacttcattaactaatggaggatacaagcaaaggtcaggaccaatgagttccatgtgtcctcaggaaaccctgaaggacagcatatgggaaccagtttgatatttggccttgacacactaaaggagaaaatcacataaagtgggatggatggccttggacacaattagtccaggaccgcagttatatttcaatatttcagataagtttgcaatggtttagaccttgaacaattttgactcaataacactatgcacaactttcataacaatttcatttcaagaagtgtctaatgattatctggataattttcataactataaattaccaaatgactgatgaaagtattaaaaaaatttacttttaacagtacagggattaatgctgtaatttttttacagatttcaaatgtagccaataaattagaatcttgtactaagaaaaattaccactttcaatgcagatatggtaatgttttaaggcttgatgaactattcaagttcagaccatcatcaagtgtgacaataaaacactttcatacttgaaattgtcatttcttattgttccatgtaagttaacgcacggtttgatactcctttgtttctcaatgttatgggagacatgcatactggtattctgtgcctgaaaatatggccttgctggcacctagttgctgatcatctaaagacaaatcatactgtgtggcaatgacaggcgacagcaaatgtttctgccttccagaaccagaatattctctgtctccttgtgcctttgctgtcataactgaagctgtcaaccagttctttccttaggtagatgcacataaaaatttcccaaaataggcatgccatttattctgctttgtgctcagtcttcctctgagttcagctccttagtccacaaaaccactccccatgtgacagggtctccacatttaccacatttatgccttatagacttctcagcccacaggcttcactctgtaccctgctgtattcaccagcatgtatttgacatctgaaccaaggctggaatttatcttgctctatacagtctactttctgggactgcccattgtaaaccgctggcatttaagtgtcctgaatttgctggccttgcactataaaacaatataaccctggcttagctccaatttttgcatctctgttttccttgttgttcccaatgtgataatatttttcaataaaatttgctttgagcaagttttgtatcagtgatagcagtaacagtttgaatcttaaggagattttggaaatctgtctaaaatatgccactgacttgacagtgaaaataaatgaaagatactttaaatgcgtgaaagaaattctagttgtctatcagcttctctcaatctcaactctttaaaaatcatctttcagcacaatgtggataaattttaaggtagaaaactttaaggataaagattaatactatttcaaagtatttttctggttctgctttctgtttgcatctttcaatacttatttcacatttaagcttctagttttccattctctttttattttttcactgtgatgcctttctttcttttttccacatgagtgtgttacagatttttctaaccacattagtgcacaactaacttactaaaatcttcatgttaaaaagaaaagaacaagtttcttagaaatgcaggcctttctgtagaagagtgaggataaattaatgagtgactcaattctaattttcagtgaatgggataatcaacacctcttattaactggtctaacagttcatgcagacccacacgagatcagatagatcatcatcactacaaatcattgtgttcctatgatcaaactaaatagtgcttcctaggatcaaactaaattaggcaacaaacttcgcagtgaattacatgtacaaatgggagtgacaatgaaacccacccccatttccaaaatattttcttgatgactagtagtcatgtggattgctcagcatgtattgataatccagttctctatcaacatctggcagatcatgtgttttaaaaatgtttttctttttgggttttcttttgtcttggggaactgtagttataagtcttgccattgtgacctcctagaaagtgtgggtgggttatcactaatatcttctaacacatttaaatacaaccatgcatcacttaaggacagggatacattctgagaaatgtgtcattaggggatcttgctgttgtgccaatatcagtgtatttaccacatacttgggagttataaactatgacacacctacactacatgggatagcctattggtcttaggctacatgcctccacagcacattactatattaaaacttgcaggcaattgtaacagcacagtatttatatctccaaacatatctaaacatggaaaaggtacagtaaaagtatggcataaaagataaaaaatggtacacctatatagagcacttatgatgaatggagcttgcaggactataatttcagtatagaagttgctgtgcacgagtcagtgagtgagtggtaagtgaatatgaaggcctaggacattactatacactactgtagacttttaaatgctggacacaggctacacaaatttatttttaaaatttctttaataaaaaccttatcttactgtaatttttcacttaaacttttaatgatttgctgttttttaactcttttgtaatagcttttagcttaaaacacaaacatttacaactgtacaaaaatattttctttcatatatccttgttctataagcttttttctattttattttttgaattttaacttttttgctttttaaaatagtttgttggaaactaatacccaaagacacatgctagcctaggcctgcacagggtcagaatcatcaatatcactgtcttccacctcctcttgtcccactggaaagtcttcaggggcattaacagccatggaactctcatctcccatggtaatgatgccttcttctgaatacctctggaaggatgtgcctgaagctcttcttgaggaggagtcacatttttagaaatatgtccatgatggtttgcttctttttttcattatagacttgtttataaacaggtaaagcatcataagcattcctctgtattaatgaaaacctttagatgttgggatctatggtttcaaaccttttgtttgcttgtttgtttagagataggatctctctaggctgcccagacgggactcaaagtcgctgggattacaggtgcatgccacaacacccagctcaaacattctaaggagcatcttgaggtctgcagaatcttctgctaaacccttcattgtgaattttttttgggggaggtcactgggcaatagaaatttttcagttcctttataatcttacgggaccacttaacatgaacctaggagttataagctattacacatctaggctacatgagatagtctattgttcttaggctacacacctgtacagcacattactatactaaaacttgaaggtaattgcaacactatagtaagtatttgtatctccaaacatatttcagcatagaaaaatacagtaaaagtgtagtaaaaatatgatacaaaagattaaaaatggcacacctatatagagcactcatgctgagcagagtttgcaggactagaagtggcaatggatgagtcagtgagtgaacatctctatgtagcacctgtctgtgatactttcttgttttcttatttacccccaaatgtgcttcctgccctatgtttccagtgtctttccaattatatttgtatagaaaatcacctcaggactatggattttgtaagccagggaagggcttgctacattttattgtcccctcattgagttcacttctcattctgaccaatgctggatgtcacagtcttgactaattagacccttgactgagaatgaagataaccagtatatcttccagtgcggtaccaaagaaggggacagtagcagtaaacatatacacaaaacaaaacagtgaaattatgttcaataaactaacgctgtagctttgacctggaaaatgaattttttgaggagtaagtcttctaatgagggaagggagaagtattggacacttcaaagaatacttctttaatatctaaagttgattttcctctcatccacttgtaacatgcttcattataaagatagtcttttttttttactaaaaatatataggaatgatttagcactctaattttcttcagatgagcaaactaaatccctttaaaattattccaccaagatcacatagatattaagtagtcactgtaaggctagaatttagtattctctttccctggttatttttactatatggaagctacttatgtttattaggattttaggttagagtcttatgtatagcaggtgataatttatatcaggtgctatgctttgttatatatggtgagttttatgggaagtatactttactctgggtgttaaataaggcttcacaaagacacataagattgatataaatttaaaatgtgaaagcaaaacatgaatgggccatataactatcactgaaatctactgaagatctcatcttccttagtaaacacagacaactgaattgccaatagatgattgccctgtgggaagagaaaggatggaaaatgaaactcatggcctcttcctttctttagccctatcaggacatagcagaacttaaaaaaaagaaagaaattcttattttgtttgttttatatttatttttaaggctaaataatggtctttttttcaaccccagtggtaaagcctagagaaacttctaaccagatttagcgactaaatcatcgacactttagtcaatcttttacctagtcactcaaccaatatttatgaagaaactatcaagtgccaagcatttttccaggagcggaaaataaacaagtatgatccctgccttacctgaatttacatcccctctccataactctttttttgatagtgcaaaggtggtgaatctgggaggtaacagttgtggcctatgtgcaggtagtggcagtggtggccgaaggtgcagagcggggttagagcctgcaagctgatctagggaactgctggtcattgcaatcaggcttttgcctttacaattggactttgtccctgaagcttgtgttggggaaaatcacttcagggtgtgtgtatgtgtgtgtgtgtgtaataacttttagatcctcagttgtgaagtgactagtgaggaaacgagaaattcacagaattgtaagacatattggattttgattatgcataaatattaagcatgtgacatctttttttattagattgaatacaaacacttttttttctgtaagaggacttgcaagttatatgctattatatgtttaagaagatgcagccattttaagagtttttgtaggtctaaataaactcaactgtctctggatacaattcctttggtaagagagatttggagaatctctcataggcatttgaatactggtctacccaaggatagccttctctctaaaggttcacaggactcagaaaaacagtttacctattagattactggcttaacataaaagggtgcaactcagaaaagccagatggcagagatacacgcctcaggcatggaggaaggggtttggagcttcatgccctgcccatatgcaccaatccctgaggccctccctatgacaccaacctggaagctctcagaatccctttgattagggatttttagggaagttccattacatagacaatagatcatatcatcggccattggtgattaattcagtctccagtccctcttgccttcctagaggttggggaattggggttgaaagttccagtcccttaatccatagttcccctggcaagccacacccgctgcttagaggttttctgaaagccactgcaataacataaactcaggtgtggttgaaaggcacttgtcatgaatgatgaaagacactcctttcacctttatcactcttatcacttagcaaattacaagggttttaggcagtctacccaggaacctgggactaagaccaaatacggatttctatgacatcgtaatttcacacacttactgtcatgggctctttttctttctttttctttcatgacggtttatgtatattctgggaataaatagagaaatgggtgagaacaactttagtttatgtgtttttctttaggattctatatcgtatatcttaaaatgcttatatcatagcattttctctgagacataacaccattgcattaattacagcacctctcattattatattggctgtaaaaagggttaatatgaataattcattcatattcaagatcaatacctccatctgctttcctataggccttgaattttcataaaaaatatttaaaaatacattatattcaattatattttactcagcatttttaggtcagcaaactatttcttgttcttttttattgcagtaatcatttaaatcagtttttgacttcttacaaatcacaaaaattaatagtaattatgtgttttggaaaaagctgagtttaaaataatataattttattttttcaaacagaaaaaatcatttaaggctttttgcaaaaccataacaaatgttctttttactactgctactattacaaatgcttccactatccattctcataatttctatttattaagcagttattttgtccttgtgctgagtaccttacatatactacaaatctacttgatttctcaaattttagagttcatgtgagagtcaattaatttccataagtttaattgcttctatatgagtagtcagagaaaaattcgagtggaaaaacaagagatcaaaaagacatctaaaactagatttctagaagttgtattcattgatttttctcttcaatgtctttaatttttgatggtgtcattgtagcttgtgtacaaagagacatggtgagataattactgaaatagacctctaaggcaaaagcaaaccaaatgcagagtgaaaacatggttagatgaatttacttttatgtttgtcatttattaatatagcttttaactccacgtaatatacaaatatgtttatttgaatttgaatatatatacattgactatatgtatttataaactttccctttgaaatttgctagtcaaataataagaaaatttctgatatatctgatctaaagtatttaggaaagaattgtataaaatcaaagattttttttaaatcttgcagaaataaatgtataaatgtttttgttttaattatatctagactatgagcttaggagaatggatacagcaaattgaaattcagttctttggccaatttcctttaaaatttattgtgttcttattacaatagactgattattttatggtatcttcttaattataagtgttgattaagaactcttataaccacaaattacgagtggtaaagacaattgttcttgcttattcattttaaaatgcataaaatattttaaaagcttattagtctgtaattgctaacataaattattttgaaagctttattttgcaaaatgttgcaaaactgcatctagattggattctgggcagctgacataaaagcaattttctaaccatttcctacttttctaaaataaccagttgactgtattttaaacacccaaattaattggcatgcctattattttctaacaaacaatttatcacctgagtatttgaggaatatagaacttttatcatgctatattgaaaatatccagtgaacaagagaatgagaactagagtccatccaaagcatgaaacattgggatctgtgtaataaagtcaacgcacaactataacattgccaagacatgcttgtaggacctctgcatgttagagccagaaaggaacatagctcaatgcttgcagatgactaaatcaatcagtatcaggaactactacatggttgcgcccaagatcacagagtgagtcagcacagaactgcatctttacccaatagcctttttactacgctgtgcagttacgtttaaattggtatttttcaaagtgtagtccttgactatctttatcagaaatcataaccatgtccatgaccatcttaatcagaaattcataacaagcccctttcaaccataaccatgttcatgaaaaattcataatcctgagtttttccctaaatttactgaatcagattgaggtttgggaatgtataatagggatctacattgaaaataagcactatgtaattgattcttccgtactggtttttaaataataatatatgtctatatgattttatatatatattattttgtaataatataggcctatattattttatatatattttatataatatataatatacttactatttgcatatatatgtgaatacatatattttatatataatatagtattatttaagaaccaatatggaagatataatactataataaaatatattatatataatatatataccattatatagtataggcctatattatatatattatagtattttatcttccatattggttcttaaataatactatataatatagtataggtctatactatataatatataatatagtatactataaggacgcaaatagtaaggagtagtaaaatacagatttaaggaatcatctgttttgtctgcatcattggtaagactaacaccatcaaagagatctcaacagcaatagcatggagtcctagaacccaccccagagttgatgataattgttctgatgtgagcataggtgattctaagagaatatttggaaaacattcatttatataatagagtgttgtttcctttaccaagtagatcagcttggtatttaaaattcatagttcatttcttacatgtattctttaaatgttagaaatttgaaactttgattttagtctcttgaccaccaagaagtctaccaaagtctatgacatttcctagttcacaatattagaaagaaaatagtcatataattcattaaattcccacagtaaaattagctaacaccagattaattttatttaattctatgttagaatgctgaattgcagccactaacaaaatatatacattagattttaaccctgcatataaaatttattattttttattttttatgttagtgagagaaatatgtgtttacttacatagtctttcagaatattactatttttgataatgactcagttgaaaatacagcaaaatgtacttactttaacaactgattatactaatgtagaatcatttccaattcttatttgttacattttgctaaagtataaactcattcaatcatgaaactgtatcaggatataatatctagtaattacctgtgattgttaattttttgtgtccacttgaatgtgccactgggtgctcaaatatacttggtcaaccattgtattgtatacacacacacacacacgcacacatgcaccctactggttttgcttctctggaaactcctgagcaacactgcactgattttggtaccaggaagtggactgctgctataactaatacctaaaaatgtggacctggcttggccttggcttgggaactgggcaatagggtagaggttggctgagttttgaggtacagactagaaaaagcccgaatttctacgaagggactattggtagaaacgtggacattaaaggcaattctggtaagggatcgggaggaaaagaggagagctgtagagagggcttcactcttcttagaaaataaataatcatgaataatcaaaatagaatgtttgtggaaatatagacgttaaatattctgagaaggtctcagatggaaatgagaacaggccactgtaagctggaggaaaaatggttcttgttatatagtggcaaatatcttggttgcattttgttccaatgttttgagaaaaatagcacttataagtgatacacttggctatttaccagatacaatttttaagcaaagtgttgaaagtatggcttgggtcctccttaaggcaatacaataggaaaaatatggattaaagaaggatttgttaagcaaaaagacccaggacaaggagatttagaaatttctcagcttatctataatgcaaaaactggagaagtctgttctggagacaacactaagagtgcaactgaatcaccctttgctaaagagataatgggggtgacccatcagcttaatcagccatatcagcagaagccaggaacagcaaatggattacaccatcaaagatccggcccgtttgaactgaagaggatagggggagcaggacagattaaggaaaagctgtcagacttcttggattctataggaccgtctggtcctatagaatccatagagctgttaaccaaatggttggggttgtcctacaccctccttaacaggatatggaaacaaagaggttcttcttcagacttcagatttaatgaaattgcccttgctaggttttctgctttcatgggaatcatcacttccttttttaatttagatttttccattttgaaaagaaaatatctatcctatgcctctcccattattgtattttggagacacataacttgtccgtttcacaggctcagcgctggaggggaattttggctcatgatgaattgtacctcaagtctcattcatatcttagttagatgattttagtatgagactttggcctttaacctttagagttaatgctggaataagttaagaatttgggggctactggaatgggatgaatgtattttgcatgtgataagaacatggatttgggggaaccaagggaagaattctatgagctgaactgtgatgtccttccaaaatgcatatattgaagccctaacccctaatgtgactgtatttcatggtagggactttgggaggtatcaaagtgaaatgatgccataagaatagcatcttcatttcataatattggtgtcctttaagaaaagaaaaagaggctgggcacggtggctaacgcctgtaatcccagcaacttgggaggccaaggcaggtggatcacatgaggttgagagttcgagacgagcctgaccaacatggggaaaccccatctctactgaaaatacaaaattagccaggggtggtagtgcatgcctgtaatcccagctacttgggaggctgaggcaggaaaatcgcttgaacccaggaggcagaggttgcagtgagctaagattgcatcattgcaccccagcctgggcaacaagagcaaaactccgtcccaaaaagaaaaaaaaaaaagaaaagaaacagaaaccagagctagctcattatctaccaagtgaggacacagccagaaggttgctgtctgcaagccaggaagagagaccacaccagaaaccaaagcccactggaacttgatcttggacttccagcctccagaactgtgagtgatacatttttgttgttttcttcacccagtttatggtatttattatggcagcccaaactgactcgatgccaagtgtcattctagggaaagagacttttaagaatgaattttctgagttggttctgaagtatctggaattggctctttaatctgattgggtttaaagatgccaatgactctatttctaatattccatggtgtctatattccatggtgtgatctggccatagagatatgcagaatatcaccattggacactcctaatcaaccatttataagaagcaaggatctgagtactatgtatatacatttgagcatttttggcaaactaatgaatataatgagattggctggcagctcctaactcactgcacaaagtgagaaaataaaaggatgagttcaggaattcaaattccaagctcaagggctacataaatgacatgaaagattctgggcgtgctatgaaggagctcttttttcctgtagccataaggctgagattgttaaaaatcaggtgcagaataccactctgcgactggctgaatcaaaatgcaacttgaactcccagcctgttgaactatctgctacagtgagggcattgattggtaaggaatgggatcttgaaagtcagaatgggaacgaccctgtgggaagaccctgatgagtatgggcacaatgagccagtaaattggaatgactcatttttgccagtagaggaggcttctccattttcagtggagagtaggagcagcgctccattttcagggcttcagtgggagcagcctccccacctgcaatgatagtagtctcctcgccctttcacccctgtctgaaggacttaaccttacattgcctgaaaaacctataatggcctccccaaaggcagttactaggcaaggtaatgccatttctctccagagccatccccacctccgctcctttcttccagacctataactagacccaagtcccagaagtcccctgaaggtgaagtacaaagtatgacccatgaggaggtgcactacactccacaagcacttgaattttctaatttatacaagcagaattccgaggaatatatatgtgaatggatactaagagtatggattaagaatgaaaggaaaataaaagttggatcaggccgaatttattgctatgatctccctaagctgagattctattagggaggattttaataatttgtttaataggataataattttttgataggataattgaaacatgaacttaaatgtggcctaatgtgaccaagttagaaatgctagactggcctttggaggcttctataggtgaaccacagcatgggtctttatgattttggagaaaagcccagccattcactcaagataactattttcttttgagaatcagctattggcctactactggatctcagaaaagactgaatgcttaaccattggtcaccacgttattatgtggcgtgagctgcccatcattaactggatgttatctgactcactaagccataaagtcgggtgtgcacagcagtactccatcatccaataaataagtcatcaggcctcagcaagccctgaaggcaaaaataagtcacatgaactagtggcccaaattcccatggaccccattccagctaccatggcttctccctcccagcatattcatatggctcctgccaagttcactgtgatcagttggcagggaaagagaagtctctaacctggtgtgcagatgattctgatgttgttgggtgaagtgttcagtatatgtttattaagtcacattggtgtagagtgttgttcagcccctttgttttcttattgattctctgtctcactgacctaccactactaaaaaggcaattttttaggtcttttactattattgtgttaatatctatttctaacataaattctgtcaaggttttattcatatatttgagtgctctaatgttagctgcctatatatttataattattacatcacatcttcctggtgaattgacccttttatcgttacatcatgtcctacttcgtgtcttctgaccatttttaacttaaaatcaattttgtgtaagtatagctacccctgctccctttggctaccatttgtctagagtatcttttcctatttttttactgtcaggcttatatcaaaaaataaatctcctgtagacggcatgtagttggatcttgttttttaatccattcagccactctgtcttttgattagggagtttaatccacttacatttacagtaattactaataggaaagaacttaccattgccatttcgttattgtttttgtgtgtcttatagttatttcattactttttatttctcaactcttttcatttttcatccttttttatttttcatttatagttatcttatcccatgtcaacttttcctctctagctgctttcatttgtgtttcattgatctttctctgtgtgtgtgtgtgtgtggtggcatgctttgattcctttgccattttattttatgcatcttctatagttattttttttcgggttaccatggatctaacataaaatatcttatataatatattttaaattgataacaacttaacttcaattacttacaaaacctactcctttacatctcttcctgtttcttgtccccatgtacataccatatattgttacgctagtgtctctgtggtagaagaagttctggtatttcctattctgccatcttcctgatactttgcatctttctttatttaaaatgggcaaatatgcattttaattattacttcctattatgtataagtcacatactcaagagatggtcataatttaactttatataattttattaaatgtctgctgtgtgtcaagctcattgagaagctctggggattccaagaaatgaaagatacagctctgacattatgtaacaggatgggatgacaaataggaagaaaaaatcattaaaatccagtgtaaggatttcaataatgaaactcagtacgcagtgcagtctgaatagttgtttgtctctgtggagtcagatagtatatcccaagaaactgcatgccgggttgaattttaggaagtagactggatttcgtatacaaaaaataacctcaccattttgaactgaagagtttccaagagacagttggtaaacaaaacacctgctttagaagttatctgtgttatactgaaaaatattttctgtgtctctccatctgtccaagcagtataactatatttaaacatttagctattctgcatgtatataactgcattttacccactgactaaagaaattatctacagagaacagagggaggcaaaaatcaccaatgtaagtaaaaatttttccatgtgttaattacaaatcattccaatgtagcacttggtaaattctgttttgtaaagttttaatttttgtttatttgcttcataaagataaacaaattgtaattctttttggttagtgattattaaactcccagatcctcttatttaaggaatgcaaatatgttttcacgaaatacagaagttaatttaatgttatgagctcaaatatggtaggtcactgtttaaattgttgagtaaatctcacttgttaagtctagtgatcaggattttttcaaacagctctccatattaatttttcaagtgtgacaagagaattctaaattaattcttggtgatgtgtaagattgtataatgttaccatgtgattaaatggatatacatacctttgtaaaagtttattaagtagtaaaaaatgtacaatatgtgcctcagtttcctcaacctcacaatagataactatttttcaggattgttctgatgacagggaaacagtagatgggaaactcatttaagaagtgcagagtttaatctcacatgacagcttatacttttcattatggttaaatgtatattggaagatatatttgaagatatcaatatacttgcagctaaatattattttttctctaaagtgagatgttcttaattccatatctgttcatggtgacaataactgtgaagtcacctgggctatgttaaggctgactccacacctgttcgcatgccttagcattgtttgatcaccaggcccttttgtccaaggctcccaccaacacctttactccactgtgaatcctcgttcctgggccattacaggaatcatctcactcctcttacagattctagtcctgggatctctgatgtagcctacacaatttttttttatggatttaaatttatcttccccaaaattcatatgttgaagctatgtattagtgttgaaatgcttagcttgttagaagacctattttgatggtgaaggaccctgaacaaaacacatagccaatggcattctgccacaattttcactgtcttttaggtgtttgtgacctctctgtttgctgttaaaatcttaaattccctttaggcaaatcttcctggtgaattgacccttttagccttgctaatagtgtgatcaattgtagtttccttaatatgtaaacatccaattagttaaaatatcaaggttgctatttttggagtcctggaagaaagagcataataactaagtaaattctgtttaataaaactatataggcactttcgaatttagtcaatatcattcctgttactattttgtgaggtccagagactaatctcccttgcaggttgtaatgcatggtacatttttatatgggcagctcaactgttgtaaggcgcacaaaagatcttcattttctgtcctttctgttttcagcctcttcccagaccaggtacccagttcatagggacaattgggactgtagtaattagttagcttggtggtctttaaactttgctccgcagagctccaggcttcaagaagagtggcctaattttcactggaaaataaagtgaacttaagaaacctcagccttttttcatgcccaaatcaatgtgaactgctcagcatttatgtgtttttcatatttggcttctacacagcatttagatgaaacaaggcatctcatagctaaataaataaataaaattccctaggcaatttgatccttttttttagatcaaattggaagttggaaaactgttttaagttggaaacttgttttcacataaataaaaatgttttcatcgtgaagaaagaaagtcacaaactcactacctcaggcactgggaagtaaaattaaaaagtgaaggtgtaatgtgtcctggataaggaagaacttgctatccattaattgcagagtgaatgtctgccagagtaacatttaaacaacatgtgtctgcaggctagatttggtccttggtttgctgttggggatctctcctgtagaagattcttgaacatgcagggcaaaatagtgtgtttttaaacaacatcatttctgaaactctatgcatgctccttataaaatgagatgtttgcattactgacttttgtggacatagagccttgaatctatactctaatgtcatcagatggccttcaggcacatggttgggcacattagattctggtggatctggctggtgtgctggggcaatgggacatgcacaggaggacctgggggacaagctccagaactctacagagagccaagagtttgtacatggaacagatacgacttacagaggagccaagcagaagagacagtgattcagaagggctaaggtaaagaatcaagggcatggcagctgtgggaggggtgctgagcaattgtgagcatgagtgtgaatgaggtgagagtagatactccaggcagagggaaatgtttaggctgaatcacttaaaaaacatgtagtgtcaactttacaatcctagcctgtgcttgtttggggatattattcccatgtaaaaggagtcaggataagataagtcacaaaatcctctgataatacgatgaacatttggaattttatattactatgtggggaaaaatagtaaccctataggtccttggttggaattgacccccataacaaaagacagattaacaagagaaaaacaaacagaagtttattacatgtatgttttatatatgcatgggaggcacccagggaaggagtagctctgcaaggggagactttgagctccaggttatatagcaactttacgaagaacagtacatttttagagaagtgacaagaaaaaggaaaaggactttgaatctctatagatggcaattcaggggaaaggcaaataaatggtgaaggccggttagtaaaggtgttatctccaggctgaaagtctaaagatatttccagtgggtaaactttgttctcactggtagaaggagaaggcagggtatcttttgtctttgtaaatttacatcctacttttaggcaaatagagggagaaaaaagagctttcctgcgtctgctgcaccataattgtcttcagctcaacaaaccttcctatttgggggcaacatattctgatttccaacaactgtaactatacagattatacacatcctccacttcatatttataacaaaattggcaattactaaaacttgaaccagactcttgctattcagatttgaggtttacatgtcccagaatgggtaaaatattttcatatcatcttactgaggttttctttgcagcagtagtatttttcacttgcataatgataataattttgtgaaaaaaaatattacatctgcctattacctcatccttgaggaaaagtcagtgatgtatcattggataggaaaagggtattgagactcagatcgtttaagcaaatgattcagcaagtaagtaacccagccaatggtgaagcctcctgacttgcagcctgacacttaccatactgtgtcgtccactttcagagtcttcatcaaattgtatatattttttgcctgcttccatgaatcccaggacttcattttaatctatttcagaagtagattaaatatataatattatatatttaatattaataaattatatatatatatatatatatatatatagagagagagagagagagagagagagagaatagtgcttccccaagggtttgaaaacaatattaccttgccctgaagctctcctcatcttcaccttcttttgtcagttacacactttgatcagttgtcttgtgctctttacatgctgcatttagaacttcttttatcctcaagcctgaaagctaaaacttctggaaggtcaaaaggaagcagtgaaggattcaacctggcctgagtgttcccagactccggctcctgcctgggcatcatgagcccaggctcacaatgggtcggctttctgagtcagcttcataaaataataagcacatagaaaggaggctgctcttggggaattcgggaggtgtgtatttgaggagggtgagaaggacaattgaggtgaaattttgatgtaagtgagtttggctgaatttttgaaatggtaaaatctaggcactcaaaagcctgcaccttcataaattaaactttaggaaaggaagaaaaaaaatggaatgtgtagggacatgaatatttatacccatttatatatcctttgttggcttatttctgtgcacatgggaaagtttaacaacttcgtacataatttcaagttctttattcattttttagatttgaaggaggagaacaattttgcaaaatagggtattcttcagttttttggaaaacgttttatgtttcttaaaacatctcatttgttttttttctaattcactcttcactgtgtttgcagtacttttctggaaatgtattcatgaattttcagaattttttctcctctaagtgaagaatcaatggttgaaaagactttttttatagcatattatcaaatttgcataattaaaaataaatatacacacaaaaatgtcaaaaatctagctaaattgattggttaaaagcaattttatcatataaagcaaaatcacctaaagaattgacataattgcctaatattaatttaagaattataaaatcaacttagacatttgaagcccacataaaatatcaaaatgtccatgagactgcagttattttgatttttaaaaaaattgattttggaatgttcctcaggggtgaacagaaaatttcaaaacttcatgacaactttgtgaaaaagcagagtaggtataactggtcaaaactgagttaatatcaataataatgctatgggatgcttgaggtgtcgcttttccggatggaaacctctgtggctggtggcacctttgcccgagttttgctcaggtccactgggctcgttccgcccactcggcctggcaggctgtgcttggctcatgctaccagcctggatctcatgcctgccagggcaagtcatgcatgaagtggcaaggggtgtgtgagtgagcacggggttcggccactgcacgatcagacacaccaactgctgcagtggggagggtggctccaggtgctggcatgagcaacagctctctgtgaggctgtgtcttgtccaggtgcacttcaagcagctcccacaggtggcattgcagaacacagtggcacccagaagtttggagatgccaggaaccacagggccccaaagatggtgtcacagccctggctcagggagttcacagatctgggaatactgaagggccacagctcttccctccttctcttcgcctgcaacatgatgagcaaggggcatgtttcagccctgctggtgttacagctgttttagccctgccagttgatagatcctgagttcttgtgctgtgaccaggaaaaatgaggtgtgcagacaagtggagggtgagcaagacaaagaggagctttattgatagataggacagctcagaggaaagccacagcaggtagctcctttcttcaggcaggatatcccaatgagtgttcagctcttagcagagaaggtagctcctctctgctaggcaaatcatcctgatgagtgctcagctctcagcagagagggtagctcctctctgcagacaggttgtcccaagaagtgttcagttctcagcagagagggtagctcctctctgcagctggtcatcctggcacctgctcagctttggctgatcctagggcttttacgggcctcagaggggagaaagggcatgtgattagtccatgggagccataggtaggcccagaaaaggcaccacaagctcccactctggtcagcaggactgacagcctgtcccccagccttcaggccctccctgccctgaaggtggagccttaccagggtcttgccccctttcacccaggaacctgtctgcattctgcagctgttcatggagcccaggctgtaggtaccaaggggcacctgcaggctagtgaagaactgccctcaaccccacctcagcttcccttctgtgctagttggtgccccaagtctggaggcagctgaagtggcaaagggctggtgtggcagcattgccttgagcatgtgaacagctgggtgggcttcgacggcatctgggcttggccccgactttgctccgagatcagagtaagtgctcacagcagggagtagccaggcagcaggagtaggcacttcctagcctatgaaagcagggggggccttcatgggcccccagagatgccttggtttacagccacagccatggcttcacagctgcagttgggcagctgcagttgtgccgatggggggtcaggggcagggctccctcctgctccagggcccaggagcacagggatgtctggatccacagctatgcattgggtgactgcagcagcatgtggggagctcccaccccaactttgaaggggcagagctcccactttttcctggctcccaccactccatggagcatgcagccatggctgcacctctcttctgcagctgacctgatggcaactgccgctccagacagcctgctgctgccaacagtaataataataaatgttaaaagtgcataaaacatctcagtaatcccaaggactacagaaactctcttaaaaggactctttcacacaggtgaaagttacaaggtgcaagagcaacttcggaaaatgcctggcggccatccctgttctccagcatgtgttagctggtcacagggctgcccccttaaacaccacatttcccagtcccagcatggctagatgtgatcttgtaatgagagaatggaatgtgaatgggcttgatgtgtccagctcccattttctgcctggcaggagcttggacatgagggcagcaatgaactcttgtcagagcacacatgctgaggatggcagagaaattggagggatggagagtgggtcccacagattttgaaatcacctcgggacgtttacgtttggactcttacaagagaagcaaactgctctctgagttatgccactattatattgattttttaaaagaaaccagtatcctaactaacataaaaaggttaaagatgcttaaatagttgactccaaggtacatattgttaaatgaacaaaaaattcacacaaaatgaaactcaagtgactgtaaccattgttttaaatcctattgttgtaactgagtttggagagaggaccaattaatatttttccaacagtcaaggcataacctgaagatgtgaatgtgtgtggagagggtacacactgggtttcagtttgggacacacaaagagataggagataaattttgcatatttcattattttgcctagagcaaactctataaatagataacatttttctcttcagtaaactgaactgtcagagtaagcagaacattatagagactttttaacactcatcaagtaaagcattatggaaattatcaaaatcatttaaatccaaaatatttttgcaccaatacttcctattctgttttacataactacttagctctccatgggtgcagctggagaggtgcatatctttatcagtctcctgggcaatggagcatttgaagggaagcagtcttatgttttatattcagcatgcataaatttggctgtgtttgtctcattttattttccaggttttggttgcaaagatgaagtttaatcaacagctattgttgctgttcttatcataattgatgataataattctttttaatttctgagtgttagatttaatcataataggcaagatctctagacagaggccacatctgatgatgtgacagtcaggaaatgttcagcttcactttcacttttcttggtcaggaaccaggctgttaccattgtttgttaggtcagtgacgtaataatagtctagacaggcttccttaggctagagctttccatgctttgtggcttatcactgagctgtccatggagattctacatggatcaaagatgaggtaggggacattcatatattgtcattttttaaacattaaagatgatttcatcacattatatgcattgcagttctcatctccatattttaggtaataaagtttactgatgaaattttaaaaattattttcataggggctttttttttgcccctagaaaaacttatgctagataatgattaaccaataaacttatttttcttttatccatggatacagaaaagaagacatttataaactatgtaattgttcctgcatcatattttagtacaaatcaattacttttaaaaaatcatatacagaaagcattaaaaatttcatatctgaataagaaaaaaagtaatatgggaagatgaatgtgtctccagagaaaaataagttttgttgttggaaaaaaaatctaaagtttacattttaaataacagaattagttaacctattgtattagtcagggttctctagagggacagaactaataggatatgtgtgtgtgtgtgtgtgtgtgtgtgtgtgtgtgtatatatatatatatctcctattagttatatatatatatcctattagttatatatatatatatatatcctattagttatatatatataggatatatatatcctattagttatatatatatataggatatatatatcctattagttatatatatataggatatatatatcctattagttatatatataggatatatatatatatcctattagttctgtagctatatatataacatatatatatattatatatatatatatatgaaggggagtttattaagtattaactcacacaatcataacgtcccacaataggctgtctgcaaactgaggattaaagaaaccagtctgagtcccaaaaactgaagaacctggagtctgatgtctgagggcaggaagcatccagcacaggagaaagatgtaagctgggaggctaggccggcctcgtcttttcacatttctctgcctcctttttatattctagccatgctggcagctgatcagatggtgcccacccagattaagggtggttctgactttcccagcccagtgattcaaatgttaatcttggcaaaatcctcacagatgcacccaggatcaatactttgtatccctcaatccaataaagttgatactgagtattaaccatcatatctatgttactaataaaccagctacaaatgaagtgttttccttatagtttttatagtataacatagaaatatctagtatatattatattctggaacttatcatgttattaaatggctggcacttgttagttgtgtttaaaggattttcaggaatatctagaaatatgcgctactagagttatttggatacaagagacgaaatccaaatatgactagctcaaactataaaataattttttggaaaaatatggactgtttcaccaaagtgaagaagcaactgaccaactaggctttggaaagagcaggaagtagggtagctcacggaatccagataatgggactgattgacagtatttttttctagataatatcatcaaaataaactactttcaatatttcaatttttttaaaaaagaaatatgctcttttagtcaattattatcacaaaatattacacaataaaacaataaaatctcagtggcatacacaactgtatcagtcaggattctccggaccagctgaagcagtagaatatctatgtatgtgtacacatattttaagagacccatttaaagaaattggctcatgcaattgtgtgggctggcaagtccaaattctgtagggtaggctggcagaatggaaactcttgggcaggagttggtgctgcctactcgaaacagaatttctttatcagagaaacctcaatgtttgcttttagggcctttcagtgattgcatgaggaccacccacattattgggaataatctcctgtacttaaagccaactgatttcagatgttaaccacattaaaatacctccacagcaacacttagattaatgcgcaattaaataattgggcaccataacctattcaagttgacacataaaagtaaccatcacagctcaccctttgtcaacgtaacattcatatatatccccttaaacctactttagctccaaataaaaaccatcacaaagtcatccttctaacgaatatgatacaacagtcctttgtataatcaaaaacacactaattatttccctagaaggggatacaaaggccttgagtaatctccttgatatgctgtaatttaaatgctgtgatgtaaaattaactattattaataaatcttatgttagatgataagggaataaagaagggaagaaaacaaagataattgacatatattatacatatgtgtatacacacatatatatgtttgtaagtgtacatgcacatacagtcaagtttataacaaaatgagaaagaaataacaattacagtcctcatttttgcagctgatcatgtggtggtagttggtagtaataaccgcctttttccactacccattccttattccttgtgtcctcagcaaacacctcagctggtcatagttcttcacctggtaaggtaacccaaatcttcattcctgaagtgtctgggccattaatagtccctgcctgaacggggttattgcagttttccattggcatgaatcacaagcatggtaagacacacctaaggaacctcctgtgcatactcttcctgacctccaagctggagcagcccaatttccctctggaagtcagtatcaatcaccccagtcagaggagtaactcatttctttgcatgttgattcagaggcaatggagtccaaagtggctgggagtatctcaacttccaattcaatgaaatcattgttggatctcctaatagaaacattcttcactgtggaatgaagacctctaaaccagaagagaataaggtcgcaggtacaggaaacaaaagttttgctagtaagtagagagtaatactgagaggcactaccctcatttcctaaactcatgaattctggtaatgggagagacagcaccatatattgaacatatacagcttcctggagaactttgactcagccctgcaagaaaatgccacctggctgatgccataactgttttcaaaaggccattgcactgctctatcaagccaacttcaagatggtgggaaaatggtaagaccagcccagtgaaatttatgagcatggactcactgcttcacttcattttctgtgaggtgagtgccttgatcagaagaaatggtgtatggaatatgatgacagttaataaggcattctgtaaatccacaaatggcaattttagcaagaacgctgtgtataggaaaggcaaattcatatccaaaataaatgtctatttcaataagcacaacatgctgacctttccatgatgtaagtgtggcccaatacaataaacctgccatcaggtacctggcttatcactctggggaattatgccatactgggctcagtgttggtctatgctgctgacaaattgggcactcagcagtggctgtaaccatgttggccttggtgagtggaagtccatgttgcacctgcatattgtgcagaaccatctctaacccaagtcaacttttctcttcctccagtgaattgtggttaggaaactccccatgagaccataggtgtgggctaagagaaagaaggtaatggagcaagagtggaaaccatagataattgaagttctttctcttgtaaactatttgtgccttagggtctgcttgagcccgatcacttccatttgatgatgtgtacccctaattttatggcttggtctattggatgatacccagttcatgatgaacatctcaggtgacttggtgtcccatggttaatcattctgtatctactaatagccaatagcagaaaaagagctgtctcttaaaagggagttgttatccagagaagaaagcagggattagctcccaaattctgaggacttgtcctgtgattcacctacagggacatgccaaaggctctaaacagcatccctgtctgccactgccacttcacatgacagatattctgcgtcatatgttccaagtggtagagcggcttgcacagtagcctggacctgacgcagaatcttctcctgttctggaccccacttgaaatcagcagctttttgagtcacttctctaaagaggccatagtagtccacccaaatgaggaatatgttgcctccaaaactcaaataggcctcctaggcattgtccctcttttctggtcataagcaaggccaactgcaacaacctattctttaccttagaagggtatctcaactgacatcacaccactggacccccagaaactttgctgaggtagaaggtccttgaatttttgtcagatttatttcccactttctgacacacaaatgtcttgttaataagcctagaatagttcctaattctcacttactaggtccaattaacttaatgccatcactgtaatgagccactgtggaatcttgtggaaaggggaagtgattcaaaatccttgtgagctattgacatagggctgaagattgatacatctctgaggtaggacagtgagggtatattgctgtcctggccagctgaaagcaaactgcttctgatgggccttatggacaggaatggagaaaaagggatttggcaggtcaatagctgcatgccaggtaccaagggatatgttcatttgctcaagcaataaaaccacatctgctacagagcttcaattagagtcaccacctggctaagcttgtggtaatccattgtcagtctccaaaatccatctgtcttctgcataggccaagtaggtcagttgaattgggatatagtgggaatcacttctcctgaaacttttgagtcctcgatgatagtaataaagtctacaatatctcgaggaaagtggtattgttcttggtttgctattttacttgcaaaggtaagttaaaggtagttctaatggcatccatttggcctttcccatagcaacagctctcactccacatgtcagaaaaccaatgtggtgattctgctagttactgagcaagtcaattctaattacacactcagaaccaggggaaaaacatacaatgtgttcacagactaccttggccttaccctgagatggacttgagctaaaactccgctggttacttccacagcccctcttctgattggtggaccacagtggtgttttgtgtctccaggaattagtgtcatttcagaaccagtgtctggtagttgctgaaagatatggttttttcccttctttaattcatatttagttcacatttatttgccctggtaaaagattctgcaattctttgggggaggctgggagcaagattaacaacatacacctgtggtagggtatcagcgtccttctttatgtggcccgacttcctttctttattagttcatttgtattgctataaaggaatacctcaagcaggctaatttataaagaaaaggggcttactttgactcatggttctgcaggctgtgcaagaagcatgacaccagagtctacatatgctgaggtcccaggaagcttttagtcacagcagatggaaggggagccagcatgtcatgtggtaagagaggaagcaagagagaaagaagggaggttccagactcttttaaacagccaggtctggcatgaacttattactacagggaggacaccaaggcattcatgagtgatctgcctccataacacaaacactctccaccgggcccaccttccacactagggatcccatttcaacatgagatttggagtggacgaacattcaaaccttcatgcaaggggctctggttctacaaaccatttcaattctgggaactgagtgagagtctatgactctattctggtgattcatactagaattttcactcaacctagaattcatttgcttgtactgatcaaataaaaatttagtaggcttcctgtctattttgcttctagggacacatgatcaacttgccaacaccataggcctctccgagttaagctactctgattactgccttggccctgatttccattctcataaccatggcctctttgtctttgccacttgggccctgtcatcccaggatccaattactgccattgcatgtaaggattccagttcagtggcaatagttcctatggtaatttctgccctacagagaagagtgcccgaagagctctttaacagagccaccacacaaatttcttcctcagagtcaagtcgaaaggtgcattctctgggccctcccagggtcagtgaggggctcttgtatgataaatccactctaacattccagtactcttaagtcatctgttaacttcctctgcagtgtaccaaggcgatcctggcattttaatgtaatttattataagtcatttttttttggtccatgtttaaacccaagtcaactaaacaaactgtcagaatcctttctaacaccccaaatttacatccagaatttatgcttagtggggcaatatcaatcaatttgacctagtccaaatttatgtgccttccaacattatccaaaatcatgagtatccattccacacgtatttcccagaagtctgtctgtataaattgaaaaaatatgcaatgattttgaagtggaacacacgtttaatgggttaaactttgtatctcaccttttttcacctgttgccacttgagtgtacttatacctataaaagaaaagagggttggtggggttggatcctcaggagaatcagcattgtttttaggacaaccacctcagtgaaggctatcactctaccaccaaagaagactcagcagaacttaggggttcactgagctcagcttcatcacagacttcatatatgtcttccttccaatattcagggtcctgtttttcccaatcaacgtctgtgtttaacagaagaaactttgctaagctggggtttaatttgtaatgtaattcagtgactagcaggatgagactctgggtttagtgttcagaaatctcaggctcatggctataggagataagggtataatctaagacaggcatatgcattttcaggtcatatatgcagggcataggctagtaatttgaaatcctaggctcaccctttttctctctactttctataccatggttaagagcaaacaaccaatcttattgcactcattatttgacagaactgttctaagttatcaaatacttggtcactgagaaccttgccttatcaatacttgagtagtagtattcagtggtgatattgtgtgtatctctattgcctctttgtgccatggactaccagtgttcttgttaatactggaaatagagtctttactgcctttaaatctaattagattacagaatcaattcctgaaaccccaaaaccaagtcaaaaaactcattcttagaattctgtgcctttaaaaccactgttggtacccaaatctatatcagtcatggttctacagaggaatggaatcactgtgtatatgactaacatgaatgggattcagcaagtctaaaatctacatcagcccagcaggctggaaactctcatgcagaagctgatgatgcagtctggaggcagaatttcttctacagaggaaactcatgcttgcttctgaggctgttcaacttatttgatgagacccacccacattattgaaaatagtctccattatttaaagtgagttgattatatatatcatctgcaaagaaacttcacagcaccacctagattagtgtttgattaaatggctgggctctgtagcagctaaagctcaccaccacaaatatcaagcacttatttgacgcaggagtcttcaatgtgattgtggcagctctgtcctgggcagggatgtaagggtggttgggatgaatcttgcattctgtgggtcatataagaagtttggctctgtgtgtgtcactttaaggccaggccaacagggcagcagcttcttggggaaactgttctcgtgcaattgcagaagtgctagagggcacgggaagcatgtgaggcctgtagagaaactagcatatggtcatttctccccacccatagctggagtagacataagtaattttgataataagtgcagtctatatgaatgaacgtaaaataaactatgctgtagtggatacagttgtttcccacaggcctgtgggttagcatttcttatggctatacatgtatactgggattgcacaactgagcacatgaatgattggttattggaaactatgtttctcactgtcagagacttatccagtggaaatacttaatcgattgtatgacatgttcagtttctactaaaaatgaacaatctatttcctttcacagccaacaggccctggtgtgtgacgttccccttcctgtgtccaagtgttctcattgttggcttggttcgaagtctttgctattgtaaataatgccacaataaacatacgtgtgcatgtgtctttatagcagcatgatttataatcctttgggtatatacccagtaatgggatggctgggtcaaatggtatttctagttctagatccctgaggaattgacacactgtcttccacaatggttgaactagtttacagtcccaccaacactgtaaaagtgttcctatttctccacatcctctccagcacctgttgtttcctgactttttaatgatcgccattctaactggttcaagatgatatctcattgtggttttgattttcatttctctgatggccagtgatgatgagcattttttcatgtgccttttggctgcataaatgtcttcttttgagaagcatctgttcatatccttcgcccacttgttgatggggttgtttgtattttcttgtaaatttgtttgagttctttgtaggttctggatattagccctttgtcagatgagtagattgcaaaaattttctcccattctctaggttgtctgttcactctgatggtagtttcttttgctgtgcagaagctctttactttaattagatcccatttgtcaattttggcttttgttgccattgcttttggtgttttagatatgaagtccttgtccatgcctatgtcctgaatggtattgcctaggttttcttctagggtttttatagttttaggtctaacatttaagtctttaatccatcttgaattaatttttgtataaggtataaggaagggatccattttcagctttctacatatagctagccagttttcccaacaccatttattaaatagggaatcgtttccccattttttgtcaaagatcagatagttgtagatgtgtggtattatttctgagggctctgttctgatccattggtctatatctctgttttggtaccagtaccatgctgttttagttactgtaactttgtagtatagtttgaagtcaggtagcttgatgcctccagctttgttcttttggcttaggattgacttggcaatgctggctcttgtttgcttccatatgaacttcaaagtagtttttcccaaattctgtgaagaaattcattggtagcttgatagggatggcattgaatctataaattaccttgggcagaatggccattttcatgatattgattcttcctacccatgaacatggaatgtttttccatttgtttgtgtcctcttttatttcattgagcagtggtttgtagttctccttgaaaaggtcctccacatcccttgtaagttggattcctaggtattttattctctttgaagcaattgtgaatgggaattcactctttatttggctctctgtttgtctgttattggtgtataagaatgcttgtgatttttgcacattgattttgtatcctgaaactttgctaaagttgcttatcagcttcaggagattttgggccaagatgatggggttttctaaatatacaatcatgtcatctgcaaacagggacaatttgacttcctcttttccaaattgagtaccctttatttctttcttctgtctgattgccctggccagaacttccaacactgtgttgaataggagtggtgagagaggacatccctgtcttgtgccagttttcaaagggaatgcttccagtttttgcccattcagtatgatattggctgtggttttgtcatacataactcttattattttgagatatgtcccatcgatacctaatgtattgagagtctttagcgtgaaggactgttgaattttgtcgaaggtctttgctgcatttattgagataatcacgtggcttttgtctttggttctgtttatatgctggattacgtttattgatttgtgtatgttgaaccagccttgcctaccagggatgaagcccacttgatcatggtggataagcttttcgatgtgctgctggattcaatttgccagcattttattgaggatttttgcatcaatgttcatcaggagtattggtctaaaattctctttttttgttgtgtctctgccagactttgttatcaggatgatgctggcctcataaaatgagttagggaggattccctctttttctattgattggaatagtttcagaaggaatggtaccagctcctctttgtacctctggtagaattcggctgtgaatccatctgctcctggatttttttggttggtagactattaattattgcctcaatttcagagcctgttattggtctattcagagactcaacttctttctggtttagtcttgggagtgtgtatgtgttgagtaaaatggcattttacttctgagatcgtccccctccaaaaccccataaccacactataatagttaaaaagaacatcagaataatcccaatggaagaatatcttacaaattccttaccagcatgcttcaacactgctaaggtctttaaaaataagcaaagtctgagaaacagtcacagccaaaagaagcccaagggaaaaaggggactacatgtaatgacgtgccttggaagcaatcctagaactgaaaacagacagtaaggaaaactaggaaaacacagatgaagtttaaactttagatagtactaatgtatcagcaatggttcattaactgtaatcaatgtgacataatcatataagatgctaacagtagagaataatggaagtggagaactgtcagaagaaaaaattacaacaattgtagcaaaatgattggattggctttgattgtgatttatgaatcatggcagcatctcctttaaacatttagacaaggtgttctgatgagctgagccctggaggtgggatttatatgcagaaaggactgaagaaagaataaaagccaaaacatcgattattcattacaaagttactttccttttagggttaaagcagaggggacttatttaatgccagctaaaattggcctctttggctctttggctattattccctctcccaatgttttagaaaagtcaaataatcatcttgctttcagtttggtgatgtgaagctttagcaagagtaacttcattttgatatggtctagtagaacctgaggaactcaatccaaataagttatctcctatatattttatctaactgtatgtagaaattctttgtgcttatatatgaattacttttctgaacaaacaactgatattatcacctaatgttttgatgaaaaagaatagaagattagaattgaaaaaaggaagatgtgctaaaaatggtagaaagtatagatatagcacctgctcaaatgtgccatgttatgaaataattaaaattttaagatgtatgcattaaaattaaatacagcatatgaaacaaatatgaggttatatttagatggttcagtatcctcatgtctatttctctggttgctttttagtagcaagaaattgattccagacatctcttgtttttatataatcaatacatatcaaaattttccttcttttgtagtaaaagaataactttacatcacagttagagacaagaagatatttacaggttcttcaaataaaatgtttaagagcaattttgaaaaataattaagttagtaataaaaatttcattaatattaatgaggctcacaatccacaagatttatctaggggaaatatttaatagattatatgatgcatttggttactactgatgatggctaatctctttctttcaaagtcaatagtaataatctatcagttcagtgacagcatggtgatacctcctactctgttttgccacacttacctgataaagcattaattaatcttgtataattaaaaagaaatgccaaagaaagatataatagtttactcttccaaaggctgagatgagtaattttgaggagtacaaagtcttctattttggaattaatcattcatcttactttgacgtctcatttacttatccattatattttggctctgcattgctttgttttatagtgtctgggtgtcaactttccgtgacatatcttagtttggttaggtgtatcacgtaatgaaaacaaaacactccagaataattttacaaaaacatctatatgtatttaaatctacattcatcatttaggtattatagtgaccatagatgaatctattttagatattttatacattgatttttcttaatattattcactctgacaaatagcttgcttccttacatcatattgtgaataaaattttaagttccagagagaattattcatgcatgtagctttttaattaaaaagagagagattagtcaatcttttttcatgaggtaaccatatgaaaggcaacttttaattgctctttttgaagtttctttctcaattgcaaactcaggtttcacaatgcatgttgggaatgagcgagaagaggttgatctgatgatacatggagtctgaatgcctgctggcggggtggaaaggtgcctggaaatgcacactcaatcacactgaatgatggcaggatatttatacttcctaaaagctggggattaagacttttttcatctgttcattttcctctcttcagtataccctggagctcttgttccttacaagtggttgtaaacacagttttcccacaagttctgcttcacgatttcctccactatattagtgttctctcttacatgccatgctgtgcctaatggcttaccatttctgtgtcttttcagacgacatcctttgtggtgccacagcacatggatttcagaaccgcctgtgaggaggtgagtacagagctttctgcttttcaaacagggaaaacagaatataagcgggaaacacttggctccaatttatatagggaaattctgcttttggcagaaaatggagagaggaggatgggctctttttccttccagattacgttctccttctgcaaagatagaaaacctaactgtgcatggaaagccttggactttaactctttctttaggaagactggagcatattgaatataattgagttgctcctcttcaccaactctgcacatttcaggtagtggaagtgttggaaagaattcttttcacataaatggtaataaattagaagacatctaaggttcctttcagccctaaaattctatgattttatgattctgatagtatttaagtaattcaatattatttaagtattaatacacaagaatttagattctctgtagagctgtcatcacatttcagcacgagttaaagtggcacattagtatttcaaggatgataaacagtgttcaagtttacagttcaatagtgcatggatgtgggcccccagggaatacaaccattccatcttaggaagaaaaactaacttttttttttttttttactaaatatgtaacattcaaagtattgtgttttcattcttcaggcaaaatacaaatacttgcagcttaaaaatgttttatatttgtttaaaaggtttaaagcatttttttattgtatataaacaactcaacaaaaaccaaccataactgcttacctctggtagtgttaaaatcaaactagggaaagacttcagttcttaaccttgtgaagactgttactttagtgaaatgtcatgtgtttacagttcttgcatgaatttgtggaaagtaactccttattttcttctaaagcaattgaaaaaatatatatttaaaaatacttgtcactgttggtaagaagttcagaatataaatataaggtttttcagaaaactaataaattgcttttatatttctattcttatgtttctacttttaatgctttaagcataacattttaaacatatctctatgctaatactcatcaaattacaaggcagtttttttgtttacaaacctttctcatgtgctacactgaatactataaggtcagagtgtgtacattattcatctttttaacttagcacttattggttcatatatttttaaaaactgaattaatgttctagaagctttgtattttaaattttaattgtctaatttctgtttttttttttttttttaatggagtctcactctgtcgcccaggctggagtgcagtggcgcgatctcggctcactgcaagctctgcctcctgggttcatgccattctccagcctcagcctccgaagtagctgggactacaggtgcctgccaccacgccaggctaatttttttattttgtatttttgtattagagacgaggtttcaccgtgttagccaggaagatctcgatctcctgacctcgtgatccacccgactcggcctcccaaagtgctgggattacaggcgtgagccactgtgcccggcccatttctggttttaattgcatacttaattttaaaagtagcaagtcttctatttccattaatgtgcaaccttatgtcttgagtagtaaggcattcattgaaacccagtggatatttgtgtgaatgagatacttatgggacacatgacattcatatggtacagattggacagtggtcaaatactatttaacaaatggtttattttggatttcagaggctggaaagatttacaagagctttttgtaaacaaaattgttttgatgtactaatttgggatatttctcaaattctattaagatacagaagatttatttaattggtaatactgttattaccatactagctcttgtaaattagtaatccttagtactgaaaagagtgacaacctgttactgagataacaatatagaagaggaaattaaatcactcatgtgagatatagctaaatattgctgaagtcactatatgtgatgccaaaagacaatagtgatcaattttggggtaaatatttacttaatggaatccaagtgttcaggaaagtgaggactcatctttgaatagaatgatttcagaaggcttcaaagagaagggagtctggtgccaggactcgaataatggctagaatttagttaaggaaaaggccatgatcaaaagtaatccaggaatgggaacgtaaatgataagatgcagtttgaagcactttgcataaaagaacatttagtacactactgctacaatgcagtacagtataagacaaaacaaattaaatcgtatttggcacttgaaacatggaaatactgtggatacttgcaagaaaatttgcagtccattttattatctctgcctactttttgtagtttgtcatttcttatatctgatattgtgagtatatttcaaaattaatagaccttaaattttaaagtttcatgaaaatacattttgtacattttgaaagactagaatataaattaaaaaggccttaacttttaagtagaaaatggatgatattctacttttataaagatccaacctaggtcctatgtttaagaaactacaaattcttaataagtttaaatgtgagagaagttaaatgtgagatttgtttaaagagtaaacccatgcaaattcataaacattttcttgatttgcagaaagcatagctaattaataatttaaatatgttgccttttaggcaattaggaagtattgcttttcaataattcctttaagcaaatagtctccaatgtggattttgtaaaaagttccatctagaatcgtccatcagtcagagaagaagaatattttacttatatcatttttaaatgaatcatccctttaaaattatgtttggtgtatattttataaagtacaaaatacattcatacagtatctatatcacatgcattcctttatttatgtgcaatggtatgcaaagtcaacgaagtttggagacaaatgatgttacattaataaaaagaaagaagaagattcatgtctttagtttatattaaaatttgagaccaataattatgtaggtgattttcgatatctaaacaatttgggtccacagatctgtaaagactttgcaggtggggctgttttaggtttgcagcaccaacctgcagctgctcccatgattcggtctctcatttttagctcttaaagcacttcaggaaggagtggagatcaaacttcttcctctatcagacagtctcctagtagcgtggctttggggaagatcatcctgtaagttccagagtagtctcttactcgttttttctctctagtggtcattgcttcaatacaagaagaatagctgcttcaagattatgttgttcttttcaaaattatccacaccccattaggagattattgataaccataatgctctccagtgaaagatgccaatagccatgtcattgtatacaggacaactgggggtggcattcttaaataatctgtgtatgcgggatagcagagtgtgtggtgaagagcctagctgcctgtgttgaattctagccttttcttcctctaggtccctctgcacttgtctaatctgtaaaggcagatggttgcgttaatttttgttaagggagaaaaataaattaatacttcttgtcacacagtgagcactatataaataattattattaaacaacaaataaatgaaatatatgaccacatttcatgagtgaggatctcagtccagcaatgctgattctaatcaagacagtgccctgaaatggagtttatccttcttcttgcatctctcagaggagctctgaatctaatgcacctgtttattagttcccaacttccctgctcagtgcctgtttctgtcaacaataagtgtattttaactttcccatttattctccatcttctactctgctacaagaaatacatttagaacacataacagtgaacatattatctccttgctcacatttatgtatggcgtctcccttaccgtccaccatctgcccatcatacagggcgttagcacgcctggtcctctccagacatctctcctgcagcggcccctgctggaccacacaggctcagcggcgagcgcaccttcattttcttgcatcatcacgtggcatgcattttcacacttccatatctttactcatgtgttccctcttgattaaaatgacatttgttcctctaatgattgtttcctcaattaatttttttcaagacaaaccacacatatttcctatcctccataaactcccttccctcatgaatattaaattcccttccccatgttgctcccatatcagatgtcatattgtgttttattacatatgtactttcgaagtaaatacgaggccgagcgcggtggctcacgcctgtaatcccagcactttgggaggccgaggcgggtggatcacctgaggtcaggcgttcgagaccagcctggccaccatggtggtgaaaccccgtctctactaaaaatacaaaaaattagctgggtgtcatggcaggcacctgtaatcccagctacttgggaggtgaggcaggagaatcgctcgaacccaggaggcagagattgtagtgagccaagatcgctccactgcactccagcctggggcaacaagagcgaaactctgtctcaagaaaaaaataaaataacataaggtaaaatagttacgaatactatgaggccagggaatgttatctaattaatgtctgattctctgttaatgctgcacagtatttgcaaaattaataaatgtgtgggattttaaatgtatttccatgtgcaccagctgaattttcatggtagaacatgtgtaatatctgtaacctctggaaatgtattttaactgatctgttttagcacttcgtgtactgttttctccagcagctatttattggaatgtgtgtttgtgagtgtgtgtgtgtgtgtgtgcttctgtgatttattctaaaaaaaatccttctcattctttattttctgcaactcttgtcctttcagaacccaaaagcgagctcaaagactgtattctgttttccagacaactatctaataatttgtgaacattttacatagtatttaagtgaatgatagctttggccatatagaaattaaatgagaacaccctgatagctttgttttagctcctcaaactttccctggatgatctttagtatctctttgatgtgcaccaaaagtatatctctgggctttcagggaaaacccttctaacatcctgaagttcaaacagagcattatttgtgattatcagctattccattacacttctgggtgaaaaaatgtcctggaatatactgtactgaaaaatcaggaaatgtgctcatttatgatcacttggctttgatgtatcatttcatatttccactcctcagagtggcttcccccctcaaaaaggatgcatgtcggcccctctccaatatcctattgtaagcatgagtgactttgtgtaaaaacatagaaaaaatatgttctatattagggaaagtacaatctgcttgtgctgaaagatttttgtcctctagatatattcacttaaagtattctctagattagtcagcctggtttcatgagcacttgtgtgctaatgccatggatgaagaaaacttgctttccttcctcatgaaaaagcttctgtttttcctaaaaaagacatcataccttttacaaaataattctagaataatataagagtgtatatgatagagggcaaaagagtgtgcatcagcacacgagaacaaaagcagtttagagaaagagttatctttggaggctgcagtatataaatatattcccatcaatattacagcggattcttttaaagtagcagactcccagcaatagccatggaaatgtatattccaagagaaagtctggtattatttgcctgggatagcatgctccttaaatctaaggatagatttcacatgtaagtgatataatatgatatttgtctttctatgcctggcaatttttactttgcaaagtatcctccatccttatctatgttgttgcaagttaaataattttattccttttttatggctgaatagtgttccactgtgtataagtaccatattttccttatccattcatgtgttgatgggcatttaggttgatttcatatcttggctgttgtgaatagtgctacaataaacatgggagtgcagatgtccctttgacatactcatttcatttcctttggatatatacctagtaatggaattgctggatcagtttttaattttttaaggaatcttcatactgttttctttaagggatatactaatttacatttccactaacagtgtgtaagggttcacttttctccacatcttcaccagcatttgttattttttgtctttttgttagtcaccattctaacttgggtgaggtggtattacattgtggttttgaattgcattttccttatagtaagtgatgttggagttgagagtagaatagtggttaccacacactggggtgcatggaagggtcagaatcgggagatgttggagaacaggtacaatgttacagtcagatgggaggaataagctctgttactctagtgcacgctaggatgatcacagctaacagtaatgcattatatgtcacaaatagctggaagagagggttttgaatgttctcacaacacatatattattagtgtttaaagtgatgtatatgctaattatcatgatttgataattacacaatatatacatacatcaaaacctcacattgtttgccatgaatacttactatgtgctaaatttttaatttgaaattaattaattaattaactctgaggataaatgtatatccccatatatatattccactatcttaagaatgactcaataattattacaagaaaatgtcatttccaaagtggtcattattcctatggactttttggtgccgaataagagctaaagattatattctatctcaaaggaattaccttttgtgtctgtgacaagtgggaatgttaagtgcactttctagggagaatatttatattaatccaggttaatatatgtattctggataaatgacaagactcatggacttctttggtgattactaagataatagcacaagttcagaaatctttacagtctgttttcacaattacccaaagtatataaagcaaacacattggattaggcatcaaaaatcttgggtcttaaactaggctccaattttaattaactgtgttaatctgggtagtttatttcaccttgttacccttatttccttctaggtataaactgtgtgtgtgtgtgtgtatgtgagtgcgtgttcatgcaagtctgtgcatgtgtgtatgcatgcatgcatgtgtttgttggtgactaggaatgctgacatagtggagtttagagtaggctggggcagtgggaggggaaatggagaaataggagtgtgttccttctttttgaagtaatggaaatgttctaaaattgattacagtgatggttgcacaccattgagtatattaaaaatacatgaattgtacattttaaagggttgaattgtatggaatttgaattatatctcaataaagcaattattttttatttttagattataagtattacaaaaatcctcattattttaaaaatgtagtacatgtaccataatccttactccccacttctttgtgtgaattttgtgacattgttttcattatccgagtgttcactctacttgagatcattctcctttttttcccttgcacccacgttaagtattcaatttcaggctcatcagagtgtgttttcaccacctcttaaatgttattcaccatgttttgctgtaaactggccacaaaattacaacctataaactaagtataatttttcctctgtttgtttttttttttaatctgaagacaaagacaggaatttgtttgctgcaggatggtaaccaggagcctttcaaagtgcggctgcacctagccaaagacattttgatgatccaggaacaggatgtgatatgtgtgtctggtgagcctttctattctggtgtaagtagctttttcttctgttgaaattttttgtgtttgttttttgttaataaaaatgtttattcacagggcattttaaatatgtttttctttcagtgtctagtcaatggttctgcatggaatttttgcttacatcattaagtaatcagcggccctgtacgagaaccttgcctggggtccatgaacacatatttcgggcccatctccagcctgttgtctatgactcctagctgtcatcatatgatgggagtgacactgtattttctgattattctaccattttacatagagaattaattgagaactgtgcatggtgatggcttttgctctggtcttatctttcatgacctgggactactgagagtggtgccagggtggggcccaaccttcagcatcactgaatcaggagacgttaggcagcggtcactgaactcagcgtgagtggtgttcccctaggatagtgtctaaatgattctgtgggcctccctaatagaattatgcccaagtgctgtagcaaattcttttctccaatgctccaacccattgacacattacactgctcctaatctaacttcagaaagagccataaattacagtgcaaaactgattgctgtacctactcatgtcgaggcagcatagctatggaagacatccttagatgagattagattttattctgctaaaagacattatcataagacgagttctggagtttatcattcattgtataataatgctattaaaggcttctttttagcaatgttgccgtatgtgatctcagaagaaaattacagacagtagcatgtagtctgctccctgctttccccaaacatctgcaactatttagcatggagatttaatttgtaccttattaacagacttaccttggagtgtttagttggtggtgaataatgctgaacttgagctctcacatcacttcttactaacaccctatgggagtcacacaaggccctaaatcaataggcctttgccaactaaagataatggacattttgcagactgttaactattcttttgtcacagaccatttaaatcattctgaatcatgggcctggatgtcaaggctgattaaactgttcccatggggttgtcctttcttccctttggttaataatagagaagtgacatgagtcatataaccctctagaataaatatatcacactggtcccagatcaaaaaataaaatcagtaaaatttactactttgatactgaaataatattattgattttaaacttcacagtcaataatagctgatacacatagacctattctcttcttaaaagataattgtgcatataaataaagctcagagtgctaggaataatgaagagaattaaggagaaatatcctatggcattttcaacaaattcaaaaaagcatttgacaaaattcaacacccatttttacaaaacactttagcaagatatgaatagacaagaattttcttaatctgacaactgtcatctaattaaagcctctccctaatatgttagttaacattgaacattttctctgagattgaaagcaagtcaaggataataccttgcttaataatcaatgttgttcaccatgctcctacagcaagtcacaaacgatatataaagaacaaaaattatacaggaagaggcaaaatggctttacttgtagatttcatgatgatatgcatagaaaaccttaagaattctacaaaagatagaataacactaaaattaagcaaggttgctgagaataaggacaatagcccaagttaattgtgtttctaaaactacctacaagcaactagaaatgaaatgaaaatgcaatccacaataagtcagaaagacaatacactcaggaacatatttaacaaaagatgtatatgatctctaccctgaaaactacaaaaactatgttgaaggaaattaaaagatataaacaaataaatggagaaatacaacatgatcataaattaaaagctaagtattgataaactgtcacatctttctaaatattccaaaccagtcaaaaccccaaaatatttgtgtggatatgtacaagttgattccaaaatttacatggaaatataaaggacttacaataaccagaataatcttgaataaaaagaacaaagttggagtgtttattctacctgatttcagcgcttactataagattctaataataaatacaatgtaatgctgtaataaattcaggcatagcaatcagtggaacattctaaagagtccaaaaatagacccactcttatatggtcagttaagtttttttttttaactgtggtaaaatatacataatataaaatgtaccatcttaactatttttaagtataaagttcagtagcatttcgtgcattcattttgttgtgtaactatcaccactattcattgccagaattttcatcatgccatactgaaactctgtacgcattaaacagtaactctccatgctctcctcctcttaacccctggtaaccactgttctactttctgcctctacatttgactattctgggtagatcttgtaggtggaatcatacaatatctgaccatttgtggatgacttatttcaattatcataatgactttaaggatcatccatgttgaagcatatatcagaatttcattcccttcaaaggctgaataatattccattgtgtatttataccaccttttgtttatcttctcactcggtagtaaacattgaggttgtttccaccttggctttttgaaaaatgcctctaggaacatgggtgtacaaatatgtttgagtcaccactttcaattatttggtgtatatacccagaagtgaaattgctggataaaatagtaatactttgttcaactttttaagaaactgccgtactcttttccacagtagttgtaccattttccatttcaacaagcaaaatacaagggttccaagttctccacattcatgccaagcctgttgttttctgtgtttttgataatagctatccaaataagtgtgaggttgaatctcaccgtggttttcatttgcattctcctgtcaattaataatgtagagcatcattttatgtgcttattgtctacttgtgcgtcctctttgggtaagtgtctattcatatcctttgtctatttttgaattggattgtttgttttttggagcttagttgcaggaattcttaatgtattttagatactagtcccttatcagatatgtgatttgcaatattttctcccaaattgtggattgcctttttactctattagtatttttgatgcacaaaagtttttaattttaataaaatccatgtcaattttttcttctattggtcgtaccttttataccatctccaataaataattgccaaattcagtgtcatgaatcttttccactatattttcttctaagagtttacaatttttgctcttacttgtgcgtttggttatattttaagttaacttctgtacatagcattaggtaaagatccaacttcattctttagcatttggatatccagttcaaaatcatgtgccgtatatataagggggtatttgtggcctctctattctagtttattagtctatatatttgtctttatgccagtaacgcacagttatgccttttgtttgtttgtttttactgtagctttatagcaaattttgaaatcagctaatttgggttccttaagatctcaaataaattttggaatgaatttttctatttcttgaaaaaatatcattgcagtttttataaggatcatgttgaatctgtagatcacttttagtagtatggacatcttaataatagtaagttttctgatagatgaacataacatctttccatttatttatgggtactttgagttcttttagcaatgttttgttgttttcatgtacaagtctttcaaccccttgcttaagttaaaaccttagtacttgataatttttgatagtattgttaaaaattattttcttagtttacttttggattatttattgttagtgcacggaaatgtaatggatttttacattttgattttgtattctgctactttgctgaatttattagttctaatagtttattgcggaatgtttatggttttctacatataagattatgtcatctgtgattcaagataagtttacttattcctttcaaatttggatgactattatttctttctcctgccttattactctcgttaagatttccaatactatgctgaataaaagtggtaaaagcaggcattttttttcttattccagatcttaaaggaaaagcttcatttttgagtatgatatttgctgtgggtttttcatatactgcctttgttatgatgaggtagttgtctactattcctaggtggctgagtattgaggcagttttgaatgttatcatcgaaaggtattgaagtttgtcaaatgctttttctgaatcaattgagatgatcatgtgtgctttttaattttttttcttctgctctataactcgcttttcttacctgaaagtacttcctgggacccctgtcccgggaaggaattctatcttctaggtctgcatctgaggaaagccaatctacaacagagaaagtagcacactgtactttcagataaccagatattctttgagaaaaactccctttgtctgttttttaaaacctcccactggtaaaggcccgcagacgcctctgtattaaaagataccctctttaaacttgacctttcacagtgcactgtttgtgttgtattgccacaatacatagtccatgtgctcgctggacagggatcacctctcttatcagctaattatgagatgaatttgagacagtagggcagagataaacatccaactttggagagcagaaagtctcatctgagtattacaacaaatagagtgttaactctcagtctgcttaagtgagtggaaaggttaggagaatgttctaaggaaaggcagatgttagtctgaagaaccataggcaaggatgctattttgttatctagaagcaatgctctgaagtcctgggtggaaaatagaacagtcaggggcaggggactgaaaacaagattgctatcaggcagtttactcatgagggagaaaaatgaagctccactctgctgaaaaatcctgaggattatagaatgttgtagttttttctccaaccccacaatagggaggaagttgtttatattttcaggtctatcacattagctgaaagctgcttctaggattgtctttgcctgacacttttgacctgccttgctcaggctgaaagaaagtgttacagttcagtcaagctcctcttgcccacttcacagaaaaagccaatacaatgagacagccagtattgcattagatgaagagtttaatacttgcaaggcagtgaagcaaagaggacaggagatatttctcaaatctctctgcctggaaatttgaagactagcgttttaaggatagtttggtgggcaggcagctatggagtgggttgtactgactggttggatcagggcctaaatcacagtgctgccaaaactgtcctcaggcatttagttagctcctgggtggagtcactggtctgggtggcattagctggtctactagaatgcaaagtctgaaaaatatctcaaagaccaggctgaggtttcacaatagcagtgttacctagaggggcaactggggaagttacaaatcttcagaccactggctatgtgaatcctgagcagcaagcaattataaaaagcaagctaggaaacaatgcctaggtgctgtttatgcctatgtcttagcagaaatcaggtccctagcataattataatcttatggcctttcattagttttacaaaggcagtttcagtccccagtatggaaaagcttaactttgggaagcgactattatcatccttgctttaaagttccttgctttaaagttaaactataaactacatttttccattaaattgtaaagtaaatccctcccatagttattttggcttttgcacagaaataagcaaaggtagttagcttgtgaggttagacgcactagggagtcagttatgccagatttctctcattgttataattgtgcaaaagtggttccaaaagcccttgtggactgggactcagggatggcagtgggacaaggtctgggatagggagttagtggtaggcctgacaatttctctgtatctgcaccaaggcaggagagggtgccatcagccccaacattaacccactgaccatgaaggataaacagtgagatgtgagcccaggtaaaaggctcactctgagggagagggcacagaactgagcatttggagaagctccagtcaggcaaaatgttggtatctgaaaatcaaggattggcagatgggtcaaaacccaggcgtcatgccaagtaaccctcttagctccttgctctgaattcctggacatattgtagggcatagctcagttgcagaaacaagaattgagaattcgtggtaagtatgtaagggcagcctctgtgagagggcaggatataggatttggatagcaaagggacccctgggaaaaggctttgcttcacaaaatctctagaattaagagaggaaacaggtaatacagggtcagcgccagaaaaccacaggctgatgaacctgtagctgagctccagggctttatcagggtgagcttctaaagaaggtgacttaacaataacccctatcaaatggggcttaaacctgctcatcactccctgattagtgggtctgggagtttatagtagaagtcaagtagctcctcagaggcttcaggaggtgacgcagagaaaaaacactcttgacatatttagcacatctgactctaattttagttatgcagaaagtcctataaaatattgatcatttagaaacttgtgtcaacattttcacctacaagagacagctagagagttaaaactgaaatatccaacgcatttactgtgacttctatcagcaaaatactgctttcccccagtgccttttattaactacttttgaggaacattctgtgatttcttcagagattacacagttgaagttttagcattgagttcatatcagataaaacctgtttcatctgtgatcatttaaaaatagtatcaaaacgtaggcagcaattattcaggatctttagatgcagatagtaaagtgactgttgatcagaatgatgcatggccgttgtcagatagatgtgttaaagcttcagttaacatacaagaaagcaatcatcttcccctggtgctccaggggagctgaaatccaacattcagttcctgtcatccttctgaatggtttaccactctaagtcagagatatctgtggctgttctcatggtagtatacccttcaatgggccctgaaggaaaattaaatttagcctgtgctagttttaaatattgacgaaatatttttaaaaggtaaatgagggtaaaatcaatacaagatggctatctatttccccatagagacaccagtttcaaaggtgttgctagtaaaaagatacgaaaaccatgaagaatcatggagcttaaattccaaacatgacagaactgtcagataaatagcatcaatacaatcagtacctcagtgtaatgggcaccattagactttaaaatcaacagaacaacttcttccagtttccttgtggaataaaacacacaattagcaatcccacgagtgaaaccacaatttcctgaagatgactttaagagaactaatatctactattaaccttggaatttgtactggctttcacatgggtgtgacatgatgtaggatgtggctttttgaggttcattatctgtgaaaatgtgatccagagagagaatgtatctagactagtgcacctattatggatagattcttaataggtcatctgggaggcatggtgtgtgcaggcctagataggaacattgttttttctttttcccacatcacagagctactcactgaaatctgtcaacatggagattggagtctgtgtacacacacatgcacaaaatacacgttgtctatattttttaaacttttaaaaaaaactcttgtatgccaatgttatcatttatttgctgattttaatgagattgcattcttcttttatttaaaaatattgaatttacaaagaatatatatattcaaggtgtataatatgatgacttgatagatatatatacatacacattgtgtaatgatttttacagtaatgtaacacatctatcacctcccctgctatatattagaccctgagatcttgttcattttataactgaaagtttgtacctttttatcagcaccttctattcttccattcctcagcccctggaagccaccattctactttctgtttctgtggattggacttttttttagattatgcatgtgcgaggtcatacaacatttgtctttctgtgcctgacttatttcactaagcataatgtcctctgttcatttatgttatcacaaacggaagggttcccttctttcctctggctgcattatagtcaactgtgtatatatatgctttatccattcatctgttgatagacacttaggttgtattctataaaatttgacccattctaagtaaatacaactgatttttcaaaatgttttagaggtaaaagtggtcactgattactaacattgataaagaagctatcagtttaatcccgtttttacatttgattgtatgtttataaacttttcaatcagaagtattttatgtttgcgcttctccttgtttggcctttttgggtagactgacattccaaatgtgtgcaaataagactaagaaaaggaaggccgggtgcggtggctcacatctgtaatcccagcactttgggaggccgagatggccaaatcacgaggtcaggagatcgaggctatcctggctaacacggtgaaaccccttctctactaaaaatacaaaaaattagccaggcatggtggcgggcgcctgtagtgcccgctactcaggaggctgaggcaggagaatggcatgaacctgggaggcagagcttgcagtgagccgagatctctccactgcactccagcctgggtgacagagcaagactccatctcaaaaaaaaaaaataaaaagactccatctcaaaaaaaaaataaaataaaaacagaaggaggaagggaaacatttttcaggagtagaaaaatacttgcagatgggcaagtactgtttagagagttgtgattttataacagaaagataatacaaaggcctactcttgaaacctagagtgtccctgtcttttattattagagattgttaaattgaaaagacagtgctggaaaccccttctctctatttcttatgtgatgtttcttttttgccagtcagtagtcaccactagggacatttacgttcctaatttcccagggcttatgcggttccagatatggcagccctggaagaaaagattatggctccagtgaaaacattgtcaccggatcccctggtggtggccgcagtgggattagcccgagttggtcacagttgtagtcagcctgtggcaacaccatctcaggttccatagtctgggcagcagtccccagggactactgcctgtgtctcctttgattaggatagacagaacagatgcagttggaggtgttggtgttgttatttgaaggctcctccaaacgtagaagcaaatgaatgataatatttaccacaagaacaatggcacccacagaaggataccttattaacagagttaatttttttgtgaaatacattgctaggtataagattcatattaaggatatttatcttaacgtgttttgttaaacctagcattgttaaatccacttgttattgtgcatcttgttttattttacctttaaaataattttaatatgagattttctttatacatataaagcaaatttattgacaactctttaatacttagttttttcttacattttgtacctatttgtctttctgtggggcactaaaggtgactccttctttcttcttttcagttcataactctttctttgacagattgagtccattatttaaactattgaatttctgattcttattattatgtttttcacttctaaatgaatataatactatctgtcttatcgggtaattgtgaagatgaaacaagtgaatgcaagtaaaagagaatatggtctctggcacatagtaggagctcaacaaataatatctttattaacatgacacatgatacaatgtgggtgtgtatagacatggtgatacacagagtacagaggtctaggtcaggaactgctttccagaggatgtgattaaggtcccacctcttaaatagcaggtagaattttgcgggatatatgtaattttgcaagacatatgtaagtagcatttaaagcagacaaaaagtgtatgcaaaattaccaattaccaaactgttaaaaagcatgccataatcaaggatggtttagtcatgggacatgtttcctgcaggatacagttgggaaggatgtaaggtggggtgcaaagtgtattggtgggttgtggtgccatcaataaagggagcaatttaagtaggaaaatcaggttttagagcggtgtacaatggaagttgaattgagaccaaaaaagcttagaccatttagaaccaatgcaattttgtcatagactgatatcaagatggaaactaaaatcagttaattaaagcaatggtgcctggttccactggcttatcagttacattgctcacgtttgtgattttacagatttgtcatacttacaaaaagatatgtcattatttacacaaatgaatttttataacattaaatgtgagtgtaaagttcaagagggttatgatcaatcatgtgcccatcagcagcttaatgatagatagagatggatgatagatgcatagaggcatagatggatgacagatatagacagatgattgattcataggtatcaatagattaatttaacactgttcatttgtttttttcttcttccttaaaatggttgacagtttgatgtattttgtaatattttcatcccttagctctcatactgagttttggagtttgagaaagtctgccatctatctattttttctttgtaggaaaactgtctcttctttctgagtgttgaagatttcagaatccatgcccatccacgccccatggtaatctgctgtgtcactctgacatatctatctgaagatgtattttctttgcttgagagtcacaagaccggaatatgaaaatttatgtatttcttcaattctgaagaatttttagccattatctttgaagagcctcctctctattatctgtgttctttccttcagtaacatttggatggatgttagatcagctccctggattctccattttcttacgttttttcatattttgaacttgtctgccctctgtggactctaaaggcaactcctcccatcttcctttcagttcactatctctctctttggttacattgagtctatcatttaaactatttattgaatttctgattctggctattatgattttcacttctggaagttctattctatcctattttatatttgcctcatagtattttacatcacgattatacatttgatatctcctttctatcaatattaatcttgttagacaatcctatttatatgccgtatctgtaattgcaagatctgcagtctgtatagatctgactctgttatctgttctttgttctgctgctgatgcactcactaaattccatttcctcctgggatttctcactgtgggctcatggtcttggcactctataagtatccctcagtttggctctataatgtgttatgaagatagaatttacaattagttctttcaggtgaaggggctattagcaacccagatattctttaaactaaattctcagttggggatatgaggccacacaggtagagacaattcatcacacacccacctgtgggccaattcacaaaatctcagaaatggtttttaattccttcatccagatctgaggtcaagattggcaagtttctttactataatcctttgggtgataggaatggtttttcatactgacacactaagagagttttctatgcaggtgacggtgcctctcctgtcctgcttgggtccttccagtgatggccctgaatgtttgcctttgggtctctgctcgtacagacttcttacctgtgaatctttatacttcgtcatcattcctgacaaccgagacatttttcttctttccttattactctgactgcacgtttgacattatttttatttattttattcatcattttattgtgtgttgtcttggaaagggattttaagtatatctgactcaaaggagtgttagactcaagattagttgtgtgtgtgtgcatgtgtgtgcgtgtgtgggtgtgtttgtggaaaagctatcagatctgaagtgtacaggcctggcttctaatatcagtctccccatttgccaactttgtgaacctgtgtgacttcttgctttctctgaatcgttgttcgtatgagggaaaaacagagaccacctactatacatagttcactgtggcaaaattaaatgagattgcattgcctaggtgaccactagaggtgaacaataaagatggctgtcttcttcctttcatctggataattgtttctttctctaattcactttgtctaaaactttaaattattatcctggatgagtaatttgagctgcataaataatctttctgtgtaaaattagaaaacaaaacttctcaccttaaaagaaatttttcgtgagtgaacaaatgttgtttaaatgcaaaggagtttcattattattgctttaaaccaaggagttctgaaaatggcagtaatgtaaagcagcctagaggtattccaaagactacagtcttatgaagtttatattgtttctgcagaaaagcatttacattaagaaggtaatatttaaatgagattgaatataaactaataggctgaaatctatattgttctggaaatcagtaatcaggacacactagaaagtgaaatggaataggtaataacgtaaatataaggttaatgtaattgatgtaaatgtttacttatacctatacatgttaacataatatatcaaggagtaagatttttggttaaaatttctcatttttgtcaacaatatatttgaaatatactcttcccatgaaacagttcctcagttgttttagtagcacaagtagttttagtttaaaaaaatatatttttctcctctccaagccagtaaaagttcctctttcagtatattatataaaacttaaattatttttgtatttaatccacataattttgcatgatgcttgctatcatacatattgttaatttttactacatatgtggaaacggtaagatagccacctttttaaaaaaattaataataaatttataagtggaatgtgggtaaccaaagcccagagtttaaataagccttttaattttcagagcattaagaaggtagtgattgaaatttatatttgataaatggattgctgttaatgtatctaggcattgaagagacttaatacatgataacgatgggtgattatgatgagagagtaaaatggagaatgttctgagtgttcaaatattgagccacataggccatccacttttctttgtagcttaatatttttatttttacaatgtcaatgcttttatcttcatgttaattattttagattgtatcttttctctcttcatctgtgacagcagtctgtgcaatcttaaacaaaatgtcccaagtacaattaaacttgtataatcatcagtatggatattggtttttgcactgggcattcactcagtgataatctgtggtttgtgggatcatttgctcgcacactaaatattcctggattgccatggaggttataagcatagtcacacatgtgcacatgcatggaatggttctatagttcctcctgcttcattccattctaaaacactaagtctgttactttcctatacagtgggcttggatccacatagccaatatgtcaaatgtgtagtacaaaaagtgagaatctgagtgagaatttaaggccttcttacttaagagcataaattttgaaatatgtattaaacaatagtggtgatttatttttcttctttatggttttcaagactattattaatatatgagtttgcagattagctaaatattggaaatttgaggtgttactgtggcttgtattttattatacttagttcttggtaatttacagaatattttagatagattacttaaaatgtttgaagtgtatttgagacattttgtttatgactacttatattcatatcacatcattattttgctaatttgtctgtatcattgcctttttccataaatgaagactttgacatccatgtgatttaatgctaagatctgtccataatagagtgatagccgtgctgaactctatgtcatggatcccattaccctgcattagagcaatggagtcaagcagatagatacttgttctgttctatccatagcttaacacctgagtgactgtgacgatgattcactgtctttgcttcaaatgtcacataaagtaatacattcaagtgcactttggacactataaattgctatagtataggaggacttatttttacttgtacttgaaaaagtgttttaaagaagaaattctaggtggttttaaacccactggaaaatttggtaaaacaattgtaacttataaaaaatttatcttcaaagatatgtataacttcagtttgaaccgccatgatatacacttttctaagtgacatcaataaaatcaaagcaattgcttatatacacaagttggaacatctctgcgataaggagcatatgcagaattttgacactccttgaattttctactagttatgaagcacgtgccacattatcttactctgtagactgtatattctgagacttagcgatttataggagagaactgacttctatttcagagtctatcaaaaggcacctatgtgatcctcacactttactttctctagacgcaatatttgctttcttagcatgtagaattatacttatgaaatgtcgcccagttataatattccatggcttgcttctcttttttcttctaaatctcctctaacagtggagatgttatataattgcctgcaagtggctcacgtaagatataaataagagtgtgcttttctcacctttcatgaactactacatcacacttcattttcttgtccattcagtcccttgctcccttagatgacaatgtcgtatcaacttctctctccaagtgtatccaataacatctctcccattctcactccaaggtgatgcccttgcttcctccttcactgagaaaatgaagccgagaaaacaatgccccactgccatttatatctaccttcctggacttgtgaccttatgtgttttctccctttccattaccacagatgatctgtctttcctcctatctaaggtcaccatctagtcatacactaaattccacccttgcatgcatcttcaaagacatcgttccagcaatttcccactgcatttgatgattcccactgtatttgattgcatcatcaaatgctcattttccactagatcattctgaccagtgatcattctgatcattccaaccaagcaactataatttccccttcttcaaaagcaaaataaaaccaaactctctcttggcccgaaattctcctccagcatccactgcatttctctgcttcctcttccagagcaaagccattgaagtgattgtttctttgccatcatcccccaaattcagtaattcatccccactactccactgacatttctctcttcaacttcactagttatttcaacattgctcaatttaatggatatttctcattcctaattttacttgtgttttcaacaccactgacactcctttctcctacaaatattttcttacgggcttcttgggtaccctgcattcctcttttcctccaatctctaagcaacttagagatctctaagtctcagtcttcactgctgagtcttttcttcatttccatctataggcactttaatggtgcaaagcttagttctttacgttattctttttcttttactttttgcacttgctctttcagatgtcatccattctcatggctttaaaagtgactaagctccagcttatatcttaccctgtcctgttccctgcactccagattgagatagtgcaacaatttgtacaatatctgcagttggaggtccagtaggcattttcaacttaaacatgaagttttagttaaacttcatgtttaactaaaacataagcttaaacatgttaggcaaactaaactcttgattattccccaaattaattcccttcacaacgtttcctatcccaatagagtaaatggatatgtcatctttccagctgcattaggcagaatccctggaatctctcattactctactctttcattgaagccacatccaatcagtttaaaaaatcatgttagctttctgtcaaaaatatatccaggatatatccagtctttcttctggaaagtagggatagaactgtttttctctattatttgtactaggtaaaaattaaaaactatgactattatcttttaaaaaaaataccataaggctctgaaaggaacagggagaaagacaggttggcttgggattttaggatttgaggaagtcatagaaccatgttctctgatggatttttggcctcaaatatcccagattggttacaggagaagccagtaacctggaaatgacaataagcccaaccaaaacctttctttctagaaaaaaaaatgggcagcttaacaagaaaataaattcttccaaaataaatgctctactctaccaaaataccacacacacacacaaaagtgccctctttctatctccaatggcaatggccaagtggaaaacttagacttataccctcaccaggctgcactgatgttctccagctctgtctgccaaggtggtattagggaaatcataaatgggaacaaggactttcatctttatggagcaaggccaacaacaatcccccacaaactccacctcactgtggtatcagagaagattatctggttgtctgaaattcaaatctgtgcagcccagtgataaagaagccatcgcaaacaatggagtcggttgagacctctcagagagcagtaataaggctctcctcctcccctcaacaagggttgtatcagtggaggcttagtagggagctaaaattcccacctatcaccagcagaaacaagaaaattctcaccttgaatgagaagcaataattaacagatatcaaatctgaaatgatacagatattagaattatataatatgaatgttaaaatagcagtcataaaattgctatatattagttacaaacaccattgaaacaaatgagaaaatagaatatctcagccaaaaaaaattcaaaattattgaactaaacaatacaataattgaaataaaaactcaatggttgggcacaacagcacaatggacgggacagagaaaataaacagttaacttgagacagagagaacaataaaaattactcattctgaaaaaaaaacagggaaattggactgaaaaaaataagaagtgtctcagggacccatgaaaatgtgacagaagttctaacatgtatttgagcagagtcccctgagaagaaaaagagttcagactcagagtatttaaaaaacataaaggctgaaatttttcaaaattgtgcaaaaagtatgaatttatgtattctggaaatggagcaaacctcaaaaagcataaagtcaaacaaattcatgtcaatcacttcacaagcaaattctgaggactaaagacaaagaagaatacttcaaaagcaacaaaaaaggaataacagcaataggaagaaaacaatccaaatgacagtgtagttttcaccagaaacaatgaaggccagaaggaagtgaaacaatagttttaattgctgaaaggaaaaaaattgtcaatccaaaattctatatctgtgaaacacatcctccaggaatcaagagaaaatcaagacatcataagatataagaaatataagaaaagtatttcattaaaggaatggctacaaagatctctctcaacagagaggaaatggttaaagaaggaatcctgaaacatcacaaaggaagaaaactaataaaaataattaaaatatatgtaaatataatacattttccttttccccttaagttttttaaagtaagggtgatggttcaagccaaaattttaacattgcctaatgtgcttctcaatgtatatagagaaaatatttgtaacaactaaaaataggggaagataggccaggtgcagtagttcatgcctgtaatcccagcactttgggaggctgaggcgggtggatcatgaggccaagagatcaagaccatcttggccaacatggtgaaacctcatctctactaaaaatacaaaaattagctttgtgtggtggcacgtgcctgtggtcccagctacttgggaggctgaggcaggagaattgtttgaaccaaggaggtggaggttatggtgacccaagactataccactgcactccagcctggcaacagagtgagactccacttaaaaaaaaaaaaaaggcggtgggcgggggaggggggggcgaagataaagggacatttaaatgaaagtaaggtttctattacttcccttgaactggtaaaatgctaacactgttaccagaaaagggtaccaatccataccccaagagagggctcttagatctccacaagaaagaattcagtgtgaatccacagagtaaaatgaaagcaagtttattaagatagtaaaggaataaaagaatggttacttcataggcagagaagcgttcggggctgctagtggcccatatttatggttatttcttgattgtatgctaaacaagaggcaaattattcatgcttccccttttaaacaatacagcataacttcctcacattgccatgacatttgtaaactttcatggtgctggtgggagtgtagcagtgaggaacaccagaggccactcgtcaccattttgtttttggtgagatttagctggctttttttattgcaacctattccatcagcaagacctttatgacctgtatcttgtgccaacctcttatctcatcctgtgactaagaatgccttaacctcctagtagtgcagcccaataggtttcagctttattttacccaaccctttttcaagattgagttgctctgtttcaaactcctctgacaacaccaatagtcagtgtgaggaccataggctcttggccccctaaaggtctgctgaaagatcactgacatgagacatattcattaataggaaaaaaggcatacagacttacttaattaatgtgtatacctgggagccttcagaatgaagactcaacttttcagtaagtaataaaagcttatacaccatcttgaaattacagacataatgcagatccagagtatctccaaaaacaggttttaatggcaagagaggttatgggagggagaaaggaggaagattgactctcaaagtggccttgttgtgcagaccaagcctctatagagtaaatgtttcttttcagacttttaaaaatgtcacacactcaatctctcctagacctggaaacggcatggaaaggagaggcctgattgcattaatggagattctctacagatgcaaattttcttcacaaaagacaggctaataagaccacttctgtttgctggccagaaggcagccatttcaaatatgtcaacatatatattttggggtaaaatatttgaatttccttcaacagcgatctatctatctatctatctatctatctactatctatctatctatgtagataggtagatcacataaaattgattgaccaagtagacaaaaagatatatagaaggactcagaaacattatcaaccaaccagatctaatgagcaaatgtatagaacgtacagcagattacacattattttaaaataccaaagaacatttactgtaactgtatgaggggtactttctgcctgctgcacaagtaaagaccacagtattgcagtaaataaagaaagagtttaattgacatgagtccagccactccatgcaggagacagaattattgctcaaatcaatctctccaaaagctcataggttaggagtttttcaaaggtaggttggggggaaggggtgaggttgatcaggtaatgtgtgagagattaaatcctgggtggaaccacaggagtggggttggtggggccagatggagccaggtgttagacatgcagaaacctgaaaagatatctcaaaagaccaatcttaggtttgacaatagtgatgttatttgcaggaatggctagcagttgtgtatgtctacactttactagaatgcaggctcctctactcttccctagtcaggtgatctctcattagctttaaaaggtggctgagttttggcaaagggctattaccatttaaactataacctaaatagcttccaaaattagctctggcctaagcccagatgtaattcaggcatgttgaaagttaaaggcaggaggtgggtttgggggggttagctcagatctttttagctgtcaaacttttctcactgatacagtttttgcaaagctggctttattatgatgatataacatatttttgaccaaaaatgagtaaatatcaatattttaaaagaatggaaatccatacagtgtgtgttctctgactatagtggaatcaaagtagaaaccaataacagggagatacaaggaaaatcttcaaacacttcactagagtgtgagcacctaacagaaatttttaaatcagtttgttctctgttatgtttatagcatgtaaaacagtgcttagtatatagtagccacacaacaattatttgaaatattcaatattgcaaaaaacaatcataaaaatcctctcatttctcctggttctgaattctgcatttaagtttcattgactttttataatttaattatccctttccaaaagttcatttattcacttatgtttttgcactcaacatgactataaaacctttaatttttaactcaagttaacttctttatcttttctcctatgttcttgccaaaggatgaccaaaactattcattcaaaggccatagcagaatgctatctgacagagagatattgtggatatattcacaaaggcagtattttcaagccaactatgaagaagggtagctttcaaataaatcagtaaattaaagctcagtacatgaaatgactctcagcttgagaaaatctacaaagaaaatggaaaagaagcataaagcaaatgagagatgtaaaaaatataataaaacctatggaaattggccaaaaaatgtgatgagatgagacttaactgactagtagttagagaaaggtaaagtctgagtgcctgacatcgcgttagggagccgacataaagtggtcaagtccttaacttcaaatgatgaaaggctcaagtattggagacccaaagttcttctaaagtcttggatatggggatgatctaaagatggagagactgatggaacctgtgtttaaggttttagacaagaacatctcttgtcatagaccaaagacccttcttccccagtatctagccctaacaacaaataaacatgatgtttgcttttggaatgggtgaatcaaaggttccgggaatgtgctccaggtgaaactgtgatgaggcattgcactgcaaatgaagggattaaacatggagagatagcgatatgtgccaggtaccctccctcagcatcactcctctcccagaatacagaacctaggtctgtaagtccttggcaagtaaatggaagattcttttcagacaaaacaaacaaacaaacaaaaacaaaaaaaggtaatctcaagagaaagcctcaacaacagatgttgacatttggaagctcctcagcatctgtaaggtgtaccaatcaaaaatctagccacatatatacagtttccactatcatttttataccatgcatggatgagtgacgaaagtcactagtaaacacactgaagaagtcaattttaaaaaggaagacatggagttaggaaacagatcctacatagaaatatgatacaagtttccaggaatgggatgaatagaggactcagggcaacagctgtgtagcacacaacaaacttaattagctgacatgggaacaggaggatgtatgagtccaggagagagatagatttttaaaaaattaaaaatcacactatcttatgattgaaaacattaaaatatgtgactttgttaagaggagttttactgttctttaaatttgggaatcaatttcatgacagacaagtatatagaaaactaggaaaatttcaaaagccatttaggagcttcaggaaatgctaagaattgcacaagatggaaacataattatgctctgctcattgtattcagtgggaataatatttcaaagtaattacataaacattgactactgactcactagaaaattataattatatttacaggtgaaactggaatataaaaagtgtatgtgtgtagcattgtttatgagaaatcaatagtttttttccatagtagagatagcattttttaaaatggaagacaataaatcacaagtatattatttagaaatatggaatgagtcataagaagaaatggcacaagatttgcgtccgggcaggtgaaagctaagtggagataagggcaaaaagggattttttttgtggttaatacaattcatgtagaatattagacttttaacacaggggtcccaactggtaccagtcagcaggaggtgactgctgctggtcacacagcaggaggtgagcggcaggtgatcatgctttacggtctgagctctgcctcccatcagatcatcagcagcatcacattctcatagaagcacataccctattatgaattgcacacgccagggatctaggttgtgcactccttatgagaatctaatacctgatgatctgtcactgtctctcatcacccccagatgggaccacctagttgcaggaaaacaagctgagggctctcactgattctacattatggtgagttgtataattatctcattatatattacagtataataataataatagaaataaagtgcaccataaatgtaatgagcttgaatcattcctagtccaatccccaccacttggtctgtggaaaaatcgttttccatgaaaccagtccctcatgccaaaaaggttagggactgctattttaacatacataccttactttgatacagataaaaattaagcattaaactgaattatatgaaagaaaggtcaatctgatattattggtaaaaaatattggagggtgacgtttgaatcaaggaaaacacttaggagatgcaatgaggtgctgaaataagcttgcagtgaagaagcaaactggacgaattcctaaatcccagttgttttatattcttctgtaaatcaagtgcaaagtagagtgtctggcattctggaagtcttcattaaatttaatttcctccattaaaaatgtgctttattatttaggacagttttagattgacagaaaaaattgcaaaaataatatagagatataccacacaccgaggctcccctattaacatcttacatagtatggtaagttggttacagtgaatgaatacattttgataggtaaattgtaacacaagtccatagtgtatttagattttcttagttttcatcgatagtccaggatcgcatccaggacacctctgtatgtagtcctcagatctcctcaggcacctcttgtctgtgacactgtataagaattcatttgttattgctttcagcaataatgatatttggtcaatgaagggccacatatattacagcgtatcataagattataatagagctgaaaaatttctagttacatcttaatgatcctgaccctgtgtaggcctaggctaatatgtgtgtatatgtcttagtttttaacaaaaacattttaaaaataaaataataataataaataaaaaggcttatagagtaagaatataaagaaaatattttcacacagctatacaatgtgtttgtgttttaagctaagtgttattaaaagtcaaaaaaataaaaagttttataaactttttactttataagtaaaaaatgttacaataggctaaagttaatttattactgaagaaagaaaagtattttaaaataaatttagtataacctaagcatcgagtgtttacaaattctacagtattataaagtagtgtgctatcattcacaatcactcaccacttactcactgcctcacctagagcaacttccattcttgtaaaatgaaaaatatttgggaaaaaaatacaacaataagaagtaacacaaatttaaaaagcaataacgtataataactatttactatataggctataatacagcaatatggtataacagctttttaataactatttatatagaacttacattgtattaggtattttaagtaaagatgagttaaagtatacctggagatgtatgtagatcacatgtaaatactatgccatcttatatgagggacttgagcatctgaagattttggtattccaaggagatcatggagtcaatcccccacagatactgaggaatggttatgtatacttctacctatatagatataaaatttcttactcacagtaaaggtttcatgaaaagcaaaaatcaatgttatttcttagttttgtggtaattcacccctaaattaccattatgataaaagttacagtcaaaaatattatttaacaacaatctaaaattacaagccaattttactaagtaagctttgcagaaatgtaaacataatgattattattaatatcaatatttacaaatggtatgaatctgtttaaaaactgtattgaagacactgttaaagaaaacagacactaatgcaaatattcaaatatgtatatatacactttttttatttttaattttttgagtcggggtctccctctgttaccaagcttgggtgcagtggcatgatcatagctcaccacagcctcaaactatttggttcaagctgtcctgcctcagcctcccaagtagcttggcctacaggtgcataccaccatgcttagctaagcttttttatcttttgtagagacagggtctcacaatgttgcttagcctgttctcaaaggctcaacctcatgcaaccctcccactctggcctcccaaagcactgggattaaaggcatgagtcactgcacccagcctcaaatacatttttactaataatttaaaaatattctcagaacaaatttactcaattgttctttctatattatgccaagaggcactgttgggactatatgttcaaatacaattcattagatgatttgaattagtgaatctttgtctcacacagccttttaaatatatatttgtctaactcaattagaagtcccatgccagagttttcagttagagaaacagtagattagacaaaaggaaataatgatgtttaatacagggctcctcagagacattaccatctaaataagtgttaagaaataggagacaggaagaggtgcagtggcttgcacctgtaaacccagtgctttgggaggcaaaggtgagatcacttgaggccaggagttggagaccagcctagacaacataaactacatttctacaaaaaattaaaaaattagttgagcatggtggcatatgcctgtagtcctagatactggagaggctgatgcagaaggatctctttagcccaagaattcaaggttacaatgagttataatgaagccactgcattccagcctcggcaacagagtaagactgtgtctcttaaaagaaaagaaaaacaataaaagaatagaacaggggatgaatatatgggcagtggctcctagttcctgcatttcaatccagagaattcaccactaactgaccttggtaaagttacttaacatcactgtggttctgtttatattacagatgcatatttgcagaaacaaaagtggaattgtgcaattttcaattctttgcaaagctaacaaggaatatttaaattttaaatagtctgcattatctaatgaccttaagtcacatatgaaggacctgctacaaactacaattttcagtgggctttagggaatgttaatctcctttttcaccactacacctgtagcaagagagaaaaacccaaaaccctgagagcttgcctggggaatgaatcaaagggaatgaagcaagaaacctcagaagtgctgtaaatgtgatctgtaaaagaatttataggaaagggcctttttttgtaatttattctctttaattagatttttgtaaaattatctagggaggtaagttctgtgcctaagtcttctaagatggaatgctattacttccttgggaccaaggaccccattgttcatttaaagtagcatcaaaaatacttaggaataaatttaacaaaattataaaatacctattctgaaaactaaaaatcatgagtaaaagaaattaaacagagcctaaataaatgaaaagacataccattttcatgtattagaaaactcaatattattgtttatattatcataataatcccaaaattgatctacattataaatccctataaaaaaatcccagctaatttccttgcaggaatagacaagctgatcctaaaattcataaggagatgaaagagatttcaaatagctaaaacaatcttgaaaaaaacaaaagagtttgagggttcatatttcctgatttcaaagcttactatgaatagacagtaatctaaggtggtactggcataacgatagacataatagatcagtggaatagaattgagagttcagaaataaacaaattcatagtcgacttatttttagtaagagtacccaaaccaatgaagaaagaactgtcttttcaacaaatggttctgggacaactgaatatttacacatataataatgaattttgaaccctacctcacaccacatacaaaagttaattcaaactgcatgaaaaatctaaatttaagaactaaaactattaaaactcagaaggaaacatacatgtaaataattttgacattggttcaggcaatggttttgtaaatttgccatcaaggtgcaaattacacaaaacacagaaaaaacagataaatggcacatcataaaaatttaaaacttttgtgcttcaaataacactatcaatacagtgaaaagacaatacacaaaatgggagaacatttttgtaaatcacaaatctagtgtggtatttatatccagaaagtgtaaaaagttctcgcaactcaattaaacgggcaatcaaaaaatgggcaaataatttgactagatgtttcactaaagaaggtatataaatggtaagcaaatgaacaaagtgccatcagggaaatttacatcaaaaccattatatacaactttatatcaattagggtggctataatcacaaagatagataataaggtttattgagaatatggagaaattgaaattctcatacattgttgatgagaatataaagtgacatggccacattgaaaaacagtctgacaattcccattttcaatacttggtatatatgcaagagaaatttttacaaatgtgccataaaatgcttgcacatgaatgttacagcagctttattcacagtagccaaataaattaattgtggtgaatgcacaactgtgactatgctaaaagtcattgaattgcacgctttaaatgggttaatttcatggcatatgaattatatctcaaaaaatatattcttagaaagataaaaactgtgtatattcacatatctataaatatttttatgcataaacatcagtatcaatattaagctaaacatgagtttatactgatgtccccaactagtttccacaacctcgtgaaatttttagcctcctcatcttgcttatctgttagttcttctctaacacagagaaacctggattcccttcatccaccacccgtttacttgttaaatttcaatatacatgtataatagtattaggattgttaacctgtatgtactgtgaaagggccatttatgcaaagtagcccccacatgctgaagaagccaaggaaccaaagaatgagacagacaaatcgactttgttctaaggggtgttttattggcagaacttgcagacagaaatgtggtcttggttggctgcaaggcaagtagatctctgcactgttactcctcagatccagggcttgtataccataaggaagggtgtatatgctccagcaagacatttaaatgcaaccatccagaaaaggcaagaatgacatgttcttacaacagagatggtaaatcaggatggtaaagcagaaatcaaaatacattcatgggactgggatagttaggaatcgacatggaattccgagatggaatcactcttgtcttcacaccataccctgatgtgaaacaactttatcaaccagaatacagttccatgtgcagttcctttagcctttcatctttagcctttgtcttacagatgcttgtgccttacttcatttccacagtgacttaggtcacatcatccccctgccccatcgctgaggttgtaacatacattcgtaatgtagttcaagtgtcacagactgcattccttctttagtcctgaataatttttagacatttgcatacattaaggttactcttggtgctctaaagttctatgggctttgacaatgtataatggtatgcaatttctattgtaatatcatatagaatagtttccttaacatggagattctgtgtcaatgtgggtttgtcagttgtaacaaatgttcccctctgataggagatattgataacatgggaggctatgcatgcagaatctccatgtctttttgcagcttgattgctcatttttaaaattattcaatacttcactgtatagatgtaccacagtttgtttattcattcacttattgaaggacatcttatttggctatttatacttattggtgataatggatacaggtagtataaatatctgcatgcagatttttgtataaacataaactttcaaattatttgggtaaagacctaggagtatcattcccagatcatatgttaagactagggttagctttgtaagaaactgcaaaaatctcttttgcattcacaccaataagaaatgaaaattaaccatgaacagtattcttgaaagcatttggtattgtcagtgttttggattttagccgttttaataagtgtataatattatctcattgttattttaatttgcaattccccctgacaaatgatgttgaacatgtcttcataggcttgcttgctatttgcatatcttttttgattaagtgtttgctcaaatacttcagccactttttaattgggttgtttgtgttcttactgagtgttatgagttatttgtatattttggatacaagtcttctatcagatatgtgatttacaaatattttcctctagtccatagcttgtctttttattctcttagcagtatctttcacaaagcaaagttattaattttaatgtattctcatttatcaacatttttataaatcatacttttggtgttgtatctaaaaactcatcactaaaccaaaaatcacatgggttttctcctgtattctcttctagtactactgtgtttttaatatttaagcctatctatgatacactgtgttaatttttgtgaagagcatagtatacatgccttttcttcttatggatgtccaattcctccagcactgtttgttggaaaaaaatatctttgcttttctctattgaattgtttttattcttttgtcaaatattagttgattctacttttttgtttccttttttttttggccacctgttctgtaccagtggtctaaatgctttttctgtcaaaaatgccatgttgtgttgtgtactaaaactttatagtaagtcctaggtcaagcatcctgagtcctccaactttattcttcttcagtattgtactggttattataggtcttttggctgtccatctaaacctaaaaattagtttgctagtatccacaaatagcttgctgggatttttattggaattgcatagattttaaaaatcaagttggaaaggaatgacatcttaaaaatattgagtctttcaattcatgaatacggttatctcttcatatgttttgaacatatttgttttttctctagattttttagtttcatatataaatcctattagtattatgttagatttataccaaaatatttttcttttattttttatttacattttattttttattttatttatttattcatttttttgagactctgtctcactctattgcccaggctggagtgcagtggcacagtctcggctactgcaacctccacctccctggttcaaacgattctcctgtctcagcttcccaagtagctgggattacagcgcacatctccatgctcggctaattttttctatttagtagagatgggggtttcaccatgtcggccaggctggtctcgaactcctgacctccagtgatccacctgcctcggcctcccaaagtgctgggattacaggcatgagccactgcgccaggccacaaaatatttcccttttagtatgtgttattttaaatggcattatgcttttaattttcaattccaatttctcattgctgatatgtaagaaagcaatttaatttttataataattccatattctatgaacttgctataattacttaccacttctagaagaattttttttcaattctttgggattttatacgttgacaaaaaacaaagatagtcctctatttttgttcatttcataagcctttatttcatagtatttcatcactgcgctagctagaacatcaagatattgaatggcaatggtgaacagggatatcctggccttattcccaatcttgcagggaaaatattacatttctccccctttttactacattgcaccatgagttttctgttttttttttttttcattctaattcttcattttatctcaggcctgttgggatagaaagaacagcagagatcagagaaaacttggtttcaatcacaacttggatcttggtcaagttaatttcactcttttacattttgattttctcatctgttaattagaaaaacaatttcctacaccagtgggttgctgtgataattacttagaataatgtttgaatgaatatttattcatttaacattttaatacctaactttgtttcatgacctgtgctaagtgcttgtgagataactttgtgtaagacataggtccagctctcagaaaacttggaggaaaaaagtcgagggcatagttctcttcaataaacaattctaagtgctatgagagctataagtacacatagtagatttttatttattttttattattatacgttaagttctagggtacatgtgcacaacgtgcaggtttgttacatatgtatacatgtgccatgctggtgtgctgcactgattaactcatcatttacattaggtatatctcctaatgctatccctcccccctccccctaccccatgacagtccccagtgtgtgatgttccccttcctgtgtccaagtgttctcattgttcaattcccacctatgagtgagaacatgcggtgtttggttctttgtccttgccatagtttgctcagaatgatggtttccagctttatccatttccctacaaaggacatgaactcatccttttttatggctgcatagtattccatggtatatgtgtgccacattttcttaatccagtctatcattgatggacatttgggttagttccaagtctttgctattgtgaatagtgccacaataaatatacgtgtgcatgtgtctttatagcagcatgatttataatcctttgggtagatactcagtaataggatggctgagtcaaatggtatttctagttctagatccttgaggaatcgccacactgtcttccacaatgtttgaacagtttacagtcccaccaacagtgtaaaagtggtcctatttctccacatcctctccagcacctgttgtttcctgacttttgaatgatcgccattctaactggtgtgagatggtatatcattgtggttttgattttcatctctctgatggccagtgatgatgagcatttattcatgtgtctgttggctgcataaatgtcatcttttgagaaatgtctgttcatatgtacacatagtagatttttaataattagaggccatcatcctcattattccttttccaacttcagctactcttcctcagttgtcaaaaagaactattaacattctctattttctttccattattgttctacaaacaataatgtattggtttctgtaacacaaaattaatacaaacaattttccaatgataatctctttagtttctgcatgatttccacttcttcctaacttttttccatacaaatctcaaaatttcaatacctgagatatgtgatgccaacttttttttggtgtcatgtatatttttcttccaatatagttcatacaatctttctctatatgcaacttataatataatattccaaaaagcagggatgatagttatatttttctacaaagcatactaagtatttaatacaaggctttttttgtaacattgatgttgattatttaagtgtgcagcaagtctttatacagtccgatattaatcttgggctcaatcctttgcatttttgtaacgaaaaagaagattaaataaaggcattatatatatatgaaactgtataggagcatcagcctggattttgtgttttacaaaataaaatcactgacaatactttggtctcccaaaggacggtgctttgttacctggcaacagtctttacgacactcatgatgtgttaactaaatatactttcagatcagcttccagatattgtctgatttatgagctgagtatttgaaatggttcatttcttctttttattacgtctattttgggaggaggaaagaagcagaggtgtaaggggataaagtggcagagctaccgcaaacacaaacaactgggaatatattagcagaggccacaccaagaacagttatttcccttttcatgcttcctgctgcctgcagtgaccaatgtgcaatcttggttttaaaacactaagtaacttgttttgccttgtctctcctaactttcttaaaagtaagctaatgaagaagcagcatctggagacactggctataatttgcatgttgtgtgtgtgcccaggtgtttaataaaacattaagataagtgctgtttttgagattcttttggtggtttctgctgactctttagtctctccaaaatcttttctgcatcagcagttttgtatttgatttggaacatgttctaaatattctccaccagagattagagagtgggcttgtagagcatgagtaaagaagttcaaagaaacggtttttgaggaccctgcgatgcttgttgtttctgtcaaaggaaagcagcacttcagtatgcatttagctattgagcagcaattactgaccgagttttcctcatggccaattattgctaggcaaaacgctctacaaaatttaggggatggcatttgctgcttaaaatgcatttgctctgactgaaatttgtattttaagacaactgatatgggttgtctggatgactgcaccactgattttgatactgttttaaggaatcacatatttactttttacagaaaaggaaaaaagaaatagttcctgtcatacaagaattttagtttagttgggttgtcagttttataaaagcagtttacctatctattttgtaggaaaaatagtcacgatttaattcacctattcctgaatcttagtcttccagtatttgagttattctatgatgtaaatatattaaaatgactattacataagaatccctatataggatatcagattgtgtgtgtgtgcgtgcatgtgtgtgtgtaaatactaaatttctactctatgccagggtcttttacaaatgttaattctcaagacaaagcttttaattgctatgtattatttataagcattttccaaatttgaaaacagaggcttataagtaatttgctgaatggatgaagttgtatgaagctgtagctattagcatcattggcacattgtctaacttcaattccagtattgtttgcaatattcaacttctctttaatgaaccatttaatgagaaataacaaatattaattaattattcgacagattgcatttctccttttcaataaaaagacatttctaatacatagtttattttaaattattaatagattttgtgtacttataatgcacatgtttaaccttcctttttgcttttgtatatgcagccctgtttatatgtgtaggttttgcgatataaattctaaaatatatcttcccgtatttgtggttgcattcctggggtaatgcaacaaacagtatgctgaaaaataaaaacagactttgtggtagtatttaatacaaatagttcatcttatatttcaagttgctttgcataaattgttatacacatagaaacttatttgtacaattataattttaatgttggtttgaaagtatgattggatgacagattataagagtaacataagtatttttgaaatagatgaaattactcagcacattgtcaaaataaagaaaatttattttatcgaatgctactcatttgcattcaatagtaataataataatttctaagtaaatatgcaccatcttcatcaaaaagtcttattttcaaaattcaaaataaatcaataatagtatacctcaaattctggtatggcaatcttgttctttaagtattattttgttctatttatagaaaccaaacttttggctaaacaaggaagtttttaaccttgccaaaatgaagagtcttatgctatcttaaaatatttagcaagagccaccagaagcacacatttttccaattttcactagttcttttaaaataatattatctgttccacacagtttccgcagaacaagagaatgagggaagcaattcatctgtaagaaagagggcagtatttacatttggaaatggataatgtgggcaaaaggtatttgtagagatatagggaccagataacaaatatctaccccagatgcaggggaaaagggtcagtgtctcaaatgattctgcataggggaatgttcaaaaagattgatgtaatggagcaagctataagttaaagcgttcagccctatagcatgcctccgcagtaagcactatgtaaagatgactgcccaaaatcagagcagtatcgatttttcaaattgaaaattacaggatttgtctaaatgtagctctttgttctcatgccatcatctttgtgattttgaagttttataggccagtgattgaattacttctattgtggagagaaaaagaaactgattgttaaagttgataattcaattatcattattacttagatgtgtaatttattcattttatgaacaagcaattagtttattttggacttggtttattcactttcaatctaaaacacacacatgtagcatttctgtgctggccacggcagcctcccagcttagctcccgaattccaggcagggatggagacagggccatggtttaccaggatcatatttaccattgcctctgagttacttttatataacctaaaacttatcatttcttagaaaataagaatacgtaatgtggaaataagaagaggtataaaagttaagattccaaaatatgtccaaaataatcattgagaagaacttatttttaagagtttaggagtttataacgcttcagtccctgttattttaacaagtaaccctttgatttaaaagtcaaagactatttattacaagatgtggaggcactatcccagcacagaagagttctcttttgttttaaagagcaaaagcaaaacccagaagaaaaccaaaaaaacaacaaaaaatggtgtgtaagtatagtattaggaaacactaaccattcttaaaaatcctgtctttcaggaaagaacggtgaccatcagaagacaaacagtaggaggatttggattaagcataaaggtagcctgcctttctagtctatccttacaaaggccatgccataagagctgaactttggtgcatttcaatgtttgctgattaataattagacaaggatggctatagcaaactccttaatatttggacggggatgtaaattaggtaggttctcacagaattcctgcaaactcttaccatttgatttagaaagtttagcaaagaatatgggaatttaccttatgattgaatttaactcattaactttctttgtctggtttttctgaaatgttaaatatgatgtcgtgtgcatatctttctttaaccaactggagtaggaaatgatgatctgcagtaaatagaacaataacaagtttcacactaataaagcccaatagtaagtgagatattgtattctgttcatcttgtttatttttcatttttaaaaaagaaatcagtaaatttaattgtatagtgctaatcatataggatagacttaaagtctttgcatatgctttattttaaaagtgaacatatgtgttcatttaaatttattatcaaattttaaaggcctttattttgtatattattgactattagagatgtaccatatctgcaatttattatcattgaaataaaggataaatttttaaagcataggaaattatgtaaatattgaagagttaatctcatgactgcaatgcctttgtcaaacctacatctcttcatagataaatgaagtttaactttataattattgggttagttatttgacttatatagggtgaaaataatttatatatttcaagtacacattgcttgaaatttcaacacaactcatgtcatatatttatggaaagcagaactctaaattttgtgaacatcagctctagttgactttgtgaaaatgactcagagtagaaatcagtatgcaatagcgttgtattgtcagtgataagaaaagaatattgctataaagagcactagcttcaaaacatattttgtacattcagtttatcaaagtgaaactttatcttatcaccaactaagaccagggaggcatgcagaacagattataggatgtgcaatgtattctatgagaatttaatcactcaataaatgagatttttttttgttttgcttttttttttttttttttggccaggctgtttattgagattgctgtaaagaatttaaaagtaccactaaagatactagaaaatccatgaataaaatccaatagtgagagctgatttcatctgaaatcatcatttttactgaaccaggcactaactctatttctggtagtagagcttccattaattttgtgtcacctagaaatgttcttttcctttttttgttgtttttcgtattttaaatttaaacccaataatgcaatgctatctatttttactaaaatgccacattttaacctagtttttaaagcatcaataatttttctaaataaagcttttcattttaatattttcattatttcaatccaatcaaaactattgtatatataataaatagaatattttttgaattaaataagtatgaattttccattcaattattgaccaaaaagtggtatttgagctatgatcaatatcttatattagagttaacaaaaaagaactttttgcaaaattcttatgacacactctgacaagaaatacaaacatcaagacttttatttagaatattactcattcatcctaaagaaattccttttatggttttttatttttactttctcatacttacctctgaacttcatttttctattttttaaactatcttttattgtgattatttagatcaaaatatgattctttcttttaactagcagtgttattacaaaaatctctttccctgtcatatatgagttgaataaactactgtgtttatttgttagcactattttccttagatctgagaatttaaaaaaatgtataaacttttttaaaaatatcattctaggctagaagcagaattagtattttaatgttgaactatttatttacagttttcaggagcaatttgagccactaataaaagtatgcatataaatacataaacgcatatcttaccactatttgcttcagttaagtaatcctcagcggcacacaccggaaagactcgtggtgagaattattaattaaaacctttatggtcttgacttaagatgacagaaggaagatggtatgttagacaactgaaaagccatttaccaatgtagttaagactcctacaggtgcttgtgaattccgctggactcagaacacatggtattttagttttatgttaaaaacacattctttaaaaaagaaaaaaacttggttaaagggtaatgaatgtcctttttagacagaattcagtcaaatgctctaacatgtgctgctagaagtcaaagccagctggccatgccctacactcttgacagatcttggcttggggactttcctgtcacagtcaccactgtgcagcatggtaattcctcacatctccccacaaactggacaaggacagtgtggtggggcttcttatgtaggtctgagtccattgttttgttgattaatatgtctcagcggctgtgggctgtgggcaacatgaagtctctgtagctaccagtgtccacaaatccttgatgtctgctgctcatgtgcaatattgctgtctctctcaagccctgtctccagccagggtaccttgtagggtacaagttggtgggaaaataaaagttagcctttaccttcatttttcttctttaccttatataagacattgtacaaacttctgggacaaaacgtgcaggtggcttggaggttgaggcagttcagtgtccctacggcttaattctaggactttaactcttcccttgatgtactaatgctagatatgatgcagaccacattgaggagggttcctatgtcaaaaattcctgaaatcccaaagaataagagaaaaatatatatttagtagaaatgaaaggaatattgaaacagctttacattttaaaaatatgacttaagtaagtccgaatcctttttcttttcaaattttgtctagttttctttccattattccttaatttttctctttaaattttttgaagcacattctttggagtttcttaccaaatctgagcctgtccttggaaagtcatacttaccatttcttcaaatcatctccaaaaatgctagacactcagtttgaaacaaagccacccaaaaagagttctgacatcaattacattgagatttagggtaggaattactgatttatcttcatggacttatttgtcctttagattcctaaactcctattgttttataacaggaatgttttaccattaaaaggtaaagaccaaaattgcctgtttctccatgttaattctaaataataagaaaaaaaaagcaaaagtaaagcccgaaatgacgtatgagcacaatgtccagctttagcgcatgctgcacatggaaaagcagatgccttgaccagggaggtgccacacacaggctgacactctcgcatccccatctcccagttttgatgaactatttgcactcagctcctaaagtgaaaagaaatcctttttaacctctggggagaatgtcccttcctggttgtgctactttctctgctttcttgtctcattctacagttattctttcattgctgtttagcaactgtagaaggatcaaatgagtaactgagccataatataatgagatgaaatttggagtcatgacacacatttgcaccggtccctccactgtctttaagtgaagcaaatccctactttagagcctggaaggagacagccatgcctccttcctctcttattagaacccttctagggctttatgcacctggctcactcctgctcccagccctccaggcatccttgcttatccaagatattctttctctcaggttgcctttcagaggcatcctcactcctgctgtaacttttgggattttttgacagtgatttagatttcttcctgcctgttattatttaattttcctttgttaaaacatctctcagaaatcacatacttgtgtgcctttttttctttgtattaatttgtctatcagtaaaaaaaaaaaaaaaaaaaaaaaaaaatcaagctcttcagtttacttttcacaaaaatttcaacaaaaagccctatctgggcttcccccaaagctggacaaaagaaccactaaactttcaactcataatcacatagtctgctgcctgttctcaggcagaaactgctcctttgaagcgggcagattcagcaggctagtggcatcctgcacatggcctcgggcctggctgcttttccctgcttgcagcaccatttctactggcatttcctggttcttctcccagccccaccaactcttgtctccttcccctctcaagtgcccatcctctgggctggaccatgcagagacttggcatttatataaataactttaatagtttcctcaactacatctgcagaaatcaccaaatttctgcatcgtaggatccaatattattgtattttgccttattcttcctatcgggattaccatagggatagtcatgttaaagcaagccatcgtcttgcccttgtgaggctttatttatctctcatatcttttaaaattcaatactatctagctgcacattattaaattatacttctgttcattgtcatttaaaaatttacctttgagggaaaggatgttttaaatgttattactataaatatattttatgcagtattttccaacagacacaattttcttatgaaaataataaattatctatgtccattaaataaatgtatgcaatcaaaggtgatttctatttggaagatttaacactacagcagtaaaaaatagaattataatcattattactcttaatcatcttctcatttctaaataattgctaatatttatgccccacttattaagtgccagtttctgagctaaatacttcatatttagttcaatttgcctttattatccagtggagtagataactattgttataccttccacagacaatgagattaagtgtcaagaggttaagtaattcatcaattgttataagcagtagagttggacctcagtccccctagaagccgatgacaaagtccttactcttaataactatgcttagaactataaaacctgaaataaattacctcaaaactctctactcagggacatagatcatgtttcctctctatgctgtttactttctggtttatttaaaactgaaataagaccaggcacggtggctcatgcctgtaatcccaggactttaggaggccaaggcaggcggatcatttgaggtcaggagcttgagaccagcttgaccaacatggtgaaactctgtctctactaaaaataaaaaaaaaaattatctgggcatggtggcacatgcctgtagtctcagctacttgggaggctgagacaggagaatcacttgaaccggggaggcagaggtcgcagtgagctgagatcacgcctctgcattccagcctgggtgacacagtgagtctctgtttcaaaaaaaattacaataaaataaaataaaacaaaactgaaataaatgtgtagctcaagtaagcaattttgtaagataaagggttgagtactagtcgtttcaaattttccaaataaaatatatatattagttgtaataaatgtatgccttttaacttattagtggtatctgggcaaaaatatttaaataacaaccattgctataagtgcatggacgtgcttgcatacatttttctgcattctgcttcccctgccatttttactcaagtctgattcacttgttttcactctagacaaaatgaatatgtccatttccatcataaaagtagataacagggacaggcacagggctcacacttgtaatcccaacattttgggaagccaaggcgggtggatcacaaggtcaagagattaagaccatcctggccaacatggtgaaactccaactctactaaaaatacaaaaattatccaggcgtggtggcacacacctgtagtcccagctattctggaggctgaggcaggaaaatcgcttgaacctgggaggcagaggttgcagtgagccaagattgtgccactgcactccagcctgggcgacagagcaagactccatctcagaaaaaaaaaaaaaaaagaaagagataacaagcatacagtaaagcttaaattgagggttatggattagtcccaaaaatgagttgaaaccactggtcaattatcatttcaaagaccattacattttttttcattacatagctttattgaggtataattccaataccatacaatttacccatttaaagtgtacaattaaattgtttttagtatatccgcagatctttgcaagtatcacggcagtcaattttagaacattctatcacttccagaagaaatctcatatttattcatcacccttttatcccctatctcccctctttcaaacctgagcaatgaccatttccctattttagactttcatatgaaggtaatcatatagcatgtgagaaagacaattattttttgccaaaatcaaacgaagtatgttggcaggtaacgatagcatccagaaggatgatggcacatgcccgtattcctccaggtgatattcctttacttgcctcttctgtagttgtccattgcagctcttaactctaattactgttattctgtttacaagtagtttcctttctctaaaaggaaaaatagtggttagctctatgcatcttccctgcacccccatgcccataatatgattgattgattaattgattggagtaataataatattgaactgaaaagattacttggcaagactcctgatgctctaaaagcattccaggttttatttggtggtatttcacagtaatgctagtaaaaccgttgtgtagagtcattctcaaaatgctttagatggaattatacatccttcttcctacagagctagctataaaatccactatgctttgtaaaaagattatcacaaagctgaacgatgtatgtgcgaacattacctgggctgtgctttagaacactgccttccttttcctaatcttgtatttctccataaactacaataacaatgctcagttaattcaagcattctctaaaccacagtcatgagccacagtcccgcccaggagtgccttggggagaagatggtgatgaaagccttgcctggacctcaggccatttatacttcagtaggaaagtagactttgatcaaattgttaccagaataaatgtaaatcacaggcatgatccagtgctacataagtgtattatttcaagtaaggagacactaaaggagggggctttaagccaaaatttcaaaaatgaacagtttccaggttaggagggaaggaggagcataactggccagacaacagtgcatgctgacatccttcaggttcagggcgatggaggtccaggagctacactggaagagaggcagtttaaaggttctcattattattcaactgtcatggaagcctatcacctgttttaaacaagccacatgatttgattattgactggaaaaccttacatttccccatttaggccctgcactaaatctaattaactgtagcagctgagctgctcacattttctccagtaatgaaggcagcgtgattttgagttccaattttatcttctgagttttgtcttaaaattcagtaattactgaagtcattttcagaaattagtttaaaaagtacatcagagctccaaatgtctaatttaaaagcaaaaaaaaaaaacaggccaggtgcagtggctcgtgcctgtaatcccagcattttgggaggtcaaggtgggcggatcacctgaggtcagggaggggttcaagaccagcctggccaacgtgttgaaatcccatctctacaaaaataccaaaattagctgggcatgatggtgagtggctgtaatcccagctacttaggaggctgagacaggagaatcacctgaactgggaagtggaggttgcaatgagtcaagatcatgccattgcactccagcctgtgaacagagcgagactccctctcaaaaaaataaaataaaaacagaaaaccaaaaaccatgtttggattcaaaccattcaaatttcaggataaattttacatataagagaaaaactgtggtaaaataagtgttacattttgcatttcaaagatggttacaatagtctccacttaaccttgggagatgcattccaagaccccagtagttgcccgaaactgcagacagtattgaatcttacactgcatataacatatttgcttacatatgcaaattcatgataaagtttaatttataaattagcatagtaaaatattaacaataactaataataaaatggaattataataatacactgtaataaaagttatgtgaatgtgcttcctttctctcacaaaatgttgtattgtactgtaccctggataactgaaaccacagaaagtgaaacacaaataagcaggggattgctgtacaagtctgggtgttgaggaaagaatgggattattgagtcaaccctcagaaaaactctatctcaaaagccttttctctggacaccaagaataggtttcccaatgtcttgccatggtaatttgcattaatagtctatgcatttaaaaaaaatgggttcagtagcagaataagagaaaagggtgaaatgcaaaaacagctgaaggaaaatactctgataacagcctcactgaggagaccagcaaaatcattgttgttccctgtcccaaaatatctgaatcacaatatctggatgattgtttcatggtttaattctacctaaaagttcatcagttaatgattcatttgagttaaccagctttttccttctaagaaacatagatgcatccttaacatcctttctaatttccaagtgtctctagaggctatcagtgaccttacgctgggcctggaaaagccgtagacttcattcattcattcattcattcaactcaacaaacatgtcaaagatagaccagacattattccaggcactgggtttacatcgatgcacaaaacaaactaccaaaaaatgtctgcaccctgaagaaatgtgcattttagttaggaatgggaagaagaaagaaaacaataagtgtgagaaatgaaaaaataacatgttagacactgataactgtaatgggacaaaatagaacagataaaaggggattgggaatttggagttctaactcataaatattaagggtcttagaagggattagtcctaatcttatttaccactttaatgctatgtgagtttcctcataaatcttaatacatgggctgtgttagcataatagccttcctttattcagtgtttactgtgtgctaaataagcacttgatttccaccacactgtcagccacaaatcactatctctgttcaggtcagaggcagggtcatcttagacacagtctgtgtttgttagggacacacagaccaaaaagcagaacaagtgggagccattgtaacctacgccagtaacttcccccacagagctgaggggtgcggtgcatgaatattaggttgctgtgaaatagtgaggaaaagggaactgagcagtgggtttgaaattcagtgagtaggacagttttcattaccttaattatcatatttcttcttaatattctggaattagaaaggactctacttgccaaaaaaaaaaattcaatattcctgcttttctaaaaaactattgactattttatatttaagtatactggcaattcagtgttaaaaatgggcatgcaagggaaaaaagaatatctcttccaaaataattttttatacttgaaacaaaagcttaggtggtttacatattctgaagatagaacaacctcaatggaattcagattgtcttttcaactaggctgtgttacaagttctatgcttctttttatatatgacattttattcttttatgtactgatttcatttctctactactgcttttaaccttctcaactctgtaatacagaaatgggattctttttccgtttttaaggatttattttattttctttcacataagtttagcttacttgtctttcttttttcatatctcatttagtcaactaataaatagtactactgcaggccgggtgcggtgactcacccctgtaatcccagcactttgggatgccgaggcagttggatcacgaggtcaggagatggaaactatcctggctaacatggtgaaaccccgtctctactaaaaatacaaaaattagctgggcatggcgcacctgtagtcccagctactcgggaggctgaggcaggaggatggcgtgaacccggcaggtggaggttgcagtgagccaagatcgcgccatggcactccagcctgggcaacagagcgagtctcctccgtctcaaaaaataaaataaataaatacataaataaataaataataaaaatagtactacttcaatattcttggcagtatgttttactctgcaaattgtttagtatgtgctttcacacaaggaggaattcaatactaaggaaggaaatgcagatgaatccctcatttttcatgcatatgtgcattctgattttgtttatccatttgttctggtaaaggtctctctacttccttggtatcccaacgggtcactgcaccaccaaaagcccttagctgccagcacagaataacttagcaggataacagtaatatataattatctggtgtttggaatcctaaataagaatttctattggatagcattgctacacattgaggagaatgcctatctaaatacataatcaatatttgttgataaatgaaaactttcaaagccaattgttattattggatgtctcagcaaaattctaaacaggtagataattttcatgggagcactatctacttagaggagaaattccacaagtttatttaaattctgcctaatatccacttaacattcccttcagagcctgtatggtttcttagctaaaagcagcattttttttagattaaaaagtacaatatatgattttctcttttcagggaggagcagaacataacattccagttgtcgtttcaaaaatctccaaggaacaaagaggtaatatgtttagagaattgtgtaccagccatttctttaaggcattgtttttgaagtgtgagatgatattcaagaatcctaaattacaatgtgattgactggctccagcttccccaccttcaggcattagtggctgagtctgcttcctgggtccttgccctttatcctcctgtgggagaggacttctctcacagaaggggaacaaggctgaaagataggaacccttgaaagcaggtatgagttagggactacacagcttttcagttgtttcattaaaccaacaaagatacaaaactaatgataacaagtcccatcaagtaaagacaatttcaagtgtctgtttttcagttctcatttgcaattttactcagctaaccattcataagaaactgtaggaaaaataatggagatataaagcagatgttgcaagaactgaaattagtaaaacaatgtaatgtttaaaaatgaacttggagccaattccatagctgacggattgaatgtctatgtcttaaacattttcacagagacctaataatcttaagtgcgtgagaaaatgtggtcttttacccttagaagagtggctcatttttagcaactgttaggtctgcaatagtaaaagtaaatggaaatatgtctgcatgtgcttcagtaattagactgagtcatattgtttcgaatttccattttttgtggatcttttaagatgctaaccatataagacacttaatttttatatttgtaaattttacctttatttaattaaaagtcctttcatctgcataacaaaaacagtcaatgcattatcaattgtgctttttcattcacagcggaactttcaggactactttttattggagatgcaattctacaggtatacattttatcactatatgtgtggtcaaaacattaactcaatttacaatatgccatgggaaactatgcttttcttttcattgcagataaatggcattaatgtgagaaaatgtagacatgaagaagtggtgagtttactttttcctaatgtcatagttttccccatgtgcaaataagaatttagtgcattgctaaagactgtcacttcattcattaggcagatatgacatttatccagtttgatatcaaattttcaaatgttctcttaatttttttttaaattagaaatagattaacgagtcctatcaaggatgaaatgtgttctgaagaattcttacttaaagatggtcattttctatgtttttccagtttttctatctacccctaccagtcaatgtccattaaatacaccactgggcgaaatacatctctaaatctctgtaaatgtttaaaagcttataaaccatacatttatgcctgtagaatctcacacagtacagtcatccctccctattcatgggatttcacatcggcagattcaaccaaccatctgtagaaaatatgtggggaagaacaataagaaataacaatcaataataaaaataatacaaaaaataatgactattacatagtatttgcattatattagatattgcaagtatctaaagattattttaggcatacaggaggatgtgcatagtttatatgcaaatactacaacttgttatataagggacttgagcatccacgggtgttggtatcctctggggtccttcctggaaccagtcccccacagacagattacctaggaacaaatggaagggcatataaagactgcgtgtgtgtgtagtctgtgtgtgtgagtttgtgtgtttctgtgtgtggggtggtggggagaaagagagagacagagagagagaaccttaacctcaaggcagacaggtttagcaatagacagagtagtcatccagtttttcggcagtattttcttagatttgtgaatgtacagattcccaagccctggaattagatattctaattcagccagtttgggagggcccagggatgtggattttagcaaccggcctaagtgtttccatcataagtggcctctaaattaaacttttagagaagctgaaaggttaaggaacttctgttgggggtggtgaaatgacattaaaaaaatacagaaaggaacaggactgtggtaggcattctaggacatgtctgtcgtggttgaataaatatcattcaaaaacctcactgatttctgtatcagctcctatgggaaagagtagaggataaatcgtatttaaaagtttatactcaaaggtgaaagaaaataagaaatactgtagtccttttgcttgtcacagctctagtttatttggtttttgaatagattgctcctctgttaaaagctatttagagaaaactatgttgatacatttcacatctaagagaggcaacctcaagtgtctgtgaaaagccacggctgcacaagaaccgagacgaaggagggtttttaattaggaacacttggcataactaatcaaggttttttagtatttgtcacttgtctttgtcttcttaaaatcttattggagtcatgctcttgccactctgtgctcaagttcatgtaaaatatacatatttcaattcccaagtttcctacaaatatgtgcaaaaaaactaatattttagaacaagtttgtaaacaagtgagaaaccagcacagcacagagccttctatcttgcagattcctatgtaaattttaaatatagtcacataagcaaagctgcttgtaacttgactcttttttcaaaagtacaaagtgattttaaactcattacccagggagtaaaaccaagtgcattctcttttaaaaccacatgctgttagacggaatgcaatttgcccttcagaggcaggcagcatgcttagacaaactgagatggagctttgattaaacagattagtgcagcatgaaagattagaacgcaccaataattccacttctgaatggttctcattctgttataaaggaaagaaatttgggattgtattgcaaattatatgtggtccttcacaataagcttttatttttttctgagaagcttaactctaccagctttgaaatatgagtactaatatttttatttatttctaatatttcactttccaacagctattagatgctttgtcctcactgcttattagctaagccagtagacttacacctcagtagaacagagatattaattaaatgtttaataatcaacctacaagggcagaaaaaggtataacaagctgagagaatgtaggtggttttgagctagcatgctgatgtaccacatttcttattccaaatagcatgctgatatgccacattccttgtaaaacaccaaattcagaaacaaattgggcaggtatggaagcatgttgtttgtgcatgtaacttttattttatatacctactctattccttgatgttagaaattctgcattcagtctatgatcagctttactgtcaaacagtcttcaaaagtgtaaatgttacttttgtgttggagttatcaggtttgatttatatagaagggggattttacattgttcaggtagtggacagtacctggtgctgtgagcagtaggtgctcagtagatttgtggatgggattctgtaaccaaatgcctagaattagatcatggaagcatttacatctactgtatatatttctcatgggaccagtacgggagtgtaagtgaagtcctggcttcaccacatcacccactgtattcttgctggaagattgttaaggaagagaagctcacagtttcctcatgaaaggaaactagaaccagtgcccagcaccgcttggcatgcagcatggtgcacacatagggcttcaatgctcagaaacaactctgcaaatcatagctcaaccacttacaaacattgtaatttaaggtgaacggaatgaactaaacttttctatcactctattatgtattcataaaaatgaaccattaataaatgttatgggaatgaatgagagtaccatatgtgaaactccaagcatatacctggcaattaattggtaatacattattttgatggcaccaaatgccaccgctcacatgctgctgctcttctccctattccccctccgtgggcactgctgtgtcaaggtgggacagggtctgcttaggagccatgatgggccctggggggtcacacacagacagagccaatgctgctgctcagcatcccatgcttcctccaacaattccagtgaggagttgacatggtcaagagtggcacagcaagagtggcaagactgtgtgaaaaatggggattccttgttcattctagcagtgtgtgtttttattttccatgtgaacacgttttggagcttatgagttgtacctccaagagaccaaagcccatcaaggaaaatgatctattgccactactgatgttaattaacactgatgctattctccttaccactgaaccctagacatattaagctgatggccatctctatatcttgtcatctgtatttttcttttgcttaacaagtaaactgatcacatatcaagaattatctgggccaggtgcggtggctcatgcctgtaatcccagcactttgggaggccgaggtgggcagatcacgaggtcaggagttcaagaccagcctgaccaacatggtgaaatcccatctctactaaaaatacaaaaacattagctgggtgtggtggcatgcacctgtaaccccagctaatcaagaggctgaggcaggagaattgcttgaacccgggaggcggagattgcagtgagctgagatcacaccactgcactccagcctgggtgacagagcaagactcagtctgaaaataaacaaacaaacaaaacaaaacaaaacaacaacaacaaaattgtctgagtggctgggtggcagggcgtggtggctcacgcctgtaatcccagcactttgggaggcccaggagggcagatcacttgaggccaagggttccagaccagcctggccaacatggtgaaaccctatctctactaaaaatacaaaaattagtcaggcgtggtggcgcacgcctgtaatcccagctactcaggaggttgacgcagcagaattgtttgaacccaggaggcaaaggttgcagtgaactgagatcgtgccactgcactccagcctgtcagacagagctaaaaaaaaaaaaaaaaaaaaaagaattatctgagtgccatctatgtgaaaagcactgagactgagtactttctgaggctgagtactttgtgtgataagaaagaatatataaataactgtatatcgctgtaaccttattggtatgtagacatcatttctttagattttaataattgagtatacaaaaattttaagaaaactattagaaaggggcaatatgaaaacaatgtttatttacaatggtctttaacatataacaatggtgatcttcctctcttcactagaaataatagtaaataagatttaactatagcagaaaagtatttgttgagtaaaaagcatcctggttctaataggataatctattcgtataactgaaatttccatctaatgagacttttgaaagagatcatcattaggcaaagcaagatggatgcatagctgattccagaggtttccttttaaagtagcatttctgctttcagacttgagatttatgggtttcaaaaaaaatatgttcatctgctttttgtttctatgattctcatgaatagaatttattaggtaatttgaattgcaaaaattaacacctaattctgaagtcatgattttgaactaaactctaaaaacattcataattctacataattctaaaagaacagactgagtaactaaaagtatgtaatttaaaatgacaccttcatacagtgaaaacaaatgctgataaaacctaatgcaaaaatcctggctaatagcattttgcttgttatgatatatgcctaagtcaatttaaaatttccactggagtaggaacatattcttttttactttagattaatcagacagaaacaatacaagagttataacaaattatctggaaaaaggcataaatttatatattggaacagtctaggaggttttatatgtcaccaaggaacatatttagcatgtgagttgagcacaaagatcattttagattaaaatatcatgaggcacaaatcatgttttacctaactgctaacgattacattgtttacaatctggaaataggttttgagctctaagtgattaatactgccttaagaattctaaccatactggatagtttttctttgaattaacttccaccaaggaaagctatatacaatgtaatttaactttgaatatttctcagtgctctgggaaatgtttagcgcaaagacaaaaggccagaaatgctgtctacactatgtctgcttttgaaaagaaataaaatatccttgccttattttcatacttagctttgcattaatacttttagggatgccttttttgctagacccacatgtccgtcccctgtataagctatacatccagacagcacaggtgacattttaatgactgcatgcttgtactcctgactgctgattcttatcaaatctttatttgtcctcttattttttgagtgaagttgaacaacttagagaactgaaagacccaattttgcaaagctccatctagtccatcccctcagctgtaacaaaatacttgtaactgggtaccttataactaatagaggcttttttttttccctcacagtcatggagactgggaagtccaagattaaggcaccaacaggcttggagtgcactgagggctgctctctgctttaaagatagtgtctttttgcagcctcctctggaagggatgaaagctgggtgggtgctcacatggcagaaaaaatttgaagggccaagtagctctctgaagatcttttatgagagcattaattctgttcatgagagtgaaacactcctgatttaataacttcccaaaagacaccaccacttgctaccaccacaatgggggtcaagtttcaatataaaatttagagggacacaaacattcaaaccttagcaccttctaataatgagacaaaaccaggcctgaaaaaccaattacttaggagggccccagccgatttccttggagaggagtctaaaaacaggatacatctcagaaggcacacctaaaccaggtcaaattgggaggagaaagctggcagggcaggcatgggtgagcctgcaatcccttcacacattctgcaaggatcttctcagacactctcctgtctggggggttggaatgaggaatgcgtgttatacaaattccaaaattttcacatagctgacattttattttcacaataaccagctgatcaaactgaaagccaaggagaagaaaccgtatgacaacggagattttaactcaaggtaaaagttttgtcacactttccactgtttgatgttgataaagggcctcattctgtcttgccctcgtttttctcatctgaaggattaagaggtcgcagtagattattgcttaggtctttttcaggtaaaatcttcagttctttcattgtcaaagaacacaaacatttgttaaagcccacagagctgcagcacacaaagaggaacctctaatggggctaactatgggcctcagtggatgacaacgcatccacactggctcagcgatggtcacaaatgcaccatgctgatgcaagatcttaataagaggggaactctttgtattcctgactctttccgaattctctatcaaaagacaattttaaggccttcccaaggagcaaatgtacaattttaagcaaatgaatacagagatgtgagattaggcaaaatgtttttacttctctccccttttgaaacactttttatatgacaatgaataactctttaaaggtaaaaatcatacagataaaagaggaggagaagagaagacagggggcaagggttgttggtaactttatttaagaatagagagcagatagacaagacggggggaatcctgaagggccaaggggctgtagccaaagccgccatccagcaaacatccccactgcaggcctcagacagcaatcgcgaatgggagtgttgaaaggaagggttgaagaggtgtagccaagaacaggcaatcgaattagagttcaagaggctctgagtattcagccccaggcactgccataagtacagcgaaaggtacattctgggcagtaagtggtctgcgtttgtccttctttcagctctcagaacactggcagccggtttcaccactcagagaagaggtgagaggattcttttttagtgaaattgatctaacagaaataatccacaaatagtacatttggactctcctgttgcaaacagggttcaccctaaaccacacagtggagcccagtggataaaccatgaatcctgtacccaacgctgtcaatttgcttttcagtgtctcactctcaaatattttgtaataccaaaggatcattaagatttgaagaaaatcaaccacatcaaaggcagaagctaaaacaggaaaaaaaaaactgaggaaacagacaaagcaaggtttattgaacaaaaggattttatattgtaatattttcagatagatggtgaaaattaatttgtaaatgaattaatgctaccattatatataaaaggaacatgcagaaaaagaagagctcttggatattaacactttgatatctatcttcaaaaattagattacaaaaatgttgggaaacatctcaaaatggaataaagtagcaaacaagaaggtgatatgacagacaaagaatatgagagatactacattcaataatttttacactgaaccaatggaattcagaaataaaatattacatgaaataaaaggagcatccattatcaaaagaataatacaagaaaaatatccagacttcttgtatatattttccaatagaaacacactaccaattaaaaaaaaataaaagcattttacatgtctacacttgccatgaagtagcatcacattttgatattactttgcattttcctaatgactaaaagtattgaacattttttcttgtgtttgttatatatgccatatcacttttattaattgggttcacttcttactgatttctaagagtttgtttacataatctggccacaagtcagatatacaattcgcaaatattttttcctagtctgtggcttagtctcttcaattacttaatggtattttttgaagcttaaaggttttgactgttaataagtctactttatcaatattttaattttgtcagttgtgcttttggtgtcttagttaataaatcttttcctaatctaaggccatacagacttactgccatgtcttattctaacggttttatagttttaactcttgtatttatgtctaggttcaattttgagttaactttcgtatacagtaaggtaaggtgtcccatttattgagaagactattctttcctattctattgccttgacacttctgttgaaaatgagttgccctaaatgttagagtttatttccaaattcttaatgctgttccattaatttattcacatataccagtattacattcttgattcttgtaactttgtactatgttttgaaattaaacgttggtaagccatcaaactttgttctgtttatatctgattgttaagcaaactatttgtattagaatggttttagtttttatttttattttttatttgagcattttatttgaatcatcataagagaggaggtaattaaaataaaatattcgaatatatatttattttgaattttcatgtatttttctccaaatgaaatataccctttttatgcaaaatgatatacattttttctttttcaacttttattttagattgtggaggtacatgtgcaggttttttacctgggtatactgcatgttgctgaggttttgggtatgaaagacccgtcgctcaggtagtgagcatattactcaacaataagttgttcagaccttgtacccctccttccctcctgcctcagtgtctattgctgccatctttgtgtccatgagtacccgatgtttagctcccacttacaaaagaacatgtagtatttggttttctgttcctgtattatttcacttaggataatagcctccaactctatccatgttgctacaacagacacgatttttttcttttttactgccatataacatttcatggtatacatgcaccacattttctttaatcttcccttggtggggacttaggttgattctgtgaccttgctactgtgagtggtgctgcaatgaacaagtgaatgcgtgtgtcttttctgtaaaatgatttgttttattttggatatatacccagtcatgggaatgctgagccaaatggtagttctattttaaattttttgggaaacctataaactgctttccacagtggctgaactagtttacattcccaccaacagtgtataagcattcccttttctctgcagcctttattaacagacattctgaatggtgcgagatggtatctcctgtgattttaatttacatttctttgatgattagtgatgatggacatttttaaatatgtttgtttgctgcttctatgtcttcttttgagaagtgtctgttcatgtcttttgaccattttttaacagggtcatttgttttttgcttgttctattgttccagttctttaaggactctggatattagtcctttgttggatgcatagtttgtgaatattttctcccattccgtaggttgtatgtatactcttttgatggtttcttttgctgtgcagaagctgtttagtttaattaggtctcacttgtcaatttttgttttcattgcaattgtttttgaggacttagttataaattctttcccaaagccgatgtccaaaatggtattttctaggttttcttctaggatacttacagttcgatgtcatgcatttaactctttgatacatcttgagttaatttttgtatatagtgaaaggtaggggtccagtttctttcttccgcatatgactagctagctattctagcaccatttattgaatagggagtcctttcttgattgtttatttttgtcgactttgtcaaaggttaaatggctgtgggcatatggttttatatctaggttctgtattctggttttagattgacagaaaattgcaaagatactaccaagaattctaatatacccctcacacatatttccctaatattaatatcttttgatattatgaaattattactaatatattactagtaagaaaagtttgcactttattcagatttcattagtttttacctaatggctttttttttcctcttacaggatcccatcagaatacacattgcatttagtagtcatgtctcttcagggtccttgcttttaattttttgatgactttgaaagttttaagtagtactggccaggttgttttgtagaatgtccttcagctgagatttttctggtgtgtgtgtgtgtgtgtgtgtgtgtgtgtgtgtgtgtgtgtgtgtgtgactgtactgggtttatgtggttttccagaggaagaccacggagtgaaattgccattcttatcacatcatattaagagaaaactaccagcatgacttattaccattgataataaccttgattacctgtctgagatagagtttttcagaattcttcattgtaaatgtatttttttctgtccagactatgttttcaagaagtatgtcactatacccaatgccaattatgcagttgaaaactgtgctttactgtgtgagggcaggctatctacataattatttagaattctgttaacatagatttatctattttctcaatttattatttatctgatcattttgataaatcactctggatgcatatatatttattttatactttgggatgtaatccaatactatcttatatattttactggtcaactggttccagttttgggtattgggaactctttctgtggacttcagtgtcacttttaaatactctaatatagtaggatttgctgttgttgttgttattgtttgtttgtttgttttgttttgttttcagcacctcagcttctggcactaacatacttttcaggctgatcttgcatatatttcctgccagtctaagaatcagacatttcccctagaagttctgcttgcctttattagagaatggtactagaaatcaaaatctggattctagatgtgcaaagtagtggtgctttctaggccttctcagctaggaaggaaacatgtgtatacatgcctgttcatatacacatagaggcataccttggtgatactgtggggttggttctagacactgcagtaaaagaccacatattcggtacagtgtactctgctccaatgacaggtgcaccaaaatctcagaaatcatcactaaagaacttacccatgtaaccaaaagccagctgtacccctaaaactattgaagtcaaaataaaaaataaaaagataaaaaagagaatatcacactaaagtgagtcttgtaaattttggtttatgaaaatatctatatggaagtacatatacaagttatatttaaaatatactatagtctattatgcatgcaataggattatttcttaaaaatgtacataacttaattaaaaatatttaattgctaaagacactaacaattatcttagctctcagtgagtcataatctttttgctgggatagagtttgcctcaatgttgatgactactgactgattagagtagtggttactgaaggttggggtggctggggcaatttcttaaaatagaacaatgaaatttgccacatctattggctcttcctttcatgaaaaattttccgtaatgtgatgctgtttaatagcattttgaacttctttcaatattggagtcaactttctcaaatcctgctactgctttatcaactaagtttacataatattctaaattctttgttgtcatttcaagaacgttcacagcatcttcaccaggaagagtttcctttgcaataaaccactttctttgctcttccatacaaatcagctcctcatgtattcatgtgttttcatgacgtggcagcaactcagtcgcatcttcaggttctactctttttttttttttttttttttttttttttttttttttttgagacgaagtctcattgtgttgccaggctggagtgcaatgacacgatcttggctcactgtaactgccgcctcccaggttcaagtgattctcctgcctcagcctcccaagtagctcggactacaggtgtgcaccaccacacccagctaatttttgtatttttagtagagatggggtttctccatgttggccaggctggtcttgaactcctgaccttgtgatccacctgccttggcttcccaaagtgctgggattataggcgtaagccaccacgtccagcccagattctacttctaattccagttctcttgctatttccactgtttgttgttgtttcctacactgaaaacttgaagccctcaaagtcctccatgggggttagaatcaactttttccaaactcctgttaatgttgatattttggcctcacccataaaacagaaatgtttttttaatggcatctagagtggtgaatcctgtccagaaggttttaaatcaacttggcccagatccctcgtaggaatcactatttttggagctatcaccttacgaaatgtatttcctaataacaaaacttgaaagttgaaattactccttgatccatgggcttcagaatggatgctgtgttaggaagcatgaaaacaaaattaatcttattttacatctccattagggctcttgggcgagcaggtgaattgtcagtgagcagtaaccttttgaaaggaatcttattttctaagcagtacgtctcaacagtgagcttaaaatatttagtaaactatgctgtaaacagatgtcctgtcatctaggctttgttattctattcctagagtacaggtagagtagaattagtttaattcttaaagtcgctagcattttcaaaatggtacacagacattggcttcaacttaaagccaccagcagcattggcccctaataatagagccagccagttctttgaagcattgaaaacagacattgacttctcctctctagctatgaaagtcctagaaggcatccagcagaaggctattttgtctacagtgaaaaattgctctttggtgtagtcaccttcatcatttatcttcactagatttcttaataacttcctgcaacttctctatcagcacttactgcttcacctcgcatttttatgtcatggagatggcttctttccttaaacctcatgaaccaacttctgctagcttccaacttttcttcttcagtgtcctcatttctctcacatttcatagcattgaagagggttagggccttgctctggattaggctttggattaagtggatgttgtggctggttagatctattcagacaactaaaactttctccgtatcagcaataagcttgtctcactttctcaccatttgcatcttcacttgagtagcacttataatttccttcaataacttttcttttaaatttacaacctggctaactgcttgtgcaagaagcctacaatttgccctattttgccttccaataccccttcctcactaagtttaataagttctaagttttgatttaaagtgagaggtgtgggaattttcctttcacttgaacacttacaggccatgacagcataattacttggcctaatttcaataatgttgtgtctcagggagtaggaaggcctgcagagagggagagaaatggggaaatgaacagtcagtagaacagtcagaacacacacatttatcaattaagtttgctgccttatacaggtgtgatttgtggcaccctataaataattataatagcaacaactaagatcaccgatcatcaagaggctgatgcaggaggatcacttggactgggaggtggagattaaagtgggctgagatcacaccactgcactctagcctgggtgacagagtggaactctgtctcaaaaaacaaacaaacaaacaaaaaccaaaaaacaaaaaacactgatcacaggtcaccataacagatacaataatatctgttaacatagtatctgttaaataatatctgaaaaaagtatccatttttcaagcagtttgactaactgaaaaagtcaaaatattgtgaaaattaccaaactgcaacccaaagacacaaaatgagtacatgctgttggaaaaaaaaaaaaaatgctctgatagactttctccacacaggcttgttacaaaccttcaatatatgaaatatgtaatatctgcagaggtcagttaagtcaagcacaaggaaacaaggtgtgcttgtatctattcatacacatttctatatgtaactaatattagctactcctgagtttatactgctgtctctaactcaaccctttatcacatgaaacaccacagcctcctccccttgctcatctcattctaacaaatggttatattatctgtcattcatttatttaattgttcaaatctagtatatatgtacagcagtatcagaataagccactccacaatgggaaacaattttatcaggtagagtagaagaattatgctcagtccctttcccctttgtcttacagaccttaagtgaagttgcttcaaacatttgtaacacaataagattctcttgtcacattctgcattttgtcatatctcacaacctcctaagttgtttttattctaagattttcacacactgaagttaactctttgattgtaaattcaatgggttttgacacctgcacagtatcatgtatgtagccactgttacaatgtcatacagaatagtttcactgccctaaaaaatcctctaggatccatttgttcctactatcctggccatggccttcaggaagccatggatcatttcactgtttctgtagtttttcctttaacagaatgccaagtaattaaaattgtgaaaatctagcctttttagattggcttttttcacttagcaaggtgcatttaagatttatgacttttttcctggcttgaaagctctttttgttactgaagaatatcccatcatatggatgcagtataatttgtttatccattcacctgttgaagggcatcacacttgcttctactatttgtcaattattatatgaagtgctataacatttccatgcaggtttatgtgtggacatatttttagaaatcaattggctcagaaggcagtttctgaattatattgagagactatctttagctttgtaagaaactgccaaactgttttccaaagtggctataccattttgtgtatatgcctgtagtaaatgaaagttcctgttgccctacatgcatgccaacattgtcattcattgacataaaaactaagtgtcaagctcaaggttattttatactccactttcttttagaattttatagtattgcattttaaatttaggtctattattaattttgagttcatttttgtgaaaggggtaacacttatatttaatttaatttttattttttgcatatgactttctaatagtttcagcacatttgtcaaaatcttaccaatttcccattgaattgccattgcttctttgttgaccagttgtttatatttatgtggagctatttctggtctttttgttctcttccattgatcatgtgtattcttttgccaacaccatgctgccttaattattgtagcttaattgtaagtcttcaaattgggaaacatgagccctttaactttttctttcccaatattctgttgcaatttaaagtcttttgctgtttcatatacattttaaaatcactttaaaatatctacaaaatagctttttggattttgatgggaatttcattaaattcattgatcagtttgagaaaatcagcatctaagcaatgttgagtcctcgaatccatgaacatggaacgtctattaatttagattgcctttgctctatcagcagagctttgtagttttccacatataattctgtacatatattgctaaattttgacccaggtacatcaattatttggtgttattgtaaacagtattgtttttctaacttcaaatttaaattgtttattgttggtaagtagaaagcaattaacacttgcatattaaatgtctatccttctaccttgctatacttcttcattagttctaagaggtgtcgtgttttgttttggttttgcttctggtagattttttgatatggtgggtttgtctggattgcaaactttgattcatacatgcttaactggaataaatctcatttggtgtgatgtataactctttttatacattattcagtttgatttgctaatattttattcacaatcattgtagctatattcatgagaaatattgctcttaatttttttgtaacgcttttaaaaacttttgtgggtgttaggttaattatgttatcacagaatgagttacaaactgttgcctctccttctgtgttctagacaaaatagtggaggattagtattatttcttcattaaatatgtgatataatttactaacgaaactctagatttcgtgctttctttttgtaatgttattatttattcgttaaatatctttaataaacataggccattttgtattatctatttcttcttgcggaaatttacccagatcatgtaagttatcaaatctgcgggcatagagttgttcacagtgttcctctattagccttttggtatccatgggatcaataagtatgatccctctttcatttctgacactggtaatttgtatctttctctctttatttcttggtgagtttcctagcaatttctcattttctttatcttttcaaaaaacaagcattatgtttcattattttttccctgttgttttttgtgtttgctttccatttcattgatttcctctgtagtttttgttatttgctttctttttactttaggctttgattgctgctttttctaattctgtattgtgagagcttagatcattgattttaaccttctttactaatacatgcattcaatggtttaaatttatctctaagcactgctttgcctgcatgtcacaaatattgataagatgtattttcacttttattgagttcaaaatatttttaaattctcttcagacttcttaatgactcacatgctatatagaagagtactgattaacctccaaatagctggggatttttgaggtctctttattttactgatttttattttaaattcttcattgtctgggaacgtatttgtataataaatatttttttttcaaaaaatagttaaaatttgttttctggcatagaatatagtctgcttttataaattttccatataagcttgaaaaaagtatatgttttgctacctgtaaatggtatattctataaaagtctattataacaatagtactgttcagtccaactgtatttttaaaaaactgctacctgcttgaactatcagtttttgaaaaaatgccattataggctaaaattataataaacatatatttctcctttcagttctatcagtgtttttgccacacatataataacatgctgttgttagattgtctaatattgctatgtcttctttgagattctactggtttatcttacttaattcctcacttaatcattatttcattcccccccttagctttagtaattctccttgctctaagtcctctttgtctgtaattaatatatctcctccagctaccttcattaatgttagcaaagtatatttttctccatctctttaccttaaacctataggagtcttcaattaaaatgggtttcttgtagaagttagagttgggtcttttatattccctagataatctgtcttttggttgcaatatttataccattcaaatataaagttattgatgtaactgaattaatatccaccatgtttgtaatgtttctctatttattgctttggttctttgttcccctcccccactcttttttaacttccttggtttaccttaagcatttgagtaagcccactacatccttctcttattgtatcaattatgcttttgaaaacaattagtgtttgttttagtttccattatgcgtttttaaaaatctgtatgcattttcagatagcactgtgctgcttcttcatgtgtagtgcaggtaccttttaacagaatgttcccaattcctccctcccatctcttatgacattactataatttattttacttatccataatctttaatcaccccacatattgttagtactattattttatacaaagagttaagttgacaagaatgagaaaagcaagatagtttatttacttgcgtttattctttcattggcattctcctttgcttgtgtgtatctgagcttcagacttgtgtcatttttctaatccctgtaggaattcctacatttcttgcagtggagagttcctggcaaggcattttctactattgtttgccggattaagtgtttattcctctactttagaaggacagttttatgggacacaggcttctgttggtgtcgtttttgttttcagcaattgacatgattcacttttttctcctcttgttttcttgggttctaaggagacccagtagtctcaggactgcactccctattcccctgctgcgtgtccacccccaccacggtcagggttccatactgcagtcaggttctgccagcatcctgaaaaccttccagaggcttcccagcatagaaaaaatgagtgcaaagtcattatctgggcttcagcaactccagtattcaaaattcatctaattccttcaccctctaacccagcatgtgccagcccccactcccccacttttgttggggctcacactcaccttaaggcctttgtccttgtcttcttttcctgcatttttctcccctgatctcttcatggtttagattcttgtcattcagaccttagattaaaagcctccttattgcaggcatggtggctcacgcctgtaatcccagcactttaggaggccaagatggtcagatctcttcaggccaggagtttaaaatcagcctggccaacagggtgaaaccccgtctctactaaaaatacaaaaattagccaggcgtggtggcgtatgtctataatcccagctactcgggaggctgaggcaggaaaattgcttgaactgggaggcagaggttgcaatgagccaagatggtgccactgcactccagcctgggcaagagagaggctgtctcaataaataaataaacaaacagttctccttatcacagaaaccttctctggtaagtcacacaatagaagccgtttgccattttgggctgcccagcgccacacaaacattcttatatgagggaacattccaagacaattgggaaataggtccttgtctagaacaacaaaaatgaattgaaggaatataaattcccccattaagttctctacaaaatagaatgttaacaaagcaacaaagtttagccgaacctaatactcccagtaatgaactttaatcctaagaaataagagtgaaatgtcaatatgagattatgttctgtgccaaaatggccaagacattgtgtccagaattggttccttccggtgggttcttggtctcgctgacttcaagaatgaagctgcagaccctcacggtgagtgttacagttcttaaagatggtgtgtctggagtttgttccttcagatgttcagatgtgtctggagtttcttccttctggtgggttcatggtcttcccgacttcaggagtgaagccgcagaccttcgtagtgagtgttacagctcttaaaggtggcgcgtccagagttgtttgttcctcccggtgggtttgtggtcttgctggcttcaggagtgaaggtgcagagcttcgcagtgagtgttacagctcttaaatgtggtgcgtccggagttgttcattcatcctggtgggttcgtggtgttgctggcttcaggagtgaagctgtagaccttcgctgtgagtgttacagctcataaaggtagtgcggacccaaagagtgagcagcagcaagatttatgacaaagagcaaaagaacaaagcttccacagaatagaaggggaccccaggggttgctgcagggggctctggtggccggcgtttattcccttatttggccccacccacatcctgctcattggtccattttacagagagctaatttgtccattttacagagtgctgattggttcatatttacagagtgctgattggtgcatttacaaacctttagctagacacagaatgctgattggtgtgtttttacagagtgctgattgatgcatttacaaactttagctagacacagagtgctgattggtgcatttacaatcctttagctagacagaaaagttccccaagtcccaacccaccccagaagcccagccggcttaacctctcaacatcagtgccacagcataaatgtccaggtgtcagccgtggtagaaacatcccaagcaaggtgtttaaaaatcatataatttttttttttttggagacacccttgctcctatcagagtgtgtttcaatagacattgcttcaattttatgagctaatacctttgcgatatacttatagtctatgtaaattaaaaattgtcatctatgtataatactacataggaaataatactaaatagaaaacagcaagatattactacaaccttattagaatggctacaattcaaaaaatcaagcatatcaaatgctggcaaagatgcaaagcagcagaaactcattcactgcagctagaaatgcaaaatggcacagccactgtggaaggcagtttgacaatttgctaccaagttacatattatcttagcatacaatgccacatgcccactcctaagtatttatccaagataaatacaaacatgtccacaccaaaacatatacaggaatgtttgtagcaggtttattcataaccaacagaaactgaaaccaagaaagatgtcattcaacatatgaatgaaaaagcaaactgtggtaaaatgaaatactattttggaataaaaagaacacagactacatgaccctatatgtagaaatccctaaagagtccataaagcaaagttagaactaataaatttagcaaagttggcagattgaaaattgacacataaaaatcagttggatttctatacactaacaataaactacctaaaaacattaaaggaaattttatttaaaatagcataaaaataaaatatttaggattaaacttaatgaaggaggcaaaatatttttacatagaaaactcaaaaatatttctgaaattaaagaaagtacaagtaaatgggaagacatcctatattcatggactgggagagaatttttattaatacatcagaactacccattgtaatttacagagttggtgtgatctctcaaaattgtgatggtgtttttctgagaaatagaaaactccattctaaaattcatatggaattgcaagagacaccaaagagcaaaagttatattgaaaaccaggaacaaaatcagaggcattacacttcctgattccaaaacttattacaaatctacagccaaaacaatgtggtagtgatataaagacaggcgccacattgtagatgtgatgaagagaatagttagctcagtaaacgattttaaataacattttaaagaccattcaattaggaaacatagtcttttcaacaaatggtgttgggaaaactggatatctatatgtgaaaaaattaaactggaccattgcatcataccatataaaaattaactcaaaatggatgattaaagatctaataagacctaaaaaaatactaaactcatacaagaaaacagagaaaagctttataccatcagattaggcaaggaatttttggatggaacaccaaatcacaggcaacaactgaacagatagataaattgtactaaatcaaaatgaaaaacttctgtgcatcaaaggacacagtcaagagagtgaaaaaggcaacctatggaatggcataaaatatttgtaaatcatatatctgataagaagttaatattcggaatatataaagaactacatttaacaacaacaacaacaacaacaaaaaaccttacccaattaaaaactgtctaaaagacttgaatggacatttctccaaaaaatatacacaaatggccaaaaaaacatatgaaaaaatgctcaacacactaatcgttagggaaattcaaatcaaaaccacaaagtgatattctcaaaccagttaggaatgccactattaaaaacaaaatcaaaacagaaaacaagcgttggcaagtgatatggttaggctttgtgtccccaacctaatctcatcttgaattgcaatccccacgttccccaagtgtcaagggagaaaccaggtggaggtaactgaattatgggggtggttttccccatgctctgctcatgatagtgagtgagttctcaggagatctaatgattttataaagggctctttccatttcatttggcacttctccttcctgctaccttatgaagaagatgccttgcttccccttcaccttctgctataactgtaaaattcctgagggctccctagccatgctgcactgtgagtcaattaaacctctttcccttaaaaatcacccagtctcagatatatctttatagcagtgtgaaaattgacagatacaacaaagatgtggaggaattaggactcctgtgcactattggtggaaatgtaaaatggtatagccattatgaagaacagtatgatggttcctcaaaaagttaaaaacatagctaccatatgatccagagtgtctcctctgggtttatattcaaaagaattgacggcagttgtgaagagatgcttgcaatcccatgttcatggaagcatttttcacaataaccaagaagtggtggcaatccaaatgttcattaacagatgaatggataaacaaaatgtgatatatacttgcaatggaatattattctcccccaaatggaaggaaatccttttacatgatacaacatggataaaccttgatgacattatgttgagttaaataagccagtcacaaaacaatacatcctgtatgaaaccacttatatggggtacctagagtaataaaactcatagaagcagaaaatagaatagtgttttccagagcctgggggaagaagggaacagagggttattgttttaggggtatagaattttagtttttaagtttttttttttcttttccccactggctccaccacagaggtgcaacggctccatggagtctagagtttcaggttttagagttgaaaacattgtgaatgtttgttgcacaacagtttgaatatacttaaaactgctgcacacttaaaaatgattaagatggaagaaaacctaggcaataccattcaggacataggcatgggcaaggacttcacgtctaaaacaccaaaagcaatggcaacacaacccaaaattgacaaatgggatctaattaaactaaacagcttctgcacagcaaaagaaaccaccatcagagtgaacaggcaacctacaaaatgggagaaaattttctcaacctactcatctgacaaagggctaatatccagaatctacaatgaactcaaacaaatttacaagaaaaaaaaaaaacaaccccatcaaaaagtgggcgaaggatatgaatagacacttctaaaaagaagacatttatgcagccaaaagacacatgaaaaaatgctcatcatcactggccatcagagaaatgcaaatcaaaaccgcaatgagataccacctcacaccagttagaatggcgatcattaaaaaatcaggaaacaacaggtgctggagaggatgtggagaaataggaacacttttacactgttggtgggactgtaaactagttcaaatgttgtggaagtcggtgtggcaattcctcagggatctagaactagaaataccatttgacccagcaatcccattactgggtatctacccaaaagattataaatcatgctgctataaagacacatgcacacgtatgtttattgtggcattattcacaatagcaaagacttggaaccaagccaaatgtccatcaatgatagactggattaagaaaatgtggcatatatacaccatggaatactatgcagccataaaaaatgatgagtccatgtcctttgtagggatatggataaagctggaaaccatcattctgagcaaactatcgcaaggacaaagaaccaaacaccgcgtgttctcactcataggtgggaattgaacaatgagaacacatggacacaggaaggggaacatcacacactggggactgttgtggggtggggggaggggggagggatagcattagcagatatactgaatgctaaatgatgagttaatgggtgcagcacaccgacgtggcacatgtatgcatatgtaacaaacctgcacgttgtgcatatgtaccctaaaacttaaagtataataataataataataataataaaaaagagcatgcagtggcaaaaaaagaaaaaaaatggttaagatggaacattttatatgtagtttctcacaattaaaatttttttaaaatcatgacaaatcacataaaaattcagatatgtggctcttcatttaaaaatcagaagctctggaaactttgggcctccactgtttctcaggtatttcacagattccagttatcctcctccttgtgcatttgcctacctgacttctgtagattcctgaatggcaatgctgaaatggccaaatgccagagtcagatgccatttccgtgtgttccttcgcatgctatagtagatcccagtaaaattcaaccacatcataagcatctctttaccggcctcccagtaaaaccaagaggcaatggtgacaataatgctgtctttcacaccatggtttgtgctcctagagtaatgcctggtaaaagcaagataactaaaaagtttgctgaatagaaagatttccaaaaaaaatcattttagaagtttggaaaatcccagagtggaaagaaaatgtgacaacataatataaatgcattacaaagaaagtgctgactttggaaatgaggaaaaattgtagattaaaggcaaataaactgcataaatactatacagcagtcccctccttacccatggtcaacgatggtacaaaaacgtgaagtggaaaacttcagaaataaacaagtcatacgttttacattgtgcactgctctgagtagcatgactggagcactgctccagtcccccatggacttgaattatccctctgtccagcatatccagattgtatacactacccacccgttagacacttagtagccatcttcattatcaaattgactgtcatagtatctcagtgctgttttcaagtcgccctaattttacttaattatggttccaaagtgcaggagtaatgatgctggcatattattataattgttccatttttgttattagttgctgttaatatcttactgtgcctagtatatcaattaaacttattcatagttacatatgtacaggaaaaacatggtatatatagggttttgtactatctggtgatttcaggaattacctgagtgtcttggaacatatgccctttgaataacggaggactactctactcagctgataaagttgtttttcatggattatgggttaaaaatttctgaaactgctacacatgtacactgtatttgaactattaaaacatactggatggcagagctaagtttctcactgttggagtgggaggttacaaataagcaaggggaaaagattagaatggtctgtgtggtaatggataggatacagttggggatgtccttatgagctcctgttttgcctaaattagatataagtcattgcacatagaaacatttatacacttatgtaaataaacaggtttataaacctactagatttttcttgctgtcccagctggagggcttagaaggtactgtcacttcagtggaaatgagcacacctagtacctagatcttggtatctaatacttttctccagtaaagagaaatggatgattcaaggactggggcaggacatacacaaaatgagcctgtgacacacacagacacacacacacacacacacacacacacagagggataaacatacacacacagtattaatagggcatgtcaaaggagcaaaggagccaactgaaagaggccccaatggccaaagctgaaaccatctgaacaagaaaataaatcaggtaatattggattttaattcattatatgaaatacatatctatgagtcctcggtgacatagatgattgaatcattaaactggggaagaaaagaaaaatcagtgcagaacaatttcaaataattcatgcagataagctgtactcatggaggtgaagtatgacttgccacttcttaagtatgggctgtccattctgacttccttatgaagaatgaagtatgaaaaggaggggtggggagaggaaatttagcgtgtagaaatgtgacatcacggcctcagcaagtttatcaaggataatatccacaatgagagtcctatcaatagcatgtacacttgatgtgatatgaggaaaatgaccctttatttctgtggtccccttccccagatcacatatacctagtctaattatgagaaaaaaaatcagaaaaaaatacaattcaggaatatactacaaaatacctgaccaatacatctcaaacagttaaggccttcaaaaaaaagaaaatctggagaaattgtcaaatccaaaaggagcctaaatagacagaacaactaaatgtaatgtaatatcctggatgagatcctggaactagaataaagacattaggggaaaaactaaggaaatctgaatgagctatggactttggttagtaagaatgcatggatactgactcattaactgtggcaagtgtaccatagtaatgaaggatgttcatataggaaaccggatgtggggtacatgggaactctctgtgctgtcttttcaagtttctgtatatctaaaactgttttaacacaaccattctatttttacaaacaattcatttgtatttacaatgatctcatatttttccttttttgtttacttttatttatttttctctctctcctctctggaatgtcagctcttcgagagtgaaagttatttatcttttattcaaagtgttgtgtattgatataatgctaatgggcaatacatatatgggtacaatgaatgaaatactgaaataccctctctgctgtaatctagatgacccattactttcagaaagagctctcctcctctcctatagattttgcttcattcttcttttctgttttcaaataatcctctctactttcatattcatctggcatatcagctcttctaccagcttcaggaaggaacctccagacagcagcccttggtttacctatgtttgtatacagaaaaccatgagattaaaggtggatcaacacaatttggatttcaacctattttgaaaatattcctttaaaaattatttggactttaagtcatccctaatatatttctatacttgatgctttaggattaatcttgtattatttttaatgacaggtttttggattccaacatatctattcatgcatattaccaattgtagatttctgaataagcaatacaatttgataagctaaaagttccttcttgttcccaaaattcccagtttattatcaatcgtttcactctgctaaccactgaagccacttcctaatcactagtttttgtttttcaattctagcatttctgggataactcctcttttgctataagttgtaaactgtatccattggacatatattttcaaattttctttccttctctttctgtgagtaaagtagtgcatgtgtgtggctgaaactatctttgtttttcttagggattcatcttattccagacagctctgttatttaaatgttgggtatgttctggagtttgtattgtggtccttgaaatgagaaagcaaatgggtacatatggtcagatacttttaagtctatttcactggagttccatatatttattgaataattttgttgaataaaatatttctcttataggaatacatagacatcccataataaaacattttatatgaaattcctcttattttaattaatctaatactttttcctgtaacaaaaggtaatatttattaagtaaatacaaacttccaagctcctctctaagtagtaaaacacataatcttcataaaactgctagatagatatgattattactattatttcatagatgagaaagatgcaatgcggagagattaaatcaattgcccagggatatacagctgtcaaactatggaaatagaattaaaactaatagaatctagctcccaagcccaaattttaacaagtacatgccatttgaagaaagtagtttggggatgattttgtgataataatctttcttctgagaatataattggaattaaaacacttggcttttttttttcttcaagaatttaatagaacttgggcattgagggactcttgtaattatccagctttctgccaagaatttgaatctcatctgatgccacgtttctgactgtttttaagcgttccaaatctgtggtgtgtagtgtgttaacagaaaaatgctttctttcctacagaatttgaaattaattttcttagtgcctgtcttctgcttacttccccaatggggaatattctcggtttctttcttttcccattgacactttcctccacattcttaatgcctttgatgcctcatttagctcctcacctacacagaatttgatttcacagggcctgagacttgtccatcccagctttattccaactctgcctgagagcccttcctctgcactcactgtggagtctagcctttggtctagcacagggtggactctgggcccctgtgccttcctcctcttcagctgtcccccatattggtggtggtgggtttctaccgtttcatgttgcctcacactcccctgttgaagttttccaagacatctcatgttaaattaccatttgaaaaacctgaattgttttctattgactagatcctgacaattacaaaggtttgtcaatatttcaagttttcctgggctcttaatgaatgctgctgtatttctccttgaagaggttcagtaaatgttagttgattaggataataaattggataagaaaagatacaaaaatagacacaatatcaactgtggagactttaaaatagtgagaccttgtctaactgaggatagagcacctctggctagaattacatgtcaaacatcttgaaatataatacttacaattttaaaataaaaatgttaaatcatcagttttaacatctcaagggttttgctgtaacaatctttagtaagtcactctcctcccaccttcttgcatttaccccacctgaattttaattcgctctgattgtggagcttaaaattagtgatgggtatggtcatcgtctttttcttttttgagattttttccaacatgaacaaatttaatgtgaggaccagcctgtaatcaggtgtgtgtagtctctttcggaatgaatggggcattgtcattcgatgacttgagatatctcaaaagtatacaaggagaaatatgtgtaaggccactgtaatggctggagttataatgcttggtttatttaaatttattttctgtttagctggagagctgctcaggctaattaacaagctcccgacatgtagcatcacacaatccaaggaagtaaatggaaacaaattgctaactagtgctgaaataattagagtagtattgtcttttggcgtgaaaatgttaacaacataaaaaagtccaccacacattagtaatctttaaagtgtttctttcacagtgacccaatgttgaaggtttggtcaaatagggttttgtattctttacaaaattatatttggatgatcagatataaactatattgcatgatttaataataaattgggaaaatattttgactttcacaacagaaatcagcctatatttaacaatattaaatatttcattgaaagaattacaggttgtgaaaatgaaagaatgaacagttgtttttattgggatgtagctcaaatagaagactcaaaactataattaccacactatttttattaaaaacaagcattgaatattcagtgtacacatagtatcctcttgtatataaaaagtattactaaaagttgtttcttgccataaataactttatcatttaaggtggcagcacccacaaaacaaggcagtaatagtttgaaggcaaagctgataaacatacagcacaggctgggcgcggtggctcacgcctgtaatcccagcactttgggaagccgaggcgggtggatcatgaggtcaggagattgagaccatcctggccaacatggtgaaatcccgtctctattaaaaatacaaaaattagccgggtatggtggtgggcacctataatcccagctactcgggaggctgaggcgggagaattgcttgaacccgggagacggaggttgcagtgagcggagatcacgccattgcactccagcatgggcgacagagtgagactccatctcaaaaacaacaacaacaacaacaaaacatacagtgtaaagtattattaggttctacagtggacaatgtgtaacatttgctttatttggggatttttatactatctccctataattgtgctctgtatattcaaggaatgtgaagattttatgtttagtgagtagcaaataattatgaccacagcaagtgaaatttaaaaacttaactgttctatgttaagaaaagcactgagattgcattttaaggacaagaggactgcactttggatttctattactctagatgtcatgaaataaatcatattgattttagatacttttcctcatcaataattggaataaagttatgtacttctacttatatcaaggaatgttttgatgattggtgtgaaaaatatctatgaaatccttttacgtctctttcactaatcaatatcaaaaagaacaatgcttcattgctcttaatggcttcccttaatgtgtaatgttttttgttactaatcagttttgtgatttctgcagagtcatggaagtgagacagtcagtcccagcagtgaatggaaacagttctggtcctggattttcagccctgcatgcaacatgttatggacatatttattcagtccccggtttatgaagtgaacataggaacagaatcagcagagctgtagccatttcccagtccagtgatctgacaaattgctgccctaatcaatctgtcaagatgtgtctgtcatgcctcctctttcctcccactaagttgtagctgtggactagctctgtctggaggctctgctgccccaggttgctatggagaccacagtgatagtagatatgaaagtaaaagctgctctttttcctcctcttcttactaacaaacgtgaactgctatcctaccctagagtccaaatataactgaggcaggtagggtgagaatgacgggacttcaaaggcatgtggggcttcctttctaatcctccatatgggcaggaagcccagcttccccgtccccgcctacttaccacctgctttgcaaaggaaatgtttgtgagaattaccctcagtagtttttgtaacactgtctcatttgaaagtattacatgtgagttctcacactctcattgtgagtttgcaaactcccaatgagcactcattcctctaaaatctctaacagaacataacccatttcaatcttaggtctgaagtaaatagcctacagattataaaaatcagcaatcatttacttcaattcatttagagagtagagagacagagcttgaattccccgtttctacaccattgccgaggacacatagatgcaaggattctaggcaagtggcctctgaaaaatgcaattatgaaacatgagggggctaatactttggctccaaactatgcctaatatatggccattgatatgtgtactccttacctggaggtttctttgcattgagataatgatgtatttagtttggaggagagttggtatgatgctgacatctgagcctgaagctcagagcatgaacacatgaaattccccaaagatgttttatttattgatttttcttattattcagataccaggtgatgggaatgccctttgggactctcttggaaaagaagcaaggcttgaagtagaatagtagactagaaagaggtctgagataaaatagaaaggtgacaatattataattttaagggttatttttagatatttgcactaattttcatataagtaaaatgggggcataaattacttccaactatgtattaaatattgaacagtctcataatgtacatgcatcttgcacaatttgataaatatcttagtgatttttatagttatcctatgtctgacatttttgtgcatagcagacctctctgaaggctgaaatttaaagtgactatgaagtgatagaatggatctatgtattttttttcatgtattaagcaacatataaggcagacaattttctccctacccattttttaatacattatatttgggatatacacatccgtttttaagtgtttaaaattactggactctcaaagaaaccactgttttctcttggtggtacagctgtgtttctccctatgcaggcttcagtcatcatgaaagtgctagcacagctcactccatggtggccccaacaatgctgctaatggtatcagggtatttatattgtactcagtgtatatcaaaggggatggcatttaaaattcagaatagcatgttcaaatgactcatgcagtggacggaaatgacagtatatggcagggaacagtgtaagcaattctacaatatttacttcttagttacatgttgtgcaaacattttgtgataatacgcataaacaaatatttagcaactgtattctgcagctgcaaatctaatgtgggtgtgataggggttagctttgtttttcagatcttgataattctttatgcttgaaataacctatacaaaattctattaaaataaggataagtgctatgtattatttctttttcttcacaaattctacttaaatgtggtacatagttttcaagctaaacatttatatagctatggttttactattatgaatttagagtgaatatgtgtataagttatttccatctaatgtggttatatcaaatatgtatatatgtatgaggctttaagtaaacattctggattttctttctttcttttctctttttctttctctctttctttctctctttctttctttctttctttctttctttctttccttctttctttctttccttccttccttccttccttccttccttccttccttccttccttccttccttccttccttccttctttctttcttttttttttatggagtttccactcttgttgcccaggctggagagcaatggcacagtctcagctcactgtaacctccacctcccaggttcaagcaagtctcctgcctcagcctcctaagtagctgggattacagtcatgcgccaccattcctggctaattttttgtatttagtagagatggggtttcaccatgttggtcaggctggtctcaaactcatgacctcagatgatctacctgtctcggcctcccaaagcgctgtgattacaggcgtgagcctccatgcccaacctggattttcttgatatagacatgttctctacttcagtatcctgcctgtataagaaatatgcagggcctggcgcagtggctcatgcctgtaatcctagcactttgggaggccgaggcaggtggatcatgtgaggttgggagttcgagaccagcctgtccaacaggaagaaaccctagctctactaaaaatacaaaattagccacacgtgatggtgcatgcctgcaaccccagctacttgggaggctgagacaggggaatcgcttgaactcaggaaggggagatttcagtgagccgagatcacgctgtcacactccaacctgggcaacaagagagagactccatctcaaaaaaaaaaagaaaaaagaaaagaaaaagaaagaaatatgctataacctttcagtctgtaaaatatgtcttgtctgcccatctgcaagatttgaactgagtacacttcatttcatgcgcaatgattgcattttataaatatactctctgccattgaaggaaggtggagggacattcaacatgggtctgaattaagtattttggggcctcagtaaacatgtgattacatttgatctgataatggaaactttgctcatttgaggaagtcattggtggtctctgagatatgaccaagagggcactgtagaaccttgtggaaaaacggctgggaccatcaggttgtgtgggcagggttgcccaggttttgttggtttccttgtttgttgtatcacactaagcaacgagacaactgtaccacatttcagtgatgtcagtattattagcacagaggccaaaaaaacactttgaatccttttatgcagactagatttgggccagggttttttacataatgctatttacttttaaaaacttctcttatacttttttttccttttaactggttgtaaatatttgtcttcccaccagcttagaagtctctagaacttcttttgagaagtgtctgttcatgtccttcacccactttttgatggggttgtttgtttttttcttgtaaatttgtttgagttcattgtagattctggatattagccctttgtcagatgagtaggttgcaaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatacctatgtcctgaatggtaatgcctaggttttcttctagggtttttatggttttaggtctaacgtttaagtctttaatccatcttgaattgatttttgtataaggtgtaaggaagggatccagtttcagctttctacatatggctagccagttttcccagcaccatttattaaatagggaatcctgtccccattgcttgtttttctcaggtttgtcaaagatcagatagttgtagatatgcggcgttatttctgagggctctgttctgttccattgatctatatctctgttttggttactgtagccttgtagtatagtttgaagtcaggtagtgtgatgcctccagctttgttcttttggcttaggattgacttggcgatgcaggctcttttttgcttccacatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtatcctcttttatttccttgagcagtggtttgtagttctccttgaagaggtccttcacatcccttctaagttggattcctaggtattttattctctttgaagcaattgtgaatgggagttcactcatgatttggctctctgtttctctgttgttggtgtataagaatgcttgtgattttttgtacattgattttgtatcctgagactttgctgaagttgcttatcagcttcaggagattttgggctgagacaatggggttttctagatatacaatcatgtcgtctgcaaacagggacaatttgacttcctcttttcctaattgaataccctttatttccttctcctgcctaattgccctggccagaacttccaacactatgttgaataggagtggtgagagagggcatccctatcttgtgccagttttcaaagggaatgcttccagtttttgcccattcagtatgatattggctgtgggtttgtcatagatagctcttattattttgaaatatgtcccatcaatacctaatttattgagagtttttagcatgaagcgttgttgaattttgtcaaaggccttttctgcatctattgagataatcatgtggtttttgtctttgcctgtgtttatatgctggattacatttattgatttgcatatattgaaccagccttgcatcacagggatgaagcccacttgatcatggtggataagctttttgatgtgctgctggattcggtttgccagacatttatgcagccaaaaaacacatgaaaaaatgctcatcatcactggccatcagagaaatgcaaatcaaaaccacagtgagataccatctcacaccagttagaatggcaatcattaaaaagtcaggaaacaacaggtgctggagaggatgtggagaaataggaacacttttacactgttggtgggactgtaaactagttcaaccattgtggaagtcagtgtggcgattccttagagatctagaattagaaataccatttgacccagccatcccattactgggtatatacccaaagtactataaatcatgctgctataaagacacatgcacacgtttatttattgtggcattattcacaatagcaaagacttggaaccaacccaaatgtccaacaatgatagactggattaagaaaatgtggcacatttacaccatggaatactatgcagccataaaaaatgatgagttcatgtctttggagggacatggatgaaattggaaatcatcattctcagtaaactatcgcaagatcaaaaaaccaaacactgcatattctcactcgtaggtgggaattgaacaatgagaacacatggacacaggaaggggaatatcacactctggggactgttgtggggtcggaggggggggagggatagcactgggagatatacctaatgcttgatgacgagttagtgggtgcagtgcaccagcatggcacatgtatacatatgtaactaacctgcacaatgtgcacatgtaccctaaaacttaaagtataaaaaaaaagtccagtaaaaaaaaaaagaagtctctagaactaaagggctttatcaactttatttcttcattgcttattctgtgttacctcatatggtgttttgaatgtgatagatatttgatatatgtttgctgagttaatttaaactatgcttctggatctcaaaagaaaatatacacaagtaagtaacttaaacaaatggagtcttattaatgtggaaagaagctacttagtccattctatcttgttttctgtatctaggtagagtcttccttctcagaactagggctgcgaagtggtgctgtgcagctgggctctatagataaagacgcatgaagaagttgatagatgatgatcatcctgaaattgctatgagagtaaaataggttttttttaagaaattctgcaagatttgccactgactattttaagaaaatggcacagtggaaaaaatggagaactcacgtttacatgtagttttatttgtcagtctgccacatattaggtgctatgtttgagcaagtcactcagtttttcaatgtttccatagagtctagcatgccctttacctaagtatctgtatggcaaatatgcttacctccttctatcccttggtcggaaatcctatcaatgggtcctaccttcactgatctatttaaaataactctccacacagctctgctcttgcttgtctgctctgcctgccattttccttgcctatgagcacctctcaacgtctccctttctgggcttgcatattgtttacttcatgctcacctaatgtctatcctccatcatctgttcctgccccttgaaaatgagcactaggcaatgaccatgatgacagcaagccatgttattgacagacgggttccaagagcccagcatgacacttggcccataaaaagtattcactaaatagtcattaataaataaatgtaatgtagtctttttttattacactttaagttctgggataaatgtgcagaacgcgcaggtttgttacataagtataaacgtgccatggtggtttgctgcacccatcaacccatcatctacattaggtatttcttctaatgctatccctcccatagccccccaccccacaacaggccccaatgtgtgatattcccctccctgtgtccctgtgttctcattgttcaactctcatttatgagtgagaacatgtggtgtttggttttctgttcctgtgttagcttgctgaaaatgatggattccagcttcatccatgtccccacaagggatatgaactcatccttttttatgactgcatagtattccatggtgtatatgtgccacattttctttattcagtctatcattgatggacatttgggttggctctgtctttgctagtgtgaacagtgctgcaataaacatacgtgtgcatgtgtctttataatagaatgatttctaatcctttggttatatacccagtaatgggattgctgggtcagatgatatttcttgttctagatccttgaggaatcaccacactgtcttccacaatggttgaagtaatttacactcccaccaacagtgtaaaagtgttcctatttctccacatcctctccagcatcttctgtttcctgaccttttaatgatcgccattctaactggtgtgagatgatatctcattgtggttttgatttgcatttctctaatgaccagtgatgatgagcttttctcatatgtttgttggctgcataaatgtcttcttttgagaagtgtctgttcatatcctttgcccactttttgatggagttgtttgttttttcttgtaaatttgtttaagctctttgtagattcaggatattagccctttgccatatggatagattgcaaaaattttctcccattctgtaggttgcctgttcataccgatgatagtttctttggctgtggagaagctctttagtttaacccaatttgtcagttttggcttttgttgccattgcttttggtgttttagtcatgaagtctttgcccatgcctatgtcctgactggtattgcctaggttttcttctaggattttcatggttttaggtcttatgtttaagactttaatccatcttgagttaatttatgtgttaggtgtaagcaaggggtccagtttcagtgtcctgcatgtggctagccagttttcccaacaccatttattaaatagggaatcctttcctcatttgattgtttttgtcaagtttgtcaaatatcagatggttgtagatgtgtagcattatttctgaggtctctgttctgttccatttgtctaattttctgttttggtactactactatgctgttttggttactgtagccttgtactatagttcgaaatcaagtaacatgatgcctccagctttgttctttttgctcaggatcgctttggctatatgagctcttttttggttccatatgaaattgaacgtagttttttctaattctgtgaagaaagtcaatggtagcttgatgggaatagcattgaatctataaattactttgggcagtaaggccattttcacgatattgattcttcctatccatgtgcatggaatgtttttccatttgtgtcctctcttatttcctcaagcagtggtttgtagttcttcttgaagaggtccttcacctcccttgtaagttgtattcctaggtattttattctccttgtgcaattgtgaatgggaattcactcatgatttggctccctgtttgtctattattggtgtacaggaatgcttgtgaagtcaatatttgaaagcaacaaaaattgtcctgaaggttaaaaccgtaaatccacattggaggaactgcaggggcaggggccccgggcagcccagccccaggggtaggcaggcaatggctcctttagctgacctgaggtgcctgcagcgggacttcctcagcctctatccacttgacctcgaccttgcttgtggacctggcaactccagcctgggcctgggtcccacgtcctgagactgccttagctcagatgctcctgctccgccaggtcctcctcaaggcggctactgcttctggcactgcagatagagtggtagcatataatgtataatcaacgaatttcaagacaattttggagctggaacccaagcctatcaatcatgtctacattgctcagacaagctctgcatcaggagactggaaaagccatgcttggaaaccttggacacagagagcgacctcacagatggaacagcaaggacgtgacacagatgtccttggcccagggcccttcctgccccgctggggatgcagccaccacgggttctgccgggaacctctgatcccaagctccccagagtttacacgtgacctggagacacacctcggacagccaacaattcagtattttgaatcagtcgggacaaaacaacgtgacagtatcagaatgacgtaccttagaaagaatgacatattcctaggcctctgggagtttgcgacaagtacttaagttgtacactttattattggaaagcttcatgtacgggaaagaaaacagccaagacaaacacaaatgcgtttttgatggatatggataaaggggaaaccaccgttccaatgttcaagcagtgattccatccgaagactacacaagacgacagaaagccccagcgagtgagccagccgccggacaacagcaatgtccttcctgactatcgcggagctggcggtcagcagccccttagctcccatgcccatcggagtacgtgcgcagcaggcaagggcgaccccgtggaaggacgcgggctgagcttagaggggcacccagcgctgctggagccgcccatgctgcaaatgctgtgctgtgatccagaacttatttatttatttatttatttatttatttatttatttattttactttaagttctggggtacatgtgtggaaagtgcaggtttgttacataggtatacttgtgtacttgtgccatggtggtttgctgcacccatcaacccatcatctacattaggtatttctcctaatgctattcctcccctagctcccccgcccccctaccacccgcaggccccagtgtgtgatgttccccttcctatgtccacgtgtcctcactgttcaactcccacttatgggtaagaacatgcagtgtttcattttctcttcctctgttactttgctgagaatgatggtgtccagcttcatccatgcccctgcaaaggacatgaactcatccttttttatgactgcatagtattctatggtgtatatgtgccacattttctttatccagtctatcattgatgggcatttggattggttccaagtcttagttgttgtaaacagtgcctcaataaacatatgtgtgcatgtgtctttatggtagaataatttatagtcctttgggtatatacccagtaataggattggtgggttaaatggtatttctagttctagatccttgaggaattgccacactgtcttccacaatggttgaactaatttaccttcccaccaacagtgtaaaagcaagcgttcctacttctccacatcctctccggcatctgttgtttcctgaattttttagtgattgctattctaaccggtgtgagatggtatctcagtgtgattttaatttgcatttctctaatgaccagtgatgatgagcttttcttcatatgtttgttggccacataaatgcctccttttgagaagtgtctgttcctgttctttgcccactttttgatggagttgttctttccttgtaaatttgtttaagttctttgtagattctggatattagtcctttgtcagatggattgcaaaaattttctcccattctgtaggttgcctgttcatgctgatgatagtttctttggctgtgcagaagctctttagtttaatgagacgtatttgtcaattttggcttttgttgccattgcttttggtgttttagtcatgaagtctttgcccatgcctatgtcctgaatggtactgtctaggtttccttctagagtttttatggttttatgtattacgtttaagtctttaatccatcttcagttaatttttgtataaggcataaggaagggatccagtttcagttttctgcatactggtaccaaaacagatatatagaccaatggaacagaacggaggcctcagaaataacaccacacatctacaggcatctgatctttgacaaacctgacaaaaacaagcaatggggaaaggattccctatttaataaatggtgttgggaaaattggctagccatatgcagaaaacagaactcttaagatagtagaatatacggaaatacaaacggggattttggagcatgatggtacaaccaattccaactttgttgtaatttttaaaattctggcaccttctatgcatatgatcctttagatgatatattctgtacagaggaagaaccagatcatccaaccaaaaacaaatgaatggatgccttacatattcctgaatgaacttttgaagagcttttgagaggctgacttcaaaccgtttaggaaactacatggaaattgtgcagacttttctgggacttttctaatgtttgtaatactgtatttaggttcttttcctattttcttttaaggagtacatttggaaatttaaaacaattggcaaaccttcaattagtgtattaaatgcaggagacttctgtattttgggcaccttcctaatacgctttatcatttagcactttgacttgagtggtgttgattaaacatttgaccagtaactatgtttttataaatctactgtacaaattatacagagtttaagatttaagatacagcttctaaggtcaacgctgtatataagtgtataatttttaaaaaagattttgtacatggaaattttctatttatatatataatattttttacttctatatattgagagtatttagtatacttttatataaataaagacaactggtaattgctgaaaaaaaacaaaaataataaaaccatgtcaaatacagtcaggtaccaaataaagataaccattatctccattatttttcaacaaatttgatgagttccagcaaatacaggtaaataaaaaattgaaatttcttttagaaatattaaagagagccctaagttggagggttgcgggggatatgccagggaatttttttttctattcctacttttcttagagttttcattaggaattgctgctcaatttgaccaaacatcctttcagaatctttaattgaagggagaaacatgtatatatgtatatatacacacacacacacacacacatatatatatacacatatatatatgtacacacacacatacaacttgttgaggaaattaattatattcataataattcatggatatttattcaggatttctcttttgaaataaagaccacttgctcatagcaaaatttcatttctcacttgctgaattccatatgctaatactgtattcaaaatacagtattggcatatgtatttatattaataattgtctcgtttattttatttatactaccacatctgcctttatttttaattttcatttaaatttactttaataaaatggtttgaagatacatgattttctactggaatcatctcttctttaagaattaggtaaaactcagttttatcactctgttcctgatgctttttcaaagtagaacttttatcaattgtaaaatttaaattaactttattaatggatcttgagctactcatttggccacataacaatcaaaagaaaaaagaaaatgttgcttgaatcattgaggaaatcatcttggaattacaacaaatgctgaaatagtgtttccatagccacgtgaactacctaataatgtattttacttcaattagtttaactcagaatgatatgtctctttatacacttttattacataaaatcttgttttaattgagtctttgaaaacaatgaattattttcagtcatagccttaaatattgtcattaccttaaataagtacaattttatcaaatgtttcaatattcttttctaactaaaataggtggctcttttctatattgaaattcagtgatttattattattgtattatgattagtttcactaagatttgttatttttattagagctgagagctgaaactgcattcttaattgtaataaataattatcaaaatcaaacattattgcataattatacattattttaggctgaaattttaggaattgtgaaattttaggaattgtgaaattttaaactattcatagttctttctttcatcatataaccagatggaccttcttgttgggacttttcattttaaacgacataaaatttagactagaaatgcctattgaaagattcctatgtcatttctacatatttatgaagtatttttaaaaattaaaatgcagaaaaaaataataaagtgaatgaatacatacaatgcctccccaggaacatcacattaccttccttgaactattatgttgacgataatctgactccccatccctaatgtgatgtatttctagcttttccagctctgtcctgtatcctgtggttgcagcaaccaagatgagagctgatgtgactcaatcatgtcaaattcttttttttttttttttgagttatttcctccacgttcccaattatatttgacttcacatagttgattaacccactacttccaaaagttatgtgataaggttttcttagatgcagctctataccctactttccagctgggtaatttctgctgctacacttgatttactttccaatccaacagtaacagctcttgtgaatattacagactcatttcttgctcaaatgcttctctcttaagaaggccttatctcctgcccatggctagcaactgccatgaccctgtgagcaatctgcagttgtgaatgtatatacctgcaggaaaccacagaagggtagtatgctccctcaccctgccaccagaagactcctctggaaacatgaatgtgctggtagacacacaaatggcaggaggactccctaacactggcatgaaagcctttacattaccgtttcaaccaaagctgtcacccagtagttcctgtaaaaagccaagttcttatttttccttcagttcgtaaatgactgcataaaaaaagatacatttatttggtttccacgtatagtcagtattttagagtgaacagtaaagtgtgttatagtttctagattagcctagttattttatctgtaaagtgacctgtttcaaaatcaaccctcaaagtcatgtttaagatccttttcagataggatccagaataagaaaataatttactatgtcaagtgggatgagtccaatatctaagtgaccgttttccatcattgttactggcgggcagaaatacgtcaatctgactctcttaagatcaaaatcttacttgattccctgacatcatatgaggccagttaactatgatcctcacaagctaatcttcctgcccttgctgtctgtgaagggaggtgtgtgcgtgtttcctgatgtgtgcttaaaatatgcctagacaaagcagcagtgccctctttttatcaattaaaagcaagctcagctatgggtatccttggctttatattgcagagcagtggcaggtagctaaattcctccttagaatctcatagacgttagaatggcctccaagaggaaaccagaaagggcaaagaaccaaaaaatgttgtatgaacttttcttcttaatagatgaatggaacttaagagctttcagttcatgaactgagtcattagatttgtagtggttttaatattaaacacataaatatctatttgaatttaatttctcttttctattcttattgattgtcaccatttatcaaccctcttgcttgggtactcatctatagcagtttgagagaataactgtgctaatactttatctgattaaaattcacaacattttatttgaattatgaaatgtgagtgaaagtaaaaaggacaactggatttattggttatttcttatttggcaggaataattcgttcattattattcaagatatagaacctgtattttccaacctgacagtatcagtctgatataatatgcatttaaagcatagaagaaaaattgaaaaaaaaaacactatctcaatcctattccctgaaaagattaataagcctgcattaattaagaaatgtgtatttgtcaaagacttaaaattatgattacacagatactcataagtgaccttatattttaaaaactcattatctctttagggtgagattttattattgtttaacgttcttatatttttcacttatacttgaaaaaaactttaagattgaagcacaaatataaagctttaaaagtaaagcaactgcccagtgcctatttcataggcaaccatatttaaccaatacatgtcatatttttcccatatctatacccatatttacatattcccatatttatatacttattcaaaattgattttcataccattatttctttttgtttaatcctagatattatctattgtacacttaatatagaatatgagtacttagctattttttccactgccccatatattttaatttatcagaaattcccaatagagtcacataatattgattatatcaatatatagaggttataatataatgtcaatacaaatacataagccaagttcataaattcattctaagccaaaaaaagcaaaagaaaaaacactggaaatttcaatgagattgtcctaaatctatagaaaaatagggcagaattgttatcttcacagtactgtgtccagcaatccatgacatagaatacccaccaacacaatcaaggtaataaaatactcatttaccctaaaagtttaatcttgccactgtataatctgtccttctgcctcttctcttctccccattccctgaacaatcactaatctgctttgtggcgctatacatttgtttacattttctacaattttatgtaaatgtaatcatataatagtatgttttctggcttctttcactaaatataattattttatatttattcacctggtatcatgtacccatcactcattgctttttttcttgttatgtggagtcacattccattataaggatatatctcagtttgtctacccatttactttttgatggacatttgagttttctaaattttctgattaaaaatacagctgctatgaatattcatgaaaagtatttgtaagtacatttactctgatttctcttggataaatttctaaaaattaatttactagatcatgtagtatggcttgtttcaattttatgaaattgctaaattattttccaaaatcattgtgacattttcagttttaattcttagtctctaagcattccagttcctccaaaaccttacacacacttagtatgtgagacatacataatttagacatttcagaagatttatagtggtatctcattatagttttaatttacatttcactaattgctattatgttaagcatattttaatgcactaatttgccttgaacataagttcaaggatatacctgcctaagatttttcctcatgttttattaggcgtttgtattattattgagttttgagtgttctgaaacatattccaagtatatattatttatcagaaaaagatttacaaatattttctcaaagtttgtgactttcttaaaagtatgttgcatagaaaagaatggttcaattttgattactcccaacttaacaatttgtgtttttattggatgtacttttggattaataactacaaaaataaatcctgccttaatgccacaacggttttctccaaagtttacttttagaagttttataagcttagactttacattcaggtaattgattcactctgagttagtattagtatgtcgtgtaaggtatagctcaaagctccttttcttttctaatgaggatttgaaatagttccagcacaatttgttaaaaagattttactttctctactccattgcaacattgttgaaaaattgttgtttatttttgtttgcatttatttctggacatatattatattaattatattacattatatcatgttacattattattttattttgctttatctatctttttgataacacaatgtcttgatgattatagtttctttatatctcttaaaatcaaacgatgttggtttaatagctttgctttgattttccaaaggtggtttggttatcctggattttttaaatttccacatgaattttaataacagtttgtcaatttttataaaaaagtctgctgggatttccatatgggtttgataaatattgagtcttgtgacacatatatttaaatgtttaaaaattactcatagcaatgttttgtatacagggcttttactacttttgttagattgatacataaatatttcatggttttggtgattttatagtttttttaaactagaaattctgattgtttataaagaaatgtgattattttatatttatcttatttcctgaaactctgctagaaagattagttatgattagttccaggagctttttttttttttggtagattctagtgcactttttgtaagccatcatgtcatctgcagatagaggcttttattccttctttccaaatatagatacctaaattttttctctatattgtcctgcctagtacctttatggaaatgttgactaaaagtagacagtgtggacactcttttattttttctaaacttaggtcgttaaggcctttagtcttttactatttagtaatgatattacctgtaggttttttttttatagcttccctatgccagtttgaggaagttccgttctaccattactttgcttaaagtgttcaacagatatgaattttgaatattgacaaatattttttgatatttcaacttaggtttttatgtggttaattacaccagttgatcttctaatgttaaaccaaccttgtattcctggattaaactccatttgatcattttgtattatctgatttgcattgatcatgttgtattgtttgatttgttaaaatatttaataatgtttacataagtcctttatctggctccttttaaaagttttaaaagtttgttcctttttatctttagtttgcaatatttttattatgatgtgtcttagcgtagatttatttggcaggattcttttgaggtttgttaagcttcttaaatctgtgggctcatgtctgtcatccaattggagaaattttcagacattatatgtttaaatattctttcagtccctcttctttctcctctcctctatgactcatatgatatgcattttatacattttgttactatccttcaggttactttttcttttttttttttggtctatatactctattgttcagatagggtgaattctattattctgtcctcatctttgttaattctactctctctcattcctactttgttattgaactattcccaagtgattttaaaatttatgaaaaaatatttgtataatatctatttggatattataacataacttttttggctgaaattttataatttttcacttgaatcaaaaagcttgtaatttcttatggcaacatttttgttgattgcttcaaaatccttgtcagagagttccaatatgtgatttatctcattggcattagtagattatttcttccctttaaaattgtgatttttctgattctcaatatgacatatactttttactatatcctggtcattttgtttattatattaggtgactctgcctcttacttgagatttctttttttaagcagaaatttaccgtttagctcacgggtttgtggtccatggttccatttacaatatatgttttagagctgtttggtgctgctttgttctgactgatttatctcgtgtcactgggcacccactgttccctgctgggattgtttgaagggatggaaaaagctttcccaggtcagtgctggttatggagggttcctccctgctgtagaggaggtaggataatggggaccttggagcaggtctatctttgctggtactctccactaggatggtgtctctaggcagaggaggatagtctcaggaccttgacaaagtggcctccctcactgggcacgtatgaggaggtacccctgccaatgatcctagttacacagtgcctctgagtggggcagagtgttctgaggcccagggggaaggctagcacttctgctggcttcccgttgtcaccgctcactgatgtttgctgccttgcctggtattagtgcggctcctttacaatccagaggtggtatgagcctatatagcgtgctttctgttttaatgatggggctgagaaagtgcccggcctgtttggtgttcctctggtggagcaggtaaggtatccggcctctgtgctgtccagtgctggcctgagaccccaatcagattttccttctccttctgtctttcagagttcttatttggttgtcttttgtattttcttcagtgtttacagttgtacttcttggggaggagcagagagagatgagcctgtgcgtttttttttttttttttttttttttttttcacggagttttgctcttgctgcccaggctggagtgcaaaggtgcggtctcagctcgctgcaacctccgcctcccaggttcaaacgattctcctgccttagcctcccgagtagctaggattacagacgcctgccacgaagaccggttatttttttttattttttttttttttttttgtatttttagcagagacggggtttcaccattttggctaggctggtctcgaactccagacctcagatgatccacctgcctcggtctcccaaagtgctgggattgcaggcatgagccaccatgcccagccatctgtgccatcttgtcagggccagaagtcattctaaattggtttcaagtagccaattctttaattgcggttgaacaagttttctatgtatttaacaagatatatttccatgtttattaactgctttttcactgattattcttgtctcattttacatgatagtttaaaattataaacatattaatatctttttcaggtgtgtttgctataagtaactcttcaacttcttgttcttttaattttttttaaattttaaaatttgcacatggcttatatttttggatatgattcttggagaaattgaaattattttaactggaagaactagacttactaattctgtattttaaaaaatgttgagagttattgataataacagacttcaacattatattacaactgatgctattgataataacaggtttgcaggggaaagaaaagaaaatattaagtagaatatgtaatgcctatttattttttgcaagaggattagagtgaattgggtcaatttgctttaatctgaattagtactctggtcaatattggcagaatcagatttttatgcttttcgaatcattttctcttacatcttagcttattttatgttacataacatatgctccaaagcttatccaatttattggtgcaaaataggtgctcaacaattattaataatttaccaataaatacagtgacctgaacattctatctgcctttctgtggacttcttgattcctcatattgcctaatatagagcataaactcaggaagacctcaacaagtatgaatggaagattcacgttgtgtataaacaggtgatcacagaatgtgacaagaggatgaacattgatggctcttactgcaatgataaataattagctccctctatcttttataaaatgtttctgaatactagggaaaaatggaaggtggaagaaacaaccaataatttcaaggctttgccatcatataacatgataaatgtaatgatgattgtattctttttattctttttttcaggttcaggttcttcggaatgctggagaagaagtgactctaacagtgtcatttttaaaaagagcacctgctttcctcaaactcccattgaatgaagattgtgcatgtaagcatttataaagaatagataaaagtgctcacatcattatagttacataattattattttgacaataattggtgatttcttcttaaagttgagatttttgcctgactgtaaacatttttatattacaaagtgttctactaacctttatgaaaagggaacagatgttatttttcttgaagaatagattcaccacattacagttttttctaacctacaattggagaagtattatttgttttaaaaataggcatatcaaatatcatgtatgcattatgcatgtctattaaatttcatcagaatatttggtgaatgtattttctctaactaaaaattaatactaaacaagaatatgtgcttaagttattctgatgagagaagatgaaaaaaagcgtttgcctttgagggaatgtactaatttacatagaactacttaaaaagttatttgtcaattttattttcatgttccattttctaaaatgaaatgtatattatctaatgcttttgctgaaaaattgaagaataatatatgtttcactgagacataatttgtatgcaataaaatacaaagatcttgcacagtcggatcagttctgaaaaggcacacatttgcttaatccacttcttacaatcataaaactgttcccagtaaataacagcccagaaatgactactcacttacactctcttcttcatacattattttgcctcttctagaactttacagaatggaattatacttaattttttattctggcgtctttcattatgaataatttccttcagattcacttatttcttagattcacatatttcttagtttgttcatttatattgctgtttattttgctgtttattattccattgtatgaatgtactacatttattaatgcatctttctgttgaagataccagcactgttcccagtattttgctataataaataaagctgctggaaacgttcttttatttaacttttattttaagttcaggggtacaaatgcagggttgtaacataggtaaacttttgtcatgggggttcgttgtacacaaaccagttattgaaattagtacccattagttatttatcctgatcctgtccctcctcccaccctacatcccactgaaaggccacagtgtgtgtggttctcctctatttgtctatgtgttctcatcaaatagctctcacttgtaagtgagaatgtgaagtatttggttttctgttcctgtgttagtttgctagggataatggcctccagctccatccatccatgtccctgcagtggacatgatctcgttcttttttatggtgacatagtattccatggtgtatatgtacaacatttttgttatccagtctaacactaataggcatttaggttgattctatgtctttactattgtgaatagtgctgcaatgaacatacacatgcatgcgtctttataatagaatgatttatatgtattgggtatataccatttgacccagcaatcccatcactggaagcttcttgtataaggcttttggcagttttgtaattttattttattacaataagtacttaagaattgaattgctgagtgactagaaagatgtataattaacttgttaataaattgccgaatttaggtggggtgcagtggcccatgcgtgtaatcccagcattttgagaggctgaggccggcagatcacctaagctcaggagttcaagaccaacttgaacaacatggcaaaatgccatctctaccaaaaatacaaaaaaaccccaaaatagccaggcatggtagcatgtgcctgtggttccagctacttgggagtctgaggtgagaggatggcttgagcctggtaggctgaggatgcagtgagctgagtaagaccccatctcaaaaataaataaataattaattaaaataaataaattgtgaaatttatttccaaagtgagcatgttatttattgtggtaaataacacataacataaaatttaccatctttaccattttaagtgttcagaagagtagccttaagtctatgtacattattgcgtaacatatcaccagaaacttttgatattgcaaaatggaaattctataccccttaaacaattccctattttccccagacccacccactggcaaacaccattgtattttgtttataagaatttgactactttagacaccttatgcacttggaataatccagtattttcttttggtgattagcttatttcatttagcataatgtccttaagactcatctatgttgtagaataggacaaaatttcattcctatttaagaatgaataacattctttcatatgcatataccacatattctttattcagccctcaaacagtgagcatttagattggttccacatctttgttattgtgaataatgctacaatgaacatgagtgtacaaatatcattcacaactctgctttcggttattttggatacatactcagaagtgggattcctggatcatatgttaattctatttttaattttttgaagaatgaccatactgttttccatagtagctgcatcattttacactcttaagtaacaggcaaagcttccaatttctacatatcctcaccagcacttcttattttctgtttttttgctttgttttgttttggttttgatagtggccattctaattgttgtcagatgataattcactgtggttttgatttgaatttccctgataatcagtaatcttaagcgtcttttcacatatttattggccatttgcatattttctttgaagacatgtctattcaagtctactatccagttttaaatctggttatttgttttgctgttgttgagttgtaagaattcttcagatactctggctattaacgtattaccagacatatggtttgaaaatattttctcccatttcaaaggttgctgtttcactctgttgatcattttatttattttacaaaatttttaattcttctgtagtcaagtctatttttgcttctaatgcctgtgtttttggtgtcatattcagaaaataattgccaaatccaatgtcataaagatttttctctaatttttctgctaggattttttacagctcaaatctaatgtttaggtatttgatttgtgttgagtcaatttttatacatagtataaggtaagtgcccaacattcttttgcatgaggatatccagttttcccaatataattaattgaagagaagactattctttccctattgtataaccttaacatgtttgtttaaaataatttcatcacatattgagggttaattttgggattattccgttccattgttctatgtgtctgcattaatgccagtaccacattgtttttattattgcagctttgtaatgtatcttgagttcagaaagtgtaaagccccagctctgtttttctttctcaagaatttttgactattcagaattcgttgaggttttgtatgaagtttaggatagtttttctatttctgcaaaataataccatagagattttgatagggattgcattgaacctgtagattgcattgcttagcatgaacattttaacaatattaattcttccagtgtatcagcatgggatgtctttctatttatttgtttcatctttaatttctcaatgatattttgtggttttcagtgtaaagtctttaaaattttgggtgagattattcctaattattctttttgatgctattatcaataaaattgtttttttattgttaatggatagaaacaactgaatttttatgttgtctattctgcaacttccttaaacttgtttattagatctaacatttttgtgtgtgtgtttaaactttagagttttctacatataagctcatatctgcaaacaaagataattttacttcttcatttgaatttgggtgacttttatttcttagtcttgcctaattgcttctggctagaacttttggttgtatgttgaatagaagacttgagagtgggcatccttgccttattcttaatcttagagggaaagctttcagttttccattattcagtataatgttagctatgggctttttatatatgaatgacctttattatgtagaggtaatttccttctattcctagtttgtaaaatgtattatgttttaaattgtgaaaatattgaatttggcaaatgcttttttcttcatcaactgaggtgtctatgtgggatttttttttctgccattctgttattgtgatgtgttaattacatagatagattttttttcatgttgaaccatccttgcatttcaggaataagtcacacttgatcatggtgtataatcttttaaatttgtagttgaattcagttttttagtatctttttgaggacctttgcattaatattcatcaggaatattggtttgtagttttattttttgtagtatctttgcttggtttcagtatctgggtaatgttcacttcaagctggaaactgctttcccctcatcaaatttttttgaaagagtatgagaaagatcagtgctaattcctctttaaatgcttggtaaagttctacagtaaaaccatctggtcatgggcccttcgtattttgtgaggaatttattaatgattcaatttccttactagttctatgtctgtctgtattttttgtttcttcataattgattgttggtatgtcacatatttctagaaggttatctattttttctagattattcagtttgttggcacataattgtccatattactctttaacaatcattttggtttttgtggcatcagttgtaatgtctactatttcatttctttttttttaattatactttaagttttagggtacatgtgcacaacgtgcaggttagctacataagtatacatgtgccatgttggtgtgctgcacccattaactcatcatttaacattaggtgtatctcctaatgttatcccttccccctccccacacccccaaacaagccctggtgtgtgatgttccccttcctgtgtccatgtgttctcattgttcaattcccaccttcatttctttttttttattatactttaagttttagggtacatgtacacaacgtgcaggttagttacatatgtatacatgtgccatgttggtatgctgcccccattaactcatcatttaacgttagatatatctcctaatgctatccctccccactccccactcccctcaacaggctacggtatgtgatgttccccttcctgtgttcatgtgttctcactgttcagttcctacctatgagtgagaacaagcagtgtttggttttttgtccttgcgataatttgctgagaattttatggtttccagtttcatccatgtccttacaaaagacatgaactcatcattttttatggctgcatagtattccatggtgtatatgtgccacattttcttaatccagtctatcattgttggatatttggcttggttccaagtctttgctattgtgaatagtgccacaataaacatacgtgtgcatgtgtctttatagcagcatgacttataatcctttgggtatatacccagtaatgggattgctgggtcaaatggtatttctagttctagatccctgaggaatcgccacactgacttccacaatggttgaactagtttacagtcccaccaacgatgtaaagttttcctatttctccacatcctctccagcacctgttgtttcctgactttttaatgatcgccattctaactggtgtgagatggtatctcattgtggttttgatttgcatttctctgatggccagtgatgatgagcattttttcatttgtctgttggtggcataaatgtcttctttcaagaagtatctgtccatatctttcacccacattttgatgggattgtttgtttttttcttgtaaatttgtttgagttcattgtagattctggatattagccctttttcagataagtagattgcaaaaattttctccccttctgtaggctgcctgttcactctgatggtggtttcttttgctgtgcagaagctctttagtttaattagatcccatttgtcaatattggcttttgttgccattgcttttggtgttttagacatgaagtccttgcccatgcctatgtcctgaatggtattgcttaggttttcttctagggtttttatggttttaggtctaacatttaagtctttaatctaccttgaattaatttttgtataaggtttatggaagggatccagtttcagctttctacatatggctagccagttctcccagcaccatttattaaatagggaatcctttccccattgcttgtttttgtcaggtttgtcaaagatcagatagttgtagatatgcagcattatttctgagggctctgttctgttccattggtctctatctctgttttggtaccagtaccatgctgttttggttactgtagccttgtagtttgaagtcaggtagcgtgatgcctccagctttgttcttttggcttaggattgacttggcgatgcggactcttttttggttccacatgaactttaaagtagttttttccaattctgtgaagaaactcatcggtagcttgatggggatggcattgaatctataaattaccttgggcagtatggccattttcacgatattgattcttcctacccatgagcatggaatgttcttccatttgtttgtatcctcttgtatttcattgagcagtggtgtgtagttctccttgaagaggtccttcacatcctttctaagttggattcctaggtattttattctctttgaagcaattgtgaatgggagttcacttatgatttggctctctgtttgtctgttattggtgtgtaagaaggcttgtgagttttgcacattgattttgtatcctgagactttgctgaagttacctatcagcttaaggagattttgggctgagatgatggggttttctaaatatacaatcatgtcatctgcaagcagggacaatttgacttcctcttttcctaattgaataccctttatttccttctcctgcctgattgtcctgtgcagagcttccaacactatgttgaataggagtggtgagagagcatccctgtcttgtgccagtattcaaagggaatgcttccagtttttgctcattcagtagactattggctgtgggtttgtcatagatagctcttatttctttgagatacatcccatcaataactaatttattgagagtttttagcatgaagggttgttgaattttgtcaaaggccttttttgcatctattgacataatcatatggtttttgttgttggttctgtttatatgctggattacattcattgatttgcatatgttgagccagccttgcatcccagggatgaagcccacttgatcatgttggataagctttttgatgtgctgctggatttggtttgccagtattttattgaggatttttgcatcgatgttcatgagggatattggtcttaaattgtctttttttgtcgtgtctctgccagcctttgttatcaggatgatgctggcctcataaaatgagttagggaggattccctctttttctattgattggaatagtttcagaaggaatggtaccagctcctctttgtacctctggtagaattcaactgtgaatccatctggtcctggactttttttggttggtaagctattaattattgccacaatttcagagcctgtttttggtctattaagagattcaacttcttcctggtttagtcttgggagggtgtatatgtcgaggaatttatccatttcttctaggttttctagtttttttgcgtagaggtgtttataatattctctgatggtagtttgtatttctgtgggatcggtggtgatatcccctttatcattttgtattgcatctatttgattcttctctcttttcttctttattagtcttgctagcggtctatcaattttgttgatattttcaaaaaaccagctcctggattcattgattttttgaacagttttttgtgtctctatttccttcatttctgctctgatcttagttatttcttgctttctgctaactattgaatgtgttttctctggcttctctatttcttttaactgtgatgttagggtgtcaattttagaactttcctgctttctcttgtgggcatttagtgctataaatttccctctacacacagctttgaatgtgtcccaaagattctggcatgttgtgtctttcttctcattggttttaaagaacatctttatttctgccttcatttagttatatacccagtagtcattcaggagcaggttgttcagtttccatgtagttgagcggttttgactgagtttcttaatcctgagttctagtttgattgcactgtggtctgagagagagtttgttataatttctgttcttttacatttgctgaggagtgctttacttccaactatgtggtcaattttggaataggtgtggtgtagtgttgaaaagaatgtatattctgttgtttggggtggagagttctgtagatgtctattaggtctgcttggtgcagagctgagttcaattcctggatatccttgttaactttctgtctcattgacctgtctcatgttgacagcgtagtgttaaagtctcccattattattgtgtgggagtctaagtctctttgtaggtctctaaggacttgctttatgaatctgggtgctcctgtattcagtccatgcatatttaggatagttagatcttcttgttgaattgatccctttaccattatgtaatggccttctttgtctcttttcatctttgttggtttaaagtctgttttatcagagactaggattgcaacctctgcctttttttgttttccatttgcttggtagatcttcctcgatccctttattttgagcctatgtgtgtctctgcacgtgaggtgggtttcctgaatacagcacactgatgggtcttgactctttatccaatttgccagtctgtgtcttttaattggagcatttagcccatttacatttaaggttaatattgttgtgtgtggatttcatcctgtcattatgatgttagctggttattttgctcgttagttgatgcagtttcttcctagcctcgatggtctttacaatttggcatgtttttgcagtggctggtactggtttttcctttccatgtttagtgcttccttcaggagctcttttagtgcaggcctggtggtgacaaaatctctcagcatttgcttgtctgtaaagtattttatttctccttcacttatgaagcttagtttggctggatatgaaattctgagttgaaaattcttttctttaagaatgtttaatattggcccccagtctcttctggcttgcagagtttccaccgagagatcagctgttagtctaatggacttccctttgtgggtaacccgacctttctctctggctgcccttaacattttttccttcatttcaactttggtgaatctgacaattatgtgtcttggagttgctcttctcgaggagtatctttgtggtgttctctgtatttcctgaatttgaatgttggcctgccttgctagattagggaagttctcctggataatatcctgcagagtgttttccaacttgattccattctccccattactttcaggtatatcaatcagacatagatttggtcttttcacatagtcctatatttcttggaggctttgctcgtttctttttattcttttttctctaaacttctcttctagcttcatttcattcatttgatcttccatccttgataccctttcttccagttgatcgaattggctactgaggcttgtgcattcatcatgtagttctcgtaccttggttttcagatccatcaggtcctttaaggactgctctgcattggttattttagttagccattcatctaattttttttcaaggtttttaacttctttgccatgggttcgaacttcctcctttagcttggagtagtttgatcatctgaagccttcttctctcaactcatcaaagtcattctcaatccagctttgttctgttgcttgtaaggagctgtattcctttggaagaagagagtcactctgatttttagagtttccagtttttctgctctgttttttccccatctttatgattttatctacctttggtctttgatgatggtgatgtacagatggggttttggtgtggatgtcctttttgtttgttaattttccttctaacagtcagaaccctcagctgctggtctgttggagtttgctggaggtccactccagaccctgtttgcctgggtatcagcagtggaggctgcagaacagcggatattggtgagcagcaaatattgctgcctgatcgttcctctggaagttttgtctcagaggagtacctggccgtgtgaggtgtcagtctgcccctactggggggtgcctctcagttaggctactcggaggacagggacccacttgaggagacagtctgtccattctcagatctccagctgtgtgcttggagaaccactgctctcttcaaagctgtcagacagggatatttaagtctgcagaggattctgctgccttttgtttggctatgccctgcccccagtggcggagcctacaaaggcaggcaggcctctttgagctgcggtgggctccacccagtttgagcttcctgggtgctttgtctacctactcaagccttggcaatggcggatgcccctccccagcctcactgctgccttgcggtttgatctcagacagctgtgctaacaatgagtgaggctccgtgggcataagaccctccaagccatgcgcaggatataatctcctggtgtgccgtttgctaagaccgttggaaaagtgcagtattagggtgggagtgacccaattttccagatgctatctgtcacccctttctttgactaggaaagggaattccctgaccccttgcacttcctaggtgaggcaatgcctcgccctgcttcagctcacgctcagtgcactgcacccactctcctgcacccactttttgacattccccaatgagatgaacccagtatctcagttggaaatgcaggaatcacccgtcttctgcatcgctcatgctgggagctgtagactggagctgttcctatttggccatcttggctccccctgcaatatttcacttttaatttttatttgcatattttacttttttttattagcctagtcaaggtttcgtcaatattgttgatcttttcaataaaccaactatttgcttagttgattttctatactgtatttcttttttccactttatttatttctgctctaatctttataatggctctccttctgctaccttgggtttagtttgtttctttttctagtttttgaatggtaaaatttggttgctgatttgaggtttttaaattattttgcaacataatgctttaaaatacatatgtttactgataaaattttctctctttgtaatgcttttgctgcatcccatgaatttttgtatgttgtgtttcattttaatttgttggatattgtttaaaatatttttaagtcccttgtgatttctttttgacttattggtttttcaaaacttcattgtttaatttccactcatttgtgtatttttcagttctctctctgctattgatttccattttaattccattgtatcagaaaagatatttgatatgatttcaatcttcttaaatttaataagatttgttttgtgaccacatatgtaaactattagggagaatattttgtgtacacataagaagaatgtatattttattattgttgagtgaagtgttctgtatatgtgttaagccaaattagtgcttagtgtcacacatgtcctccattttgttattctttctgtgtagtggttctataaattagtagcagttgaggacttaaatgtcatactattattgtgttgctgtctatccctttaattctgtcaaagtttgcttcatatatttggatatttggctgttaggtgcctatatatatttataattgttatatcttcatggtgaattgacagttttactattataaaatatctttctttgtgaaggtttttatagttaaagtctatttttgtctggaataaatatggtcactctgctcccttttatatcatttgaatgaaatatttttctctatcatttcattttcagcctgtgctcatcattaaatataaagagagtctgtagttgacagcatacataagcatatcttggagatattgccggtttagatccagatcagcaaaataaagggaatatagcaataaaacaagacacacaaattatttggcttcttgttgcatataaaagttatgcttattcttatattatagtctatcaaatgttccataacggcattatgtgtaaaaatacacataccttaatttaaaatattttatgctaactgggcagccatttgggcagacaacaagctagctgcaggagttttttttttttttttttttttttttttgttactccagtggatcctggaatgccaatgagacagaaccattcactcccctggaaagggggctgaagccaaggagccaaatggtgtagctcagcagatcccacccccacggaccctagcaagctaagatccactggcttgaaattctcgctgccagaacagcagtctgaagttgatctgggacactcaagcttgatggggggaagggcgtctaccattactgagcctttagtaggcggctttctcctcacagtgtaaacaaagttgctgggaacttctaacagggtagagtgcaccacaactctgcaaagccactgtagccagactgcctctctagattcctcctctttgagcagggcatctctgaaagaaaggcagcagccccagtcaggggcttatagataaaactcccgtctccctgggacagagcacctgggggaaggggcggctgtgggcacggcttcagcagacttaaacgttcctgcctgccggctctgaatggatctcccagcacagagtgcaagctctgctaaggaacagattccctcctcaagtgggtccctaacccccatgcctcctgactgggagatgcctcccagcagaggtcgacagaaacctcatacaggagagctctggctggcatctggcaggtacacctctgggaagaagcttccagagaaaggaacaggcaacaatttttgctgttctgcagactccgctggtgatacccagcaaacagggtctggagtggacctccagcaaaatccagcagacttgcaacataggggcttgattgttgggagaaaaactaacaaacagaaagaaatagcatcaccatcaacaaaaaggacatccacaaaaaatcccatccaaaggccccatcatcaaacaccaaaaatagataagtccacaaagatgaggaaaaaccagcacacaaagtctgaaaattccaaaaaccagaacaccacttcttctccaaattatcacaactcctcaccagcaagggaacaaaactggatggagaatgagtttgatgaattgacagtagtagtcttcagaaggtgggtaataacaaactcctctgagctaagggatcatgtcctatcccaatgcaaggaagataaaaacctttaaaaaaaggttagaggaattgctaactagaataagtttagagaagaatataaatgacctgatggagctgaaaaacacagcatgagaactttgtgaagcatgcacaagtatcaatagccaaattgatcaaatagaagaaaggatatcagagattgaagattaacttaatgaaataaagtataaagacaagattagagaaaaaagaatgaaaaggaatgaacaaagtcttcaagaaatatgggactatgtgaaaagaccaaacctacatttgattggtgtgcctaaaagtgaaagggagaatgaaaccaagttggaaatcactcttcaagatattatccaggagaacttcccctacatagcaaggcaggccaacattcaaattcaggaaatacagagaacaccacaaagacagttatcaagaagagcaatcccaagacacatagtcatcagattcaacacggttgaaatgaaggaaaaaatgttaagagcagccagagagaaaggtcgtgttaccaacaaagggaagcccatcagactaacagcagatgtctccgcagaaactcaacaagccagaagagagtgggggctaatattcaacattcttaaagaaaagaattttcaacccagaattacatatccagccaaactaagctccataagcgaaggaaaactaaaattctttacagaaaagcaattgctgagaaattttgtcatcactaaatctgccttacaagagttcctgaaaaaagtgctaaatatggaaaggaaaaaccgataccagccactgcaaaagtataccaaattgtaaagaccatcaatgccattaacaagctgtcaaataacaggcaaaataactgggtagcatcatgacaggatcaaatacacacataccaatattaaccttaaatgtaaatgggctaaatgccccaattaaaagatacagactagcaaattggataaagagtcaagaaccactggtgtgctgtattcaggagacctatctcatgtgcaaagacacacataggctcaaataaagaaattgaggaatatttaccaagcaaatggaaagcaaaaaaaaaaaaaaaaaaaaaatagcaggggttgaaatcctagtctctgataaaacagactttaaaccaacaaagatcaacaaagacaaagaagggcattatataatgataaaaggatcaatgcaacaagaagagctaactatcctaaatatatatgcacccaatataggagcatgctgattcataaggcaaattcttggagacctacaaagagacttagactcccagacaataatagtgggagactttaacaccccactgtcaatattagacagatcaagaggacagaaaattaacaaggatattcaggacttgaactcagctctggagcaagtggacttaatagacatctacagagctctccaccccaaatcaacagaatatacattcttcttagcaccacatcacacttattctaaaattgaccacacaattggaagtaaaacactcctctgcaaatacaagagaatgagaatcataacaaacagactctaagatcatacggcaatcaaataagaactcaggattaagaaactcactcaaaaccacacaactacatggaaaatgaacaagctgctccagagtgactactgggtaaataacaaaattaaggcagaaataaataagttctttgaaaccaatgagaacaaagacacaatgtaccagaatgtctgggacacagctaaagtagtgtttagagggaaatttatagcactaattgcccacaagagaaagcaggaaatttctaaaattgacaccctaacatcacaattaaaagagctagagaagcaagaccaaacaaatttaaaagctagcagaagacaagaaataactaagatgagagcagaacttaaggagatagagactcaaaaaaaccttcaaaaaatcaatgaatccaggggctgtttcttttgaaaagattaacataatagaccactatccagaccaagaaagaagaaaagagagaagaatcaaatagacacagtaaaatatgataaaggagatatcaccactgatcccacagaaatatattactactatcagagaatactataaacacctctatgcaaataaactagaaaatctagaagaaatgggtaaattcctgaacacatacaccctcccaagactaaatcaggaggatgtcgaatccttgaataggccaataacaagttctgaaattgaggcagtaattaatagcctaccaaccaaaaaagcccaagaccagttgggttcacagccaaattctaccagaggtaccaacaggagctggcaccattccttctgaaactattccaaaccattgaaaaagagggactcctccctaactcattttatgaggccattatcatcctaatactaaaacctggcagagccacaacaaaaaaagaaaattgcaggccaatatcactgataaacattgatgggaaaatcctccaaaagcaactctcaaaatgaatccagcagcacatcaaaaagcttatccaccacgatcaagccggcttcatccctgggatgcaagcctggttaaacatacacaaatcaataaatgtaatccatcacataaacagaaccaatgacaaaaaccacataattatctcaatagatgcagaaaaggccttcaataaaactcaacacccttttatgcaaaaactctcaataaactaggtattgatggaatgtatctcaaaataaccagagctatttatgacaaacccacagccaatatcatactgaatgggcaaaagctggaagcattccctttgaaaaccagcacaagacaaggatgccctctctcaccactcctattcaacatagtattggaagttctggccagggcaatcaggcaagagaaaaaaaataaagatattcaaataggaaaagaggaagtcaaattgtctctgtttgcagatgacatgattgtatatttagaaaaccctattatctcagccctaaatctctttaagctgataagctacttcggcagagtttcaggatacaaaatcaatgggcaaaaatcacaatcattcctatacaccattaatagacaaacagagagccaaatcctaagtgaactctcattcacaattgctacaaaagaataaaatatctaggaatacaacttacaggggaagtgaaggacctcttcaaggagaactgcaaagcactgctcaaggaaataagagaggacacaatcaatttgaaaaacattccatgttcatagacagggagaatcaatagagtgaaaatggccatactacccaaagaaatttatagattcaagctaccattgactttcttcacagaatttgaaaaaaaactactttaaatttcatatggaaccaaaaaagagcctgaatagccaagacaatcctaagcaaaaagaacaaaactggaggcatcatgctacctgacttcaaacaatactacaaggctgcagtaaccaaaatggcatggtactggtaacaaaacagacatacagaccagtggaacagaactgaggccttagaaataatgccatacatctacaaccatctggtctttgacaaacctgacaaaaacaagcaatggggaaaggattccctatttaataaatgctgctgggaaaactggctagccatatgcagaaaactgaaaatggacctcttcctaacaccttatacaaaaaataactcaagatggattgaagacttaaacgtaagatctaaaaccataaaaacccttgaagaaaacctaggcaataccattcagggcataggcatgggcaaagacttcatgactaaaacactaaaagcaatggcaacaaaagccaaaattgacaaaagggctcaaattaaactaaagagcttctgcacagcaaaagaaactataatcagagtgaacaggcaacctacagaatgggagaaaaaaggcaaaggctgatatccagaatctatgaggaatgtaaacaaatttacaacaaaaagcaaataatcccatcaaaaagtgggcaaaggatatgaacagacacttctcaaaagaagacatctatgcagccaacagacacatgaaaaaatactcatcatcactggtcattagagaaatgcaaaacaaaatcacaacgagataccatctcacgccagttagaatggtgatcattaagaagtcaggaaacaacagatgctggagaggatttggagaaataggaacgcttttacactgttggtgggagtgtaaattagttcaaccattgtgaaagatagggtggcaattcctcaaggatctagaacgagaaatacaatttgacccagcaatcctattactgggtatatacccaaaggaatataaatctttctactataaggacatatgcacacatatgtttattgcagcagtatttacaatagcaaagacatgcaaccaacccaactgcccatcagtgatagactggataaagaaaatgtggcacatatacaccatggaatactatgcagctataaaaaatgagttcatgttctttgcagtgacatggatgaaactggaaaccatcattctcagtagactaacacaggaacagaaaaccaaacaccaggttctcactcataagtgggagttgaacatttgagaacacatggacatagggaggggaacatcacacaccaaggcctgatgggggctgggggtctaggggagggatagcattaggagaaatgcctaatgtaggtgatgggttgatgggtgcagcaaaccaccatggcatgtgcatagctatgtaacaaacctgcgtttcctgcacatgtaccccagaacttaaagtacaataaaaaataatttttgctaaaacatgctaagaatcatctgaaccttcactgatttgcagcttttttgttagtctctctattgatggatgctgactgatcagagtggtggttgctgaagtttggaatggctatgacaattccttgaaatagacaacaatgaagtttgtcacattcattaactcttcctttcatgaaagatttctctgtaacatgtaatcttcttgggggattttacccatattagaacttccttcaaaattagtcaatcttcttaaactctgcaaccattttatcaactaagtttatgtaatattctaaatactttattgtcatttcaacaatgttcatagcatcttcaccaagaatagagtccatctcaagaaaacactcatgagattggaacaattcagtcacatcttcaagctctacttctgattgtaattctccagctatttccatcacatctactcttactgcctctacttgagaagtcttgaactcctcaaagtcacccatgagttggcatcaacttcttccaaatgcctcttaatattgatatttttacctactcctgtcaatattaatcatgagtattcttaatagtatcaacaatggagaatcatttccagaaggttttcaattgattttgcccaggtccatcagagtaatccccatctatggcagctgtccctgtattaaatatatttcttaaataatatgacatgaaactttgaaattcctttttcatccatgggctgcagaatggattttgtgttagcaggcatgaaaactacattaatctttttcatcttcatcagtagtcttgggtgtccaggaacattgtcagtaagcagtgattattggaaaggaatgtgttttgatgtgtgtttcagggtgtgtgtgtgtgtttctgagcagtaggtctcaacagtgggcttaaatattcagtaaaccttgctgtaaacagatatgctgccatctaggccttgttgttccatttctagagcacaggcagagtagattcaccataattgttaagggacctatccttgccctaggatttcagaatggtaaataaaaatggaattcaactgatagcagctgcattagcccctaacaagagttcgctgaagcttggaaggcagacattgacttccttcctttttttttttttttttttgagacagagtctcgttctgtcacccaggctggagtgcagaggtgtgatctacactaattgcagcctttgccactgaggttcaagcaattctcctgccacaacctcccaagtagctgggaatacaggcatgcaccgccatgcccggcttatttctgtatttttagtagagatggggtttcaccatgttggccaggatggccttgatctcctgaccttgtgatctgcctgcctcagcctcccaaagtgctgggattataggcatgagccactgtacctggcttgacttccttttacctatgaaagtcttagatgtcatcttcttctaatatgaggctatttaatggatacatcaaaaatctgttttttaatgaagccgtattcatcattaatcctagccctagttatagcttctaaagctcctgcaacagcacttgtttcttcatcttgtaattttatatatggtgacagtatcttttcttgagtctcataaagcaacatttgctatcttcaaacttttttttctgtaccttcctcacctctcagcctttatagaattgaagagagttagtatcttgccctggattaagatttggcttaagggaatgctgtggatggattgatctatccaggccactaaaactttctccttatcagtaagaagattgttttgcttcaaaatgcatgtgttcactggtgtagcactgttaacttccttcaaacacttttcctttgcattcacaacttggctaactggcagaagaggctaagcttttggcttatcttggctttcaatatgacttcttcactaggctttttcttttctagcttgtgattttaagtgagagacttgcaattctttcttttatttgaacacttagaggccattgtagggttattctttgttctaatttcaatattattgtgtcttagggaatatggaagcccaaggagagggagagagatggggaacagctagtcagttgagctgtcagaacacatacaacatttattcattaagttccttgccttatgtggcgtggtttgtgaagctccaaaagaattacaatagtagcatcaatgatgactgatgacagatcaccataccacgtataataataatgaaaaagttgaaatactgtgggaattaccaaaatgtgatgcagagacacaaagtgaccacaagctattataaaaacagcatatagatctgctggatgcatggttgacataaaccttcaatttgtaaaaaatctgtgaagcaaaatcgagcaaaatgtaataaaatgagatatgtctgtacttggatattgggttttaaaatccacttaaccactttatctctgtggttttggaagtttattccacttaacatttaaataattgctgatagggaaacacttactgctgtcattttgttgttttctgtatgtcttatagttacagtgcccctcttttcctctttagctactttcatttgtttccttgttttttgtagttccatgctttgatccttttatcaatttcttttgtgtaccccttataggtatttctgtgactctaataggtattgcatagaacatactataacaatctattttaaatggataataacttaatcacagtacacagatcttacttctttacatcccctccccaccttctataccatatattggtttcaagttagtgtctctgttggggaatgaaatatagagatttctatcccacaatcttgctgttattaattcccttttacctatttttaatggacaaatatacttgttaaattattattttctattaaaaataagtcacctaggcaagaaataatcatgttaatatactttattaaatactattaaccgtttttaagtaagtgaatttaaactgataactccatgtcaatcacatacactgccttataaatacaacttgttatattttatatcccttaaaccacttgtataggtgtagttgtgatacaaattccacatctgtgaatttagcctgccgcaaatcaaaattgttaattaaaatattacacaacaataaaaataatacaaataaacagtacagtataacaactacatacatatttacattgtatttggtattatatgcaatctggagatgatttaaaatatactgaaggatgtgcataggctatatgcaaatactacaccattttatgtaagggactacagcagatgtgaattttggtatgtgaagggtgtcctggaatcaatctcccatggaggaatgactgtatagttatttttcacagttttatcatttaaattctgtaccacaataaaaattactatgaatacaccttcattattctgtatttgtctacatctacctttaccagaggacattattttttatatgcatttctctttctatctagtgttcttttacttcaatttgaagaattgtctttagcaattttgtaaaacagttctagtggtgatgaagtcccatggtttttgtttatttaagaagatctgtatttctccctcaaatttattgaacaggtttgctgggtatggtattctagattggctgattttatttttctttcagcactttgaatatatcatcccactcctttctccctataatgtttctgctgagaaatgtgttgatctatgagatcttccctttacctgcaaaattgcatttttttcttgcagctttcaagattatctgtttatctgtgacttttgacagtttgataataatgagtttcagtgtgagcctttctaggttcatcctagttggagatcttcaagtttcttctattgtatgttcattttcttccccagatttgggacatttttgaaaattatttctttgaataagctctctgcccatctccttcttttttcggacttctataaagtgtctattggtctgcttgatggtgtcatataaatctcttagcatttcttcacttttcctaattctaatttccttttagtcctcaaatgtcatgcctttgaattcactttttcttctgcttgataaaatctgctattgattatctctagtgaatatttcacttcattattgtattcttcatcttcagaatttctgtgtgggtttcttgtcttttctatatttttgacattttcagttcatgcataatttttctaattttatttagctatctgtgtttttgttttagcacactgagcttctttgagatgattattttgtgtttttaaagataatttacagacctggtttccacttggttttcggtggtttattttgtttctctgttgcttcatatgtctgtgctattattttttttctgggatttgtgaatttgaaaaaatcagccatgtctcttagactttttctaactgattacacaccggaaaagaacttcaccaatcagcctgggtaaagtgtctcccaaacattttcaggggattcatcttctctgggcatgtaatatcccaaaagagaggtttgttggtttctttttcctgaccttataattactatttcctctgctggtctggctgcagaactgcaggttctctagtgctgcaatgagcccctgaactcttctgtgttctctgagcctcaggcatccagagtatgctatgtctatcagtgcacccagtcagtgacacagaaaccagacccttgtgcactcccccaaaagccagaatattggatgagtgttttttgcttttcttccactctagagagtggctgcaagtttgacacttacttctgatcacaccaagttattccagcttagtggaagggctgtcatgggtgaaatgaaatggtctttttacccatttttaatgtggctgctcttggctttgagcttacctgggttactgtgacttattaactagtttctggagcactcttcaaagctttcttaactatatattgttgcaaagttggtgtgtctatgggaagcaaggtctgaggtttctattccaccatctttctgaacttcatcaaagtcagcatatatatgtgtgtgtgtgtgtgtgtatacacaaacacatatatacacgcatatatatatatatatttttttgagatggagtctccccctgttgccaggctcattgcaacctctgcctcctgagttcaagcagttctcctgctcagccacccaagtagctgggactacaggcgcttgccaccacaccaggctaatttttgtatttttagtggagactgggtttcaccatgttggccaggatggtctcgatctcctgtccttgtgatcatcccgcctcatccaccaaaagtgctaggattacaggcatgaggcaccgcgcccggcccgaagtcagcatgttattaaacaactcccactgtgttccccagaaaggtatgcaagcactggttgccctacattctttccaatatttgatgctcaaatatttcttccagccattctattgagtgtgcagtgaaatcttattgtagttttaatttgcattttcctgatgactaataataattatctccatattgtgtgattattggccatgtgcatatcttcttttggaaagcttctgttcaagacttttccccatttttctgttggtatgttctttttactattatagtgcatgaatttttaaaaatattatctatataagccttttgccagtgatataaattacgaagattttctcttagtctttgtatatctacatttttcacttgaggttgtctttgttagcagaagctttatttccttttattgtttttgtatcctctctaagacatacttgcctaccccaaggttgcaaagatattttttcttattttcctctagaggcctgttgctttagcttttatgtttacatttataatacatcttatatttttgtgcatcttacataagaatcaattatgtgtgtgtgtatttgatatatgtatatatatgattattatttgatcatacatgtttggatttattttgagatactttgttatttccactaatttacatgtctatttttttaaatgaaaatcatattatttattattgtaacatatcctaaagtgacctagaagaggttcttcaactttgaaatctgtaaagatcatttggctattctacatctattgtattgctgcatatatttcagaaatcgcatgccaatttgcataaaaaatgtattggaattttgaatggaactaaattaaatttataaacaatttggagattaccttttcatttatgttttcttctcagcaatatattagtctttttaatttggaattattgcatatctttcattaaatttatttatatgcattttatgttttaattttattgtaaataatattttaaaacttcattgtccagttgtttattgccaacacataaaatataatttaattttatatattaacatattgcaacatagcataattctagaaagacttttctgcattcttaacgtttttctatatacacgattgtgttatctgcaaataaggttttgcttcttcctttccaatctacatttctttaattattttgactttcccgttgcagtggctaagacttccatttttatttttaacaacgtgttaagggtagacatccctttctttctcttgatactagtggggaataatctaggtttattttgtcattagttagggtatcggatataggtttttaaagatgttctttatcagatagaggagcacatctattcctagaacgctaaagtttttaatttgctttttgtaaaaaacaaaaattgatggtgaattttctcaaatatttttctacatacatcaaaatattacatatatgctttcgttctttagccttttgatatggtaaatgtttaaaatggattttgaatgtaaaaccaagcttgcatttctagaataaataccacttacttggtcatgatgtgatatatttttcatatattactaggcttggtttgctaatatattgtttacatttttcttttttgcatatgtccataagagttgatagtctctttcttcttttgtaaattttggttagattttttttaatgtatttgttcacttcaactaagttgtcaatttctttcatgaagttatttatcatgaccgctcatcattccttttaacatccgttagctctcagtaatgacccctccttcattcctgatgttgataacttgtattttctgtctcttttttctaaattttttttttgctatgggtttatctaatttattagtttccccaaatatctgatatttgccttaattaattttctttattattttctcttttctatttaatttttcccagttttatttttatttttcatttattttgtttgttttgctttggttcaatttgctcctccattcttaagttcttaagatcattaagtttatacctaccttcttttggtgtatgtatttaaacatttaaatttcactcaaatgactacttaagattcagtcacagagtttgatatgttgtatttttatttttgttcagttcaaaatgtatatgctttaaaataataagtatatacatttgctttaaagtaatacatatatacattaaaatgtagaagatataaatgcaaataaacttcacaggaaaaataactaaaacatagtgtgatattcttacagtttaaagattagaaaaattatatccagatcagtatagcgagaaagcctatatttcccatcttagttccaggaaaattacagaatgtgagagtaataaaagagaagaacaatatctgttttttagcacatggactattatgtaagtagtgttccctatgacctatgatgtttgaaatcaagtataatatttcaaatattaattgagcgtcaattatatttgtgggtaatatttataaacattagtaactttaaaaaatatctttagaaaaatcaaataatcagaagtcaggaactattgtgactctaacacttactaaactgggaaatcttagaaaatgacaaatctttaaggcattactcatctttaaaaaatagatattagtaggcatctcattaaaatctaatatgaagttttttcattgcaattatacaaaatgtgataattttaatggatacttggatactaacaaagagtacctacaaaaacagaacatgcaaacatttttgcatcatggaaaattatagtttctaagggtaggatttaccacttggttgaaatatgacattaaatagaactctgtagacaaccaaaatcttgtattattttaagtatggtttctaagagcaggccactttagataattaaacaaaataatactttttataaggctgtacattttcctttataaagtcttaatgtttctgaaatcaaagacaaatttttgtgagtctcttttagtgcccagatacctgtagtcacttggcttacttgcaaaactctggctttagtataactgagataaaattgtattgtaatatctgatttacttgatattactgagtatccttgaaagtgtaatggaatgcatcagtttagaaggttatggcattctcaccagtggaatgttatgattttgtctcctgcaggtgctccaagtgaccagagcagtggcacctcctctcctctctgtgacagtggcttacatctcaactaccatcccaacaatacagtaagatgacccaggcatagctcagattaataaggagataacacatagcttataaaaactgctagtgaatctgatttatctgacagataggaaatccctggttgcataatcatttaagaattatgataaacaagaaatgcaaaataaatagatcaggtttcttatgccatttttttcccctctcaagtctgtatggattaagttcttttgaagcaatagatactattaacttggggatgtcactggagatgtataatatacaatcattttagaacattgcacattatatgtgatttcaggttcaaaatgctttgacattagttttctcacttttttcttttgaaattacttaactaaaagtaactatttaatttgctatttgttaggatttttttagccaactttattcacagtaagcaattactgcaaagtgagaaaatccaattcacacattattttgacatgtaaagaacgtttaactatacatgtatttagtagaagttaaaattaaactttgttttatagatatttaatacaattttaatctttgttctctacttgcattttgagtaaatcgattttaatatcttataaatgtttttgaagttccttgcatttcatccttcaaaacactcacacattcttaaagaaataattttctctggttataagcagatctaacaatcatctttcatgcttacaaacataaagagaagcagaggtgacgttaagcagaattttattgttctattccacatatcatggtacatacgtcatatagcttcttcaaccgactggtatgattcatcctgcaatttgaaatttttgtcaaaatagtggcattttacttcaaagcaatctttttgaacatcttcagtcctgaatggctttcacggtacctgatttccctagtattactcctcagctgagtaccttaggccctcaagttgtcaacttttttccttcgtaaaaagaaatttgccaacaccaaaggttatctgtacaaatctagggatattttctaaaaccatcttcagctggatatatttcatgtggccatctttgaaactttttttttttttgccaaagaaataattgccacacaataagtggcatttaaaaccacaatacagcatgattggagtgacttaaagtttatgaggaaatatacaggtttcctaatgaaaaacttagatatacaaccaaattttttacctctttattttgtaattgctttgctcaccttcttccctcccgatccagatgccttcgataatttcgatccacttctgttttccttcaccgcgctggtgcacctgccctcagtagctggaggtgttggctgtgcccattcacagcttatccctcttgtctggatcccctttgcctgggagtcagagctcacaggggtgtttggcaccacatgccctgcttccatcagtcctcagaggttgttcctgagagtgccccctccacgtgtccctcacacaagaatctccatctcacctctgctcctaagacagaaacaagagcaacttacttcagaatgggagaaagctctttggagctgttttgttctaggtcttgcctcatacccttgaactcctgtataataagcagagcagaggagtcagagtggcaggtctaagggtagaaatcattctggtttgtttttaatccattccattgacatatagaaaaacatatatagaataatgtccttccttataaaactgtaattacagcaagaaaatcactccaattctataacatcccaaataaattcagttttataaaattaaaaataaagcaactgttataaattcttcttactggagctatgtctccccatttccagaggcacattttattttccttttagcactaggattgaacattcttttgacattgctgaagatatttcagtgtaaggaaattgaaagtatcatgatgctatagagaataataataaaaccgtatgaaaacaaaataaagtatattcaaaataaagacaaaaatctcaatgcatatcaattaaatgcatttttgttgagaacttactctgtggaaatacccctctagctattttactttggggagctgttaattatgattttaacacaaaaaaattaagatccagatctatagacaaaagcatacaattaactataacataagcagaaaaagagaagaatgagtagcagcattctagtaacagagataaagagttgtagagactttgaccatctgactaaaaattcaacgtaagttgagagactacaaaccaagtgtgtgctttgttgctcgcacgggagcattaacctgcaatggtaatcagaccgtgcaggcttgcacagccagggctagcacgtgctgttccttctgtatcttgaataagctttgatggaggaatggcaagtggagaacatctctactcagagatgtacaaaattaggagaggtcaaagacatgaaataacaacagacagtgggcactcagaagaaagagtgcattgtgaggcaaattttctttccacagaatatgtgtatattatagacagtctatttaaaagaaacatttgattttctgatgtgtgttaattctcagttctatcctaggctcacaaactgccttttcaatgtctataccttgatctgaagccaattttgagtaggtattattctggttttctaacatgtccttactgtattttaaggcagcattttaattctaaggggaaataaaggcttatagtatattagcatcattccactatcctacataaaaatataatctattccttctaaagatgcgcgacatcactaatttgaaggtacatgaaagtcacttgttttgccaaccaagaccttggctcttaagccccagcccagattcactgaatttcttctctctagagatggagtagaagaatttgttctgtgcttaccagaagactctgattcagataatcagccaaccagactgagaaacattcttcttaactgtacacctttaattaatacatcctatgccaccaaatccttaataaaatctcagttagcagtttgccctttgtgcagttctgttctggtaagatagttgttcttgaggatattgtgtggcatgtgtaaaattttgggaaacaagcaaggagacataattgctgctttttccagtcacattattaatattgtaggaaacaacattcttgacattgtagagtagagctattgaaaaatagtcatggttctcaaaagcacaaaagtgattgtgtttttagactatcttttatgcaaaaataaataaactactattccaaaaaaatgattagaaagtaaatttatattctatttacataaataaaataagtaaggagaaaaattctttaaaggatagcttgtgttccactgtaaataacaggtctataatatgaaatacatcaactctgttgagtcaaataactgaagtgggacttattacatatttcttataaagaagaaatataagaaagtgacatacttatacctttggtacatacaggcatcaaatcaagatgccacaagaaagaatgtcaaaggccacatatatttccatacttgccaatctatgaagtgtattgataagatttgtaaaacctaccgtactcatgtattggtgattagtcagtcctcaacatctcattacccatatctttaacaatctttgacattttctatcccatttattgaagaaacacaaaatttgaaagaaattattattgtattttatgaaagatgagaaagcatctttaaataatatacctgaagttatataaccaaaatgtgaaataatcaagtaaaaaaatccaaattatttttccattgtttcactcctgattatccaggttgaatgttaaatgttccacagtagatctgttggctctgctatcaaaaaggtgttagtctgagtgaatcctgggggtgccctttgctggctgggtgacttgggtaaattgtttactatagaacttaggaatgcgtgtgtgtgcactggggttctgggaaggagtttcagtcattgccaacgaggaccttgctttgtgcagctgggtgggtcctgggccacttgcaatccctgtggacatctctggcctggtcacagaaaccttgtttgtttacccaagcctgccacacagtattattgcttcttcatgttccctcatgaagaaaagttgggaagtaataataaaatacttctttaaaaaaactttcttgtctcacgcctgcaatcccagcactttgggaggccaaggcaggtggatcacctgaggtcaagagttcaagaccagcctggccaacatggtgaaaccccttctctactaaaaatacaaaaattagtcaggcctggtggtgggcacctgtagtctcagctacttgggaggctgaggcaggaggaccacttgaccccaggggcggaggtttcagtgagctaagatcacaccatgcacttctaagtgatagagtgagaccctgtctcaaaaactaaaaataaaaaaaccttctgtttttcctttcaaatatgaacatagtaatagctttgtttttcaaagatgttgcaagtggtgtaagtcaagcacttagtacaagtaggtattattaaaactactattaaatagtaacagtaatattcctaagaatgccctccctaaaagttccatgtttagaaataattttgccccttatttcagcttattattatttctcgagaatataatatttgatacattttacttacagctaccaagccaggcatctaagtagtttgttttactaaatgttaaattaccattagccttttagatatattgaaaatagtatggagccatttagctgggctagattataagaaattttttatttgttgctataatcttaccagttgttaccattattatccccactttgaagataaacatagtaagatagagactacaaaacttgcccccaggtaatggactactcagttgggaaactggtattcaaatctaagtgttctgattctgacttgcagcttaagacctcgccaccttgtactatctcccagctgatcccatgtcatatgctgaccacctgtacagctgacatgaagatctgacctcacatcacatgccgatcatccataacatctgacatgaggccaggagaaagagtaatatgaaacctaggtttgtgcctttgcagtcaccagagaggcattaaaagcaactgactagcattgaaggacaggtgacttggaagctgaggtgctcattgagtcaccagtagggacccctcactaagtgatcttagccagtccacacttccaggtattctaaactgctccactgacttagtacatttttatttgctcaatctgccacaattaacataaaatgccaggcaacatacaaccttaagtaaaagtaatattgtttttcactggaagcattgttaaaaagtttaatgcctgagagtaatgcttaataatatttagacttcacagagtttcaatatctagactaaaatagaatcttcttccaacactatcactcaaaaattagtgaataaagggaagtcaatgttaccagtttactggtcaaattgagcttacaacccatgccaatttaaatattaatattatttgatgtgttggtgtgatgaagaaattttaacattaaaactgaaataatgaaggaaacatgaatcaagtgaaaaagcccaaattttatcaaatattagtctcctctatatataaaggaagaaaaaagctctaacaaaacttaatgtatgtgtaattttaagccagcagtagttgccttgatatgcaattaaaacaacataagaaagtataaactttttatgaacatgaagttagaaaaaggagcacagatttccttgagcagtgttttgaaagttgttttataggaaagcttattctattcaaaaatatttgcaaaaatctgataaattaaaaacacttatgattgtgcttggcactcataaaatactctctatttgaatgaactacagctgatttttatttcttcacttaattggttaattatagttacagttttttcccactttttccattcttgaataaattatgttctgtcacattcttatcctttccttccagctcccctcattttaaaatacgttttcactagcactcttagtctcaatgattcctttcttaacttcttatagcattctgttaataaataagttaaccaatacaactttagtgtccataatttggacttcttctcatggtattccattaaagtcttttgatcatttaggggaaaaataatatcccccagataaaaggggtttgagatacagaaactcaaagcacagaagaaaaaaattacgttgaatatttatcttcctttcaggacacattatcatgctcgtcgtggccgacgtctccaggcttgaggtgggagaagcgatggtgcgacctcagactgatccctctacttcattcgcgcttctctcagtatgtgcccggcacagatttgagtcggtgagtccgtgtttaggagttatgactgttttgtttatgaaaaaagagaccttttagaaaaccttttgacatatcacaatacgccttatgattttagtatgtttttgatagtagaaagaagagcttcaaaataataatctaacaaagttaaacacttattattctgatgacaaaaccacaagttaaagccctgactctgctattaacttattgtaatggattcaatagactcaatagatagttttattaagttttcatatttcatatttgttaattgtttacttctcaagaatattgcatagtttatctatttgtttgtttgttcacttattttgaggcaaggtctagctctgttgccctagctggagtgcagaggggtgatcttagctcactgcaacctccacctcctgagttcaggtgatcctcccacttcagcctcccgagtagctgggactgcaggcacatgccaccatgcccagctaattttttgttttgttttgttttgttttcgtagacatgggagatctgcctgcctcagcctcccaaagtgctgggattataggcataaaccacatgcccagcagcatagttggtctaaattataagatttattttctgcttttaatattcttatattattatctattttagtaagtgtaagataagtagtgccctccttttcattcttgaaactttttttctctttttatcttgatcagttttgctaaggagttgtacattttgttgattttttaaaaatgattaatttgggactttcttgaatctcttaacttgtatgtatactttatgagtctctgctttttccctgattgtttccatttcttaagtttttcagcttgaatttttgttcttatagctttctgagagatataacctccaggggttgggaaactttcctgtaaagagctgtatagtaaatattttatgctttgcaggccttaatgtctccatcacaaagtactcaactctgctcttctggcacaaaaatagccatatacaatatataaataaatgagcacacctttgttccaataaaactttttcacaaaaacaggtggcaggctagatttgtcccataggctgtagtttgccagtccattttgataattaattttaagatgtttatctcttaatatatgtagtcagatcttcacatttccagcaaatactgttttagttactcctgcaagtttagcattacctcttgatttatttatagtatttttgagtatatcactttgcatagttttctgactggttgcttgaggtattataatatgtgtaggtaatatatcacagtctactggtaacgttttaccactttgaatgaagaatagaaatgttgcttccattaagattcctttatctttcctgtttgtaaagatattaccttaacttcctatatatacatcaaacactatatcgggtggtattatgagttttgcttcaaccatcaaataagattttaaaaactcgtggaaaggataatccattatacttaacccaaagtatacccatcaatgatctttctgaatttcaaagcttcttttaccgcttcctttctgcttaatttttttagacattctttaaaggtagatttgctagcatctaattcccttagttttcatttatctgagaggatacagactttggagttgacagttcttttctttcagtacctaaaatatgttaggcattaatgtctactgtcattcaaatcagtgtcccctgtaagtaatatgttctttccctctgtctgctttcaagacttttttttcttttcttttcttttttagtttcagaagactaattatgacgtatgttggcacatatttctttaaatttctcctaaatgggctttattctgcttcttaagtctgtatgattatgactttcaccaaattaggaaagtttttgacctttattccttcaaacacttgattagtcccgctttccattctctccctctacatctctgttgatgcaaatattaacccttttattattgtcctgcatttcactgagaaactttttaaaaaatctgttttctttctgttaaacagattgggaaaagtttattgatctgtatttatgctttcaaattttatttcctgtcatttaactctgctcttcagccaattcagcattttattttttgtcgatttatttttttcagttctagtttatccttttaaaaataacttcttttttgaagtttttaaaaatatttttatttgtttcaagaaaacttgtaattgcctgttgaagcatttttaggatggttactgtaaaatccttgtgagatattttcaatatctcattcatttcattgttagtatcattaattcttttctcattcaacttgtgattttcctggatattgatatgacaagtgatttaacaaaatcatcctagactttttggatattaaatgttgagattcagattactatttaatctgggttttgttgttgttgttgttgttcttgttcttgttgtttttagcaggcaatctctttgttgtgaggactgggtgggtgtatatgttaagtttcctactgcaccatgctgacacctggaaaggtagatggagagggctattcatatttcttggttactaaaggttggaggtagaagctcagctcctcagggaattctactgacataaggaaggaggtggacggataggtgagggcaactagctccacctcccaccacctcattccactgcggtgatgatggtgggagagactcagctccttgctgggccacacctgtcagcatggaaggggaggcacagtacttgtcccatctcccacaagcccatttattctaattgctgcaggtgagtatgaaggttcagctgtccatgacaccccactgacactaccctggcagggaaattggagcctgcttctttaaggtgtaggatggaagaacagcttcttgctaagccctgctgaaaaccttgtgaacagggagacaatggttccattggtatttgactggatttgggcaggtattgccaaaagtttttgttttgtttttattgtacccattctctagtccttcaaaaaggagttacagatttttattggaggctttacgtttttaaaagtcttgctgttagccattcagattggaggtttcagagggtcgtgtctaggacatgcaggaggaaaacccaggggattcagcactttttttatccctgaatttgaagtccctagccattcatgcttagctgttcacctcacaggggcttcccatacttttgtcatcttatgtgtgaagttctttagttgcatcagaaagcagctgataagaatgaggccactctgtcttggccagaataagaaatccacaagtattgatattcatgtattttaaaaaattcatttgataatgttttattttttgttataattacttctatgacctatggactatttaaaagtgtatcacaaaatttcaaaatattttgggattttctaattatctttttttgctatttctatttagtataatttcatgctagatgatttcaatactttgatatttgttgaggcttgattttactcagcatatacgttattttgggaaatgttttatatgtatttataaaggatgagtattgtcatttttttagtgctgtgttgtacgtatttcaattaggtcatatgtgttcgttagaggctctgatcctctgcatcattcatgatttttttctgtttattgtattaggttttacataaacatggtaaagtgtcccactatgatggtagatctgtgtgtttctctacattgttgagtcagtgtttgctgtatatatttaattatgttgtcagatgcaagtagatttagaatttttataaattcctgttatatgatgcttgataattatggcatgtccagtacctttggaaatgtttcttgcctttaagtctatctgtattaggataaataaaaaacagatttctatttgttaatatctacttgtatattcttctatcctattctttaaacttttattagtcttactgtataaaatatgccccttctgcattaaatatatatgtatatatacacatctatatattatacatatatttgcaatattctttgttgtttttaatccaaagtaacaaacttggtcattaattcaaattagtctagttacctttaatgtaactacatatatattttgattatacatcttatttttttctattgaaaatcctagctttttataattaaaccttttattttgaaaaaattgaatattcacgtgcacttgtgggaaatagtattttcatttactcttattatcccagattgtatcacattgcaaaactgtaatacaatatcccaaccagggaatggacttgacaaaattcaccactaagattttacctgtgtgtgtgtgtgtgtgtgtgtgtgtgtgtgtgcatgtttatttctgtgaaattttatcacatatgcatgttcctgcatccactaacgcagtcaagttttgtatgaacagttccatcattgcaggcattctcctgtagtccttccataactacaccagcatccctcttgccctcctccctcaccacatttctaatctctgacaactaataatctgttcttcacctctgttatttgatcatattaagaacattatatatgatactatataaccttatttaattcaatttttgatgcataatagatgcatagttttagaatacatgtgatcatttaatacatccatagaatttgtaaaaatcaagttagtatacttacaatatccatcatcttagtatttgtcttttctttatgtgagaactattcaaatccttcttttccagctattttttaaaaatatacaatagattattataaactacagtcaccttactaagctatttaatactaggtcctatgtcttatactatactatatatttgtgttcatcaatcaacttctcttcattctctctctcttctaactttcctggtctcgggtaatgaacaatttactagctgtctcaatgagatcaacttttttagctcccacttaaatatgagtgagaacatggaatacttgtctttttgtgcctggattatttcactcaatataatgacctcaaattccatccatgttgctgcaaatgacagaatttcattttgtttttcatggatgaataatattttattgcatatgtatatatacatatatatatgaatgtagtatatgtatatatacatatatatgaatgtagtatatgtatatatacatatatatatatgaatgtagtatatgtatactacactttctttctgttttttttttttttgagacggagtttcactcttgttccccaagctggagtgcaatggtgtgttcatggctcactgcaacctccacccccgggttcaagcaattcttctgcttcagtctcccgagtagctgggattacaggcgcaccccaccatgccctgctaattttttgtatctttagtagagatggggtttcatcatgttggctagcctggtctggaactcctgacctcaagtgatccacccgcctcggcctcctaaagtgttaggattaaaggcatgagccaccgcacctggccaaatgtatactacactttctttagccatttatgcactgatagacacttaggttgatttcacattttggctattatgaatattgttgcaataaacataggagcacagatgtcttttcaatatattgatttcctttctttaaaatgtatacccactaatgaaattgctggatcgtgtggtagtcttattttcagttttttgagaaccctccaaactgttctgaagtagtggttgtactaatttacattttcaccaacagtgcataaggattcctctttctccacatcctcaacagcatttgttattgcctgtctttcatatataagccattttaactggggtgagatatctcattgtagttttgatttgcatttctgtgatgattagtgatattgagcaatttttcatatacctgttgaccatacgtatgtcttcttttgagaaatgtctgttcaaatcttctgcccatttttaagtcagattttttattgttattgagttgtttgagtgtcctgtatattctgttcagtaattctttgtcagatgggtcatttgaaaatattttttcccattctgtagattgtctctcactttattttttctcttgtggtgcagaagctttttagtttgatgtaataacatttgtctatttttgctttggctgtgcttttgacgtcttacagaaaacatcttagcccagactaatgtcccagagcatttccccagtgtcttcttccagcagtttcatagtttcaggctttcgatttaagtgtttaatccattttgattttatttttgtgtatggtgagggatagggctctagtttcattcttctgcatatggatcttcagttttcccagcaacatttattgaagagactgccctttctccaaagttgccacctttgttgaatgtgagttggctgttaatgagagaattgatttctgggttctctattctgctccattggtctatgtgtctgttttgttgttgttgttgttgttgttgctgttgtttcctcccacaggataatttcctggagattcttccaagtagttttattttttcagttgttcattccttttcatttctgagtgatatcctatggtatagatgtagcacatttaaaaaattcaacctttgaaaacatctaggttgcttccggtttttgattattctaagtaaagatgtatgaatatttgtatatagattttttggaagcatacatttccatttatttggataaatgctaaaaagtgcaatgaatggattatattttaatagtattttagtcttttaagaagcaaccaaattgctctctagagtgattgtccaattttacacttgcaccaacaatgtaggaatgactgtttctccacatctctgccagcatttagttttgttgctttattgaaccactttaatgggtatgtagtgacatgtccctgtggccttgatttgcatattataatgacattgagcctctttttatgtacttatttgccatcagtgtatcttcttcggtgaagtgtctgtttatgtcttttgcccattttgaaattgatttgttagattttatactgttgagatatacatatatctcaaattcctttttctcaacacacgagtttttgtgctgttttatttccttacctcttgtaataattaaaaatgtttattatttaatattctctctattcaattttcatatattcgtgtttttgttatcatttaagttatcgcctaagcattatcatagagccatacatgtataactattacagtttaacacaatttatatcaatttcagaaaatgttagaactttaagaccccttaattcctttgttttttcttatctttgggcatatttttgatatacttaaaatcgtatgttagatatttcaaaatttattattgctttcatataactattcaaacatattctatttttaatctttcttctcatttctttcttttggttctattttccttctaccttaagagctctgttaatatttctattaagagaatgtatattttttaaaagcgtacatttatttactttttgatttaaaaaaatgcagttacattatttgaagacatttagctagagaaatttctgacaagaaaggaattgtctgaatgggtccagatgactccttacattttcatttttatggcattcagcacatcaacagcttcatcagctgaattaattacactcaatacacatgacagcaataagcatttacaaacatagcactattcagaatggatttcatagagattcacattcaagagctaatttattgtttactcattcactcaaccaatattgacttaatatctgtaagtgggagacattatgtttgattctttctctgtaaaagctcacagactagtagtagtagattcagtgagggagtggggggcaagaaaagataaataagtgatttataatagattcatggatgaataatacactattgcatatatatatgtatatatgaatgtaatatatgtatactacactttctttagccatttatccactgatggacagttaggttgatttcatattttgactattatgtatagtgctgcccatgattacaaataaagaaaattatttagcttggctcaaatgtaggatattatttcttggttgctttttttccatagcccataattttaacttcagtgatataatacctgtcatatataattgcaaccaagttgtgttacagtcatgtactattgtgcatatataaattaaaacatcatgatatttttatcagtaataatacagtttatatttatcataatgtaatgaccctgattcagatataaatatctgctttaaattttgaagtatgttataatattgcagtgtcaagggcattagaataagagataaagattgttaaaattggctggtcttttaatctcttcaagctttatttttcttatatgcaaaatgagcatataaatatatgcacctgtcactttatataatattatatacatgttatataaatatatatatatatatttgaatttgagaagtataattttgaggagtactctcagtgtttagcatactttatggctgaaagtactcaataaatatttataaaatgaattttaataaaaaaattcatgtcttagttttttctttaggtagaattatcatctactgcatgctttttaaacactatgaaaatcgataatattgaaagtaggcttttggactttaaaaattctcaaatgacagtagaatttctagttttctcccagagtgcacacacttgtttaccttgagatgaagacgtttcagatggtgacaggtttggcactggtggatgaaatttagtatctaaacagtaggcaagtttagtggttatgagaattgtgcttttaacaacacaacaatcttagcaaatgggtctctaacaataaagcgaaatatgaatctgacttatagtaaatacttaattcatggttgttcattgaaggagggaaacctacaggaatgtatattttgggggatctgaggaggaagcacaatcagcgaatgtgtgaagcagaaaaaagtaggtaggaagaaaaagaaaaaatactatcacgtaaggatgtcatagaagttatttcaatcagggttttaaggagaagaaagagtagattgtatcaactacagaaaataaatactgaaagaactgaggagcagtgattaatttggggatgactttggatagaataattgtagaagcaaattgataaaaaaaagtttgtaagaagaaacatattgacagtagagaaaggagcacaatatgtaagagtatattcataaaatgtgatgagggggaaaggggaatataaaatttaagcatatcatgatgttggttactaattgagaaggaagacttttttattattattattatactttaagttttagggtacacgtgcacaacgtgcaggtttgttacacatgtatacatgtgccgtgttggtgtgctgcacccatcaactcgtcatttagcattaggtatatctcctaatgctctccctcccccctccccctaccccacgacagtccccagtgtgtgatgttccctttcctgtgtaaatgtgttctcattgttcagttcccatgtatgagtgagaacatgcggtgtttggatttttgtccttgtggtagtttgctgagaatgatggtttccatcttcatccatgtccctacaaaggacatgaactcatcattttttatggctgcatagtattccatgatgtatatgtgctacattttcttaatccagtctatcattgttggacatttgggttggttccaaatctcactctgccacccaggctggagtgcagtggtgcaatctcggctcactgcaacctctgcctcctgagttcaaacaattttcctgtctcagcctccagagtagctgagattacaggtgcccacaaccatgcctggctaatttttgtgttttttagtagagatggggttttgccatgttggccaggctggtctcgaactcatgatctcaagtgatccacctgcttaggtatcccaaagttctgggattacaggcatgagccaccatgcccggcagagaaggaagactcaatggcaaaagtgctcataaacagaaacagcacccacgtctgatgcggcagctgcccctgcagtttcatcatcctgatgttacatgtggttctcaaaagtggatacagaggttgaattgattgcattccacttcacagattggtcaggaggtccacaaggactggtctctgtgtaactcaggagcaataaataatttttagaaaacatcaactaaataccattaagaccctctccataaggcatgcaagtattccttcgtctggcataaacctcttcacttgttcttacacaattatgtaggggattaaaaaagaaactgccacaatccccttaaaatatatgaatctctttggaaaagtccactcttcctttgaacaattctagatgaattttgtatagttctttcaatctagggcaaattatcttgccaaagagtcgctctttgtttcatttctccagtttattataacacacttatttaatgatatgaatttattaattaatattaattttaattttgccatagccagaggaggacagtattccagggtgcttgaatatctctggaaaactgaacaataaaaataaaaagaaataacccttgaagaagtatatgtattctggtaggcttcagtcacagaataaaaaattacatttgatcaaatgatcgaatatatattttcaaagaccataaattttaaccaaatataggttaaaggtgtataatgtagtgcttctactgatgtcatgagatattcaaaatttgcatgacaatgctttctgcttcaaatgccttcgagatggcaggattcaggaataaaaggacagagaaattatggaagagctgttatgtgactaggattagccaggaagagataaataaaatgatgtccaggtaagcatctgcatatgtaatacctgctcctgtgagggtagaaaggtaacaaagtagacaagagcaactaaggaccttggggtcccagagatcaattgtactggtgcttctttgcacaatttattacttttgccagggaatcctgctatgccaggaagaaaagggtattcatttagttaaactggatttattgagggctgggaagtagtaagattggagtgactggaggtcacagtgacaggaaattctaaaatgaaaaataaccacgtaatttgtgtggatgaacaggaagctcagtctaggcaatgcagctagatcctggatagatatatgaactagggtaattggaagggctaagaaagatcagaaaaataataaggtaatttggtggtgatggaaaggaagagggtgtagttaaagaacagaaatgtgagaattcaagtctgacagtggagctgtcttggataacatcagatctcaagttagcaaaagcaggagattgctaaagtaaagtggagatggacttgtttgtttttgtttcttacttacagattaaagattccgagcactgtgctaatgctatgagaggtataaaatagcatatatggcttttccttcaaggagctagcagcttggtaagatcgaacagtatttagcgctacacaaacatgtttaataccacagagaacaagtgttgcaataaaggaatcaggaagtcgaggggcactaaagtggaagagattcattccaaatacatgggttaaagaaaatctcatggaatagatggcacctgagttaacttcttaacatttgaaatggattttgacaggtagaaataatacaactggtatttttaacggattcttcagttgttaagaagtccagtcgatagtcttcaaaatacagcctgaggtgtgcagaatatgtgttgccttcttcatttcacgaccagaggaactgcgggtcagagagtttcacggtgttaactgacttgcaaggacctcagagatattgaaggagcatagatgggcatctcagacaaaggagtactggggagaaagacgctgttgcaaaaagtgcaggacttctttagggaatgacaagttatgtggtttcaattcatgaaacaactggtgaatttaagatctggaaaataagtcacaaaaaataacttgaaaaagctcctgatgtatctaaacagcttaggttttgtgcctgaaaaattaaaagagatgacatggcagtgaaccaaggtagtgcacacagggaagaaacagctcaggcctgctatgtgtggattacactcaacaagacagagtaaaatgcaacagtcacaaacccaaggggcctcttcttatttctttctttccttcaataacatccccctaccaattaagtgataatgaaatcaagtaaatgagtcaatgttctgtcctcacacacagggccactctgtgagactgatttttctcattgttcattttgtgtactttattctctcttttttccatatccttcaccccacagagagatatttctaaaatataaacatgatccttttcctccaatgcttcaatgtctccactggctcccctgactctcaggatcagagagaaaaattgcagcaagatatgtgagttatcactgattacaccttgtccgatcaccaacttcatggattgcctcttcttcagatccacacacaatgtgccagacaacccacatttctttggatatactatgtttttcatgccttggacatttgcttttggattaattatctcctctctaaaaattttgctttcccttacctgccccaaccaagccgttccactgtttagcccaatagggtggagtagctttgattctactcacttcttcttaattcattttaaaaagcagttattgaatcacatcgtttctaatgactttaagggggaaattatacatagaacttcagccatatgtgaaagtaccgggatccaccaattactcatcaaatccttattaaatctgtaaattgttctcatttttaggggaaattgaggcacaactaagtgaactaagttgcttcatcttcactctcactaatataagtttatttcagtttcatatcatctcaagttttaccagtgacagtcttttcctcactggtctaataggaccacccaagccacacaaatctagccactctggccctctatatggaggtgagcagtggttccttgcagactttaagcccacctcattctgagcctgcctgtttttccatggggagcttccagaactcatgctcattccagtcactccaaacttttacattttagtctctgcagctcttgctccttgtgcatgaaagtacatgccctcatgtggggtaaaatcaacaatgaatcaaaacaggaatcactaactatattaattagaaatgatatatatttatttgattgcttatgttaggttgaaaattattcatgaatttgtatagtgagcagtatatttttcattcaaggaagactaaatttgtattttaaatgaataaacctactttgagattgagcaacatttaaaaatactttttactgccagagcagttaccaagaatctttagaaagctgtataagtgcagagtggaaaaacaagcctgaacaaaaaacttcagactaactcttcagtgatgtaattttttttagtgtgtgtgtatatatatatatatgacacataattttgtctgagtatccataaggttaccgttaatgctgtaaaagtttaatgtctcacaatgctaaattaatgggtaatggagtctattgatttcataataaatattaactatttttgtttatcttgagttaaaaaattacattttctaaaagctacaaataaaaacaaaagcacttcagtttttccctagtgcttgatgagacaataattctatgtggggacattttcttttaacactgaaatattacaatcaagagcatattgatggattattcaagggaatattatacatagaacttcatccaggtattaaagtatttagatccaccaattattcagaaaatacttgttaaatctgtatggtaaattgttctcactttagatgaaattgaggcccaactaagtgagctaatttactaataaccttctttacttagtaatggaggccccagataactgtaatttttatgatcaacttatactataagaggtcatatgtaataaaaaaactgttcaagtatttcacttatgttcataaaagagtttccatatttgaaaagttgaaacagaatgtaaaaagtgatatgtattaacttataagcctagtttcataaaagatcagcccctcagaattattctatgtaggcactatgtaacatctataattacatagattgaagatttgatctaagtgtattgacttttattagctaaaaaatctagctgctatttaaagcagagaagacaaatatgatcaagatatgctttaatttatggtacatgaagcaatggttataaccagagagcagaaagaaatatgtattactaaactccaattatttctcattttctatggatggttaaacttctgtctgaatactttaaacatcatacttgccattatacatcagaattaaagctaaaaatatcatgtgaaattataacattcttttcattcaatgtgtatgctgtcacaaattcaaactaactttctttcaaaaagatggacaatagttatacttctgaaattcttttagtatattttcaaaagaaaacaaaagagcatatctaagcacatcccttttttcattataaaatgctgtgtccaagatatgagaaccagtttctctaaaaatattaataatttgaaccctcagagtcgtggatgcccaaggccttaccatgtgcccagttctgagacaggaaggcagagtggcgtagacctaccagtagacctgagccagacatgctctatggggttttctttgtttggggaataaactctgttttatatccaaaaatgtctagtagaagagccaggaaaggtgtttggagaaaacatataaatttacacattttacatagcattttgaatactgaattgcaaaagttttctgttactgtcaaaattgactggaattgaaatatagtttgtgtattgtgttgcacaatgaagtaattcttaagcctgagactttggctagtttccatccattttgggattttatctattcctgtccattaagtttatatctaaacattgcaatatctggaagtaaggaagtcattgaagctatatgaaacacttttaaattcaatagcacttttgtgaacaattttaaaaggcatcatttaattgtctatgacaacaaaaacaaaagtcaataaaatactgtcagaatgcttagactgatcatagcattttaagaaaaagtttaatgttaatgaaattggcaacatccatgcaaatggagagcatgatcatttacacctggaaagaaggtatgaacctcttgttccaaatcatctttgggaagatgaacagactgagaatgagggtggagaacaatggacaaagtgctgccactcatgttatcatctagtgactttttaatatcacgcttaatattttattgcctgtttttacgatctttctaagtcagaaaatgcattgacaaatgttaagaggagacaatggtagccaaaataataagtaaactacgcataatgttatagcaaactgggaaaagaatgcatctaaaatttcttagattctcttttatctacatgttgtatgttttagaagtcaaagtttctccatagttacctgaatctaaagatgcttcctacgaaattgaaattgtatgtcatttgggtctatcttcagtgtttcatttaaaacagagatgcttataaagtcaggtaaccaaatatgaatttggaggctgatatttatattgtatgaaagataagcttttcaacagatactattacgagctgcaaatagatcaatgacatgaggttttgatctgatttgttctgaacatctgcaggcagaatgcctttcaagtcattgctgtggatggggtctgcactgggattattcagtgcctctctgctgaagactgcgttgactggctacaagcaatagcaactaacatttcaaatctcacaaagcacaatgtaagtaatgattcaaggaatacctagccagggtttctcaggctttataaaatccttcagtatatatgtaacttcacatcaactgtttggtgttcttctcagaatgagacattcatgaaagctattctggaatacttattgtaagaaaactgagagttctggcccaatttatgagttcaataatacacatagatttccattaacaagcattataaacccctacattacttaagcaaatgaaaataactagttagcatataatccctaaatatatttaagtaaaagcattcgggaataatatagtactgggtttcaagacagcattattgatttacctttagtgatcttagaattgcagctaggaaggtttgaggagtagtaggctaggaggaaaggagttagcatagagactgaagggaacagtcagaagattgccattgtctcacattagatagagcctggtctgtattattagaaatggcttctctgcattttctctctttccactacaaccgttgcttccttccacattcctgtgtctctttattgtagctatcttctcattattttaactctttaataacctaaataattctttcccccgttattaataattctatgagaaatatagtctaacaaaatatacaaaaccacaaacctcaccttactgagtatcaatctaggtatcattaatgataattattttagaaaaagtacttgtcatcatccatgcctttgtgttaattctctcctcagtccgcaattgttccatgcgatgttgaggcatttcagaagtcctaagggagatcaggagtctaatatacaaatgatcaagcagaaatatataactctgtcaccagcacgtgaacacacaaaattgttcttatgtaaatgacccttcagatccaagtatccttgcacagagtagactttgctttgaaacctaagaaaggattgtggccactatacctttctaaaacgacaggaggaccactagccaataaaggcaactgtctagtttccagtctatggctatttcaaacaacgccatcataatagccatgcatatggtgatgggatcctctgggaatggggttgacagtcatgggatatgtgcatggtcaattttaccaggcaatgctaagtgttttccaattggctgtgcaatttacccctcactcttggtggatgatatgtttctttctataatcttcaaaactctgtgtcacgctgccttttgaatttttggttgatacatgtggaaatgtgcttccagtgtgaataaaaacagattttccttttttttttttttctggtggttccaggataggtgtaaatacaccaagccttacccaggctcatccctcaacaaggaggctaaacatgggtatgtctagtttgggcaagagtgagctctcactcccaacccacccttgctaatctggtgttgtcaccatattagagttgaggttgcacaagagggcataggtttcagaatgactgaaaaacaaagaaaaaaatagaaaagaaatgcaatgtttctctagggattgtttcctctccttcgactgacttatatggatgcttctagagttaaacacagaaaaatacctgagagtagggaatttgttacagaaatgattagagtttcttaaaaacaagatatgaacttatatttgtgagacaaatataattgtgttcttttgaaagaacagaatgttaaactttgaatccaaagttttttttccttatctagatccaaatttgcattgacctaaaatcctaggaatattgtcatgccatatttcttcaaacgtctattcagttagaatgctgtgcttcagctgacaagcatttgaaaagtcaatgctttagttaaaagcaacagcaacaacaaaacagtgaagatgcaaatgtctctaccctctgtaagcctaaggagggacaagccgcattttactgcttgtttttcatccttgtaataagtgctcaccgtcatatgattcccctatactactgttttaactgtttggagatccatatgtctgttgcatattaaaagttatgtatttcttctttcacctcctgtttctatattctaattacatgttcttttgttcttgcaatcagtttccattcaaaagtattaggttccaatgtattctgatatggaaagtactacataaatgttgaaaagttattaggcatagcaataaaaaatgtgaaagtcacattgatttcagagaaggcagaatgcattgatgaaacaattaatatggttaattagcataaagaaagaaattaggcagaaagagtagctaggaaagttttgcttaggttagttagatatcagttctacttctcttattttttaattctaaagatatactggaaataacaccttatggaaagatgtagacctttttctttatttgccaatattctgagagtataggcttgtataagtctgacttgaatagcttgttaataataggtgcagaaataaaaacattgtgataaatatttaaagaaattccactcaagagattatcaggcataaaataaaactgaaaaaaggattaaaatgcatataaaataataagtttgacagtttaaaaattatgctattgaaataagacatacatatgtatataaactttttaatgatgaatcacattttattgtaaagctagttggagaacagacaggggaaggataaaagcaaaaacaaaaaacgaaaaacaacctgtgttagaataattagatcaatgtgttgatcattttcttttctctttgctcactagtttctaaaagtaactttgtgagacagggattttcatacccagtttttaaaaattctatataattatagttgctataatttttcttccagaaataattgatcataatggctaaaaatacctaggcaaacactgacaatgtaaaattgtattttatcattattcagagtggctccaaaatatttacaatagttgttaatatttaatacttagtaaatgatgtctactagaatgagggtgaaggctttagggacttgtcttaagctgtattggcacagctttcaactcattttatttaaattctatgctttcacattggaaagcaaagcatggcagaggctatgctgttgtggggtgggtggggttcagctcatttcttaaccaactctcacataatgagcatttgctatattttaggtgagcattcactcccagtgaactattattttaggtaaagtggacttgagtagattctaaaaggtagaatttataaattgtaaaaaacagtaattgcttccaattaataatttaccaattttttattcattatttcaccagctatatgaacaagtattagtagaaagttatcaatttttatttccatgatcatttcttattaaataattgaagactttaaaatatgcaatgttgtaatagggtgaagtttttgggaaccttggaaataagtaaatatatttggcataatatataagggatatgaatcatcagactttgatgggtaggttagtaagatgcacctccgtgatgttcacttcctggcatttacacccttatgggatcaccttccatgtgcgttggctccatagtgagctctgaagcagacacttctcttacaagacttcagatgagatagcagatgacccttgagagcatttttagaaatccagtacattctaacccacactaatcacatgctgaggactcagcacatgtcagtcacatgctgagggctggctcaacacacaaagatgtcccaaccagaggcccatgccagctctcccctaccctgcaccccatctcacaccactcagacaggcacaggctgtacagacaagttatttacttcttattataaccttgggccctttctgccctggaaagtgggggtgggcaaggaggctgggcccagcatgcacccccacttctttaggggctgatccctcctacagtatcaggcgggtggtggcaggggtagaggttggagagtaggggagaaaaccaaaaaaaaaaaaaaaaacaggatgaagacccagctatgccacatgtggactcctgacatacagagattataggataataaatatttagttaaagtcacaaagttttggggtattctgttacacagcaatagggaactgtattagtttcctaaaattccaaaatttcctaaaacaatttcaaagcaaattacacaaacttggtgccttcaaacaacagaaattcattttctcacaattctgtggcccatttgtctgaaatcagatgccagcaggatacatccctctggactctgtaatgcagaagccttgtctcttccagcctctggtggctgccagcattccctggctcacagccacatcacactgacctccgcttctgtggttacattgcttctttctgtgtgtgtcacttatcagaacacttgtcattggtcccagggcccactcaggtattccagtctgacctcaagatctttaactgaagtagatctgcaaggaccctttatctggttccaggttttccatgtggatattttgggaggagcatttttggcctaccacaagaactatctggcaggtgaacaacatgattagatttagacagttctgtctgatttttgtgcaatgtctcctatagcagttcagtttcaaagcctttgctttgtcatttgggtgttccacacgtgcattgcttggggtgggcccagagcttcttgcagttcacacataaaatcgggatatcgcctccttcccttcactcctaagtgggagttccccactcttactggatcgcagcatcactctctttggtcttctctccagaaatccaaggctcttctcagagtttagtttcctgtactgatgcacatttcctcatgactggagaaaacagcatgagaaaaggagagaagagtggggatccctcatgccacaaaaactaatttttccagaacctttagatagagggtggattttctctctgagtttccagctggcccggctgccccaggctccatggcagcagctgcatggccaggggggccttggagtcagctcaggaaccaaaacaaaggaacagtaacagagatgtcttccacagctgttggctcgcagaggcctcttcccaggtctctgatcagcaagacatgctctctcagagtttttgtttgttgtccatgacttaatttgtcttgacctcaagtccatgctgggagataaaggaagcaagaaaaagaaaggaaaacaaaataaaaacaggtaaactcctgtttgccatattaatcattattcaatttttacttctttcaaaaaagttcttgctattatttattgtacaatgttctcagatagttagttgccttttgcattttatctagtgcattgaggtataaccggtgggaaagatggctgcagtgttttttttttccttcttggctctaactggaagcaatagatacttttaatagaaaacaaaatataagaaacaaaacaactacatgatatttgtagagtatcagaaaaaaataactgctattataccttggaaatattttttaaaagtcctgataaaataaatttattttcagacaaatagaaaaataaagaaaattcaacaaaataaagatttactaaaagaaatattcagggtacttttaaattttttgtattttttatttattcaacaaatatttattgaatacttgcctatgatgtgtcagatactgtgttctatttttttgtttgttttgttttcaacttttattttagaaacaggaagtacatgtgtaggtttgttacaaaggtgtattttgtgatgctgaggtttagagtataattgaaaccatcaaccaggtggtgagcaaagtaaggggtgctatttcaggcaaagaaaaatcatgccagatagaggcttggagatgtcagaaggagtaaatagtacaggagaaaatgaatacatagatgaatctagatgaacattgtttgtattaaaatgggaataatttcttgtagtgtttagataaataaacaaaattaaaatatattgcaaaagcaataacaaaaatatccaaaggaagcaaatgtaattagtattaaattttgttatgtcaaaatggattgtttgtttcctagagaaagccttaactaagtagccagaatgtgtatcttctaaattaacaaaggaataagtgaaaaaataatgctaatacctactaaaagaagttcataaaaaaataaaaaaagaaagcaaactagagcaggttgaacaaatagtaagcatacagtaagatgatgatttatatccaagtataagatacactttttacaagaggaattctaaagatattggaagattgaaagtcaaaatttagaaaaataccttgcacctgaaaaaataagaacttggaaaggattccctatttaataaatggttctgggagaactggctaaccatttctggaaattgaaactggaccacttccttaccctttatacaaaaattaactcaagatggattaaagacctaaacgtaaaacccaaactaaaaaaccctaaaagaaaatctaggcaatacctttcagtacatagccatggacaaagatttcatgacaaaaacgcaagaagcaattgcaacaaaagcaaaaattgacaaatgcaatctaattaaactaaagagtttctgcacagcaaaagaaattatcctcagagtgaacagacaacctacagaatgggagaaattttttgccatctatccatctgacaaaggcctaatatctggcgtctacaagtaacttaaacacatttacaagaacaaaaatacgttaaaaagtgggcaaaggacatgaacagacacttcacaaaataagacactcatgcagccaaaaaacatattaaaaaaaccctcaacatcactggtcattagagaaatgcaaatcaaaaccacagtgaggtaccatctcaggccagtcagaatggtgattattaaaaagtcaagaagcaacaaatgctggcaaggttgcacagaaaaaggaatgcatctatactgttgtgggaatataaattagttcaaccattgtggaagagagtgtggtgattccttaaacatctagaaacagaaataccatttgacccagcaatcccattactgggtatgaacccaaaggaatataaatcattctattataaagacacatgcacgtgtatgctcattgcagcactattcacgatagcaaggacattgaatcaacccaaatgtccataaatagtagattgaataaagaaaacttggtacatatacaccatggaatgctatacagtcatagaaaggaacaagatcatgtcctttgcagggacatggatggagctggaagctgttatcctctgcaaactaacacaggaacagaaaatcagacgccacgtcttcttacttataagcaggaactgaatgacaagaacacgtggacacatcgggggaacaacacacactgtggctggttgttgttggaggggagggagagcatcaagaagaacagctaatgggtgtggggctcaatacctgtatgaggggtttatctgggcagcaaaccaccatggcacatgtttatctgtgtaacaaacctgcacatcctacacatgttccccagaacttaaaataaaatttgataaaataaagaaggaaaacaaataaataaataaattgacataattagaatatttctctaagtgtttaataactaaatggatttgaagcttttagactgacattatgacattttaagtaatgcttccatgtaactgaatgatttggtttgttctgtgtccgcatccaaatctcatcacaaattgtaatccccatgtgtcagaggagggacctggtgtgaggtgattggatcatgggagtggtttcccccatgctgttctcatgatagtgagtgagttctcatgaaagctgatggttttaaaagtgtgtggcagttccccctttgctgtctctctcctgctgccttgtgaagaaggtgcttgcttctcctttgcttccaccatgattgtaagtttcctgaggcctccccagccatgaggaactatgagtcaattaaacctctttccttcataaattactgagtgtcaggtatttctttatagcagtgtgaaaacagactaaaacagttaatttacaaattaaataaatatgtattttaaaaaccagaaaaaaggaaaaaatacagtgcaaaccataaaagaaaggtttgtagctttgttaatactaggcaaagcaaacttcacagcaaatatattactaaatatagatatggtcacttcataataataaaaaagtttaatgcactaggaaacaaatgcaaacatcatgtcacatgggcttaaatatatctagatggaattgaaaatatagactgatgagaaagtaaaaatcatgaaatctcagaactagagacacaaaatggttaaggcctggctatgaggaaactgaaagtaaaataatagattacggaatcagaagaagaaaataaaattcatgctcagcctttattttaacctatagggctagtcattatcacattattccatcatacacaagcgacatttcccattgaactattcattcagtactaggtgtctagaatgtctccccagcctgagctggacattagaactcactttaattatctgtcttctataacctttcagctttcctcactgtcattccttagggtcaaaatagtcctgtgaagattctcgccatccaaaatccatcttatatatgtccttacccaaaaaagataactgttcatacattttaaagactcctaaaattttctgatttataagttacaatgtgtaactggaaagcaatttgaaaaatgttattttgtcaataattcaaaactgacattttatcttggtttcatcttataagatttaactctacccatctgtggtaggaagaataatgcccacgcaaagatgtctatgtcctaactcccagaacctgtgacaattccatgtcatatggcaatagagaattaaggttacagataccattaacattgctaatcagctggccttaaaatggggaaattagcctagattatccaagtgggtctaatgtgattctctacaagtgtaagaagtcaaagtgagagaacaagagacagcagtgaaagaggaactgaacccagtatttctggctctgaagatggagaagggaatgcaattcaaagaaagcagtagtccaatagcagtgaaaggctgcacttctactctagagcctccagaaagcagcacagccctgccaacacctcaatttctcccctgtttgattcatttaggacttatgacctacagaacagtatgataatatataaatgtgtgggtttttcttaaaccaccttagtttgtaggaatttgatatgacaacaatagaaactaatacaacatatctttatccagttgcatgttttcacttaatgtaaagttcacagtttaatttgaaaatcatgcctttaactcatgtcatatgtagctttttcagaataaccataaaatgtacttgcatatgttagaaaacaacctaacatttacgttattaattagtcccagtgcaaatcagcctatagtaataccactagagttcctaaatacttaatttataaccaactgacatcatcagagaaacaatgatcagaatcgttgcattcacgcagtctgagcaaggactgtctttggaactgggaagcagtgttggctctcagtgcctggataaacatggctagaagctttcaaatatcacaggaaaccaggagggagaagccacacaagacgagaataaggaactgctgtccctgaagagcagacaagactgttgaattgtcaggcagtcacaactgagaaagacggcaactgatccctgagagtgtctgtgaagatggggcctagtgctggctggctcagatcacacagcaactactgcctgtatccttgtatttccagtacttaacacagcccatatggagcaaataagaagtgaatgaatgagtcccttatcaatcaacagttgtttgaaggaaacattgctgagaatgtaaagaaaaatgaagacagaagagagaaaaacacatttagctacagtaagcactgcaataagagattcacatgtactactccttaaattcttacatgttccgtggggccactgtgctttagagtagggaaaagttgctgtggtcatgaggaaacagaggtgctgtccatggtagatgttccctgtgtttctgggtgtagttccttttgtccatcataaatctctgtctctcataatgaaatgtctgatagacaaattttttttaaataaattttgtttctataactcactgagtcactttctaagtggcaagtacagaaaaatacagtgtagcagagcaattggaaataagtggactttaaagcacatatctagttgcaaatcaagacaaatagttttgaacaggtaccatgtacaacaacttggagtctcctaagaatacattgacttgtggtttcctaaaaccttcttactggaaggtatcaggagattatctagccccatttcctgcccaattagaaatctctcctgaaaagattctttcagacagctctctcctggaaatctttcaatgacatagaaagccattgcttcacaatatagcaattaaattttttgacaacttaatattaggaaatacttttactgaataaaaatctctctcattacattcatccatttgtactagttctgatttgagaaagacacacaataatccaactttctttttcaaagacacacaataattcaactttctcttcctccagcatacaaatacaagtgtcacatgttgcagtccgttttttttttttaaaatagaaatatcactgactcctttctgtttctctctgacatgtcatccaagactttccttgtcctggtcgctgtctctggatgtagaagccctttagaataagtagagtgataatataattaactttgtattattgtaattgtcatgagctcaaatatttttgagattcattatagtttgatgtatatttactgattttgtacaataatatataaacatatatagaaaacaacaaccttacattttattataatgatcaatgaaggatcatattttcacattacctgatattgcacctcatggtggcaatagtaaataaaattcaaagtttgaatagttattttgcatttaaactcatgtatgggccagaaagcccaattcttgtgctggctgcacgaattactaaatactcaaagggatgaaagcccctccctcccatactcaagtatttacatgaaaatctagcttctcagttttttacttttcaaagactgagattttagtgttgttgccttctttcttagcttacaatgatatttaagatgtttaacagaagtgttaaatatcatagtctataagtttttttaaagattaataattcattaaacactaacagaaggctagtttttgccttatatctttgaaaataatgccatacaatgaggacttcaaatgcaatattgtggatgttacaatctccaataaaaatatgctattattaaaaatgtcctttctttcttaattttgtttattaatgtgtatagcaatcttcttccagcgttaagaagggaaagtggaaaatatacaactttggagtggacaaacctaacaaacgctactgcagctgggtggttaacgtcaactgtgatgtcaaattaataatatgtacccttgatatgatgtaacaaaaatggccctttgcctctgtgattttcgtccccaaatccataatcctagtctcatcatggaaagatagtggacaatcccaactgatgaacattctacaaaatacctgaccagcactcctcaagactgacaatgtcttcaaaaataaggaaaaattaaactgttataacctagagatgcctaaggggacctgttgaataaatgtgcatcagtccagttgggatccaggaacagcaaaaaaaaaatgtttggtaaaacctgtggaaatctgaaaagagtatggactttcgttaatattagtgtattcatatcattgtattattaatcataataaatgtgtcattgttatgaaatgtaaaatgccaataataggggagactagctgtgtggtatatggcaactctgttctataactgtatgttttttgtaaatccaaaactgtcctaatattaaaaagtttacttaaatatattcatatatatgtataattaagttaaccccaggtattaacaaacttgtgagatgcttatcagcttcctgatgtattcatccatgtattaattcagcaaacattttgtgagagcttactgtgtcaagttgttagggagcaggactgtaatattgagcaaaaaatggttagtctctgccttcgtggagccaagagtctagttgggaagggagacactaatcaaattagcacataagcaaatgtgaaattacaacattcatagataatatgaataagtgctatgagaggttgattctgtagctatccaggagtatgaggacaatttcctaaagtttatatataaacaatgagtaagaataaaataagagaattggtgggaaaatatattttacgcagaggtaataaaaggtacctattcaggaaaaaaagtaaagagatacaatcatagcaatggatattatttttttacggaaattttcacttgtctagggtaaaatgaaaatgtttaatataagtgaatttttcataagactcaatttattttttaaggataggtctttaattttatatattgtcttcttacatttatggagttaaatgtccatcctcttatcaaatgatggtaatcatagaaaaattttgttttgtctggtatccttgcttaataaaagaaaaggctatttaatcaatgtcattactgttgaaaggtttaatactccaacaaatacactcctcaaaatcattgacccagaatctttacagatagggcaaatctgcatatagtcccaaaacaaccggaaactttgagattaaaaccaggtcactgaatcctgaggctggaagaaaatgatgatgttatcagcagaatactaaccatgacaaatgggtcaaattttggaaaatcacagaaaccatttccacaagtctctagaagtctggtcttttataagtctacaacgtttgtgatattaattgaccaagtaataaaactatcacacacacacacacttgaaatatagtaggaaaaacaaatatttatcaaaatttaggcagcataaaagacagaggtctgtatgactgagttgggaagcattacaagcaaccagtattaaaaggtatttggatatgctggatctgaaaagaggaggaagtataacctcaaaactctccattgtttaatcaatcaagggagcaaagtctactgttttgttttgttttgtttttcagaagtctttttgtgttgtggaaaatgcatgagtttgatgttatcaaacttgggaacttgggtacaaaatcctagcttctctagttactagttatgtgtacttgacttcaatttgctccttagaaacagaaactaggtaactttaagttactgtgagcattcaatctaaaaagtgctttaaacattctgtcccttatatgatgctgaaacatttgcaatttttcttctttccagttgaattctaaattaaatgatgtaatccataaaccatcaataaatggcagcctctatttgtttattgtataagagtttacacatctttgttgatggaataatagtctttgggattctcaagaatcattatttgggtaatagaatgttgatgaaactggacaaaattagttgaaataaaattgtggcatcttaagcagctatgatctttgccaagtgatacatctgtactgcagtttcctcctctgtaaaagagacagagaggaggcaggtaaaatgctaacctccctttcagctagcacttcatgaatcaatccttcccaattatgctttcctactggaatactgaaattaataccaatctgtaaatagagataattttacatgacatttctattaaggttacttacagatgtaaaggaatctcctctttgattctgattcttccctatataccctatatgtgttgtttatttagatatattttgttactttgaaacatatgtgtatgtgtataaatgtatatgtatctatatagaaatatacatatacatacacatatgtatatgagatattattctagccttaaaacaagagaaactctatgtatcggtggagtaaactgttgtttttccccacctgacaagaattctagatggtagcatttgctaactatatttcagtgtgatggtcaaattaataatatgtacaagaaccaatttcctttattttttaaattaatgttttaaatggataatgaactcattacaattgtacattttaatggggtacattgtgatgtgccaattcatgtaaagattgtataatgatcaaatctaggcattttttacagtcattacattaaacatttgtcatttctttgttttaataacattcaaaatcttctattttagctacattgagatacactttacattgttatttgctctagtcaccctactatataatagagcaccatatcattcttccttcctgtatctctgtattcattggtcaacctctcccaattctccccttctctttcccttccccaggttctggtaaccaataaccaatattctactctctacttctgtgaaaacaactgttttagattctacatatgaatgagctcatgcaatgtctgtctttctatgcctggcttatttcacttaatacattgtccttcaggttcatccatgttgcagcaaatgtcaggatttcattatttttaatggctgaatagtattccattgtccatgtttgtgtgtgtgtgtgtgtgtgtgtgtgctatctatttatccatctatctatctaccattgtgaatagtgctgcaataaacatgggagtacagatatctcttggataaactgattgtcctttggatatatactcagtaatggaattgttgagtcatatggtagttctgtttttactttttgaggaacctccctacagtttttcacagtggctgtacactcccaccactggtgtgtgagggttctcctttctccacatcctcgccagcctctgttattgcttgtctttttgataaaagctgttttaactggggtgagattatatctcattgtggttttattttatatttctctgatgattagtaatggtgacaatttcttcatatacctcttggccattcatatttcttctcttaagaaatatctatttaggtcttttgcccattttttaatctgatttttttagttgagttatgttccttgaatattctgggtattaactccttgacagatgcatagtttgcaaatacatctgtaggttgtttctttactttgttaattgttttctttgctgtgaggaagccttttagttcaaagcaattccattcatcgctccatcttctatctatccacatcatttatttcctatcatctgtagagtattggcttttatcttatggccttcaagtcctggtcatggagggcgacaacagctacaaacatcacttcagtttcaggaaggaaagaaaaggaagagggatgagtagaatcagccacacctgtccccttgtatcaggtaagagaaaatttcccagaaacccttttggtagttcttctcattctgtttaacaaaatccatgacaattctttatggggtcgggtaagacaagtttggccagtacttaactttcctatcctctgtagtgccatatgacacagaagtggtggctgtgaatagcttctggatcagtcagtcagtagtatttaccacattgcttaatacggaagatgtattaattctaaagaaaaagcacggatagccagtccctctgtgggatgaacacagcccttcaggattcacagacacacacacaaataatttaatcagttattagagtgtattctacaggcatttcacccatctttctatattttacacacttacgtgcagaagtgaaaaaaaaaaactgtttggaagctatatatttaatccatagagatctgctgtactaccacttgcaagttaaaaaatcattttttttccataaaagcgttggttttgaaaagcaaaaaaaaaatcaaaaaacaaaaaacaaacaaaaaacaaaaaaaaaaccttctattctgtctgccacattgaaaaggctcaacaaagcttgtaggtgaattgaaaatcatgatggaataaagactaacagaaggaagatttaccaaaaatgaactaaagactgtgattagaggttgtggagtgtggtgctgacaggcatgggtgtcactgaagctgacattttcttccttttttatagccgctgacatttctgagtcctaaagtctactttttagcattagtatgttgctgtctgcttgtctgcattgttattctttatccaccaaaatgtgaatgtcagacaaagaggtgccaaccaaaaatgggttagtgtgagtgaaataaataattgcagagagagtcatttaagtcagaataaaagcaagggcaagtttgggcactgcactgcattcagattcttaacaatcatatttttacattttacataattagagtttatgtcaagaagtatgtcaggaaagtaaaatatttcagtaaaatagcctgctttgtagcttggaacagtactcaccggaacttaatttttttaacaagttttaatattggaaattatcagctgatttttatttaccacaacccaaaacatctgcgttgatttcctctccttcggatatatactcactaatgagattgctggttcatatggtggttctatttttattttattttattttattttattttattttattttattttattttatagatggagtctcgctctgtcacccaggctggattacagtggtgcgatctcggttcaatgcaacctccgcctccagggttcaagcgattctcctgtctcagcctgcggagtagctgggactacaggcgcacaccaccacacccagctaatttttctatttttggcagagacggggtttcaccatattggttaggctggtcttgaactcctaacctcaggtgatccacccaccttggcctcccagcgtgctgggattacagggtgagccaccacgtccagccttattttttattattattattattattattgttgttattattattattattattattattattatttaggtggagtctcgctctgtcaccagactggagtgctgtggcatgatctcggatcactgcagcctctccctcccaggttcaagcgattcttctgcctcaggctcccaaatagctgggactgtgggcatgcaccaccgtgcctgtagaatttttgtattttttagtagagacagggtttcaccacgttggtcaggatggtctcaatctattgaccttgtgatctgcctgcctcagcctcccaaagtgctgggattacaggtgtgagccaccacacctctggctcttatttttaatttttgaagaacctccacacagttttccatagtagttgcacgaatttacactcccaccaccagcgtacaagcgttcccctttctctaccccttcgccagcatctgtcataataaaatggagcagttttcctgaacatagtttccttccctctgcctccaccacccttttgtccaatgagccctgcctgcctgcccccatgcccctctttgctttgcttgtctttctggccagggcagctccagctattagcgtttcagcagccgtggaactatgaccctgcacaggggccaccccatagcataccaacgctgctatctccttcagtgcctagggctggagttagcatggccttcatcacacccaaagagaccgaagctaactccctgggacctgcctcctgtcccgggctcaagagaacacagcaggaatgtggggtaattgatccccaggtgacatactttgtccagtgaaagaccagggcaaagaaacagcctgctgataaatttgctcactcttgctcaatagacgagctgtttggatttgggagtgcagtgatggcacaggccccagagccaaagcacacttaatgaagcagtgcttcactgagaagctgaggccagttcagggatctgagaactcccacttcatatttgttttctgctggcctgccttgctggccttcacctatgaccctaagttccttaggctcaaatatcttccctaatcaattgttaacatgtgagactttgcctcacactctatttctacagaagcaggactaaggaaacaactttcacctctaaatgttcattgcagagtactgaatattccctaggtgattcgctctcacctcctaccaggcataggagtaaagaggtgtaagtgaattgtgttaagcagtagatgaaaggccattagaaaattacaaaagaaatcactttgagtgggcagttgctccactgaacatgttttagaaacccctcattctaaaatggagcttcaaagccaaggacccctgatgagggagcagaggtggtcacacacgtcacttgagggtgctttgagcttcttatgtatgaacactgtgcatttcatttatagaatactggctaataatataccaatggtaaaactattttcttcacctgtgactaaaagtaatactgataaacaaaaaacaatttttattatttcctgaagcccacggtgactgtgctaggtaggtacacctgcccctatgagaagattcccctccttctcatactcctatagcatcttgttataatactcgtctcagagacttaggattatttattgtatgtttgtttctatcacctattttatatatatatatatatagagagagagagagagagagtcatttctgatgtttggtgaattcatgcaaaaatgaatgattcgacactgaacatatacccatagatatttgtaagtgattgcgacctactttcaggcttctgattcacagttgtatgtgtgtgcatatgctaatcttaaaatgatgactgagacagataaaattggataattcttgttataggaaaataaagtttaagaaagctcactcagatataatatctaatcatcctaaggcattgatttactgttaatggatatgttttgaaaagcaacatggcctgattttaatttttatacatagtcatgagaaataaccaaagtaaaagggcataaaaggaaaaatatgagctgaaatgtgagctctagaagcaaaagtcatgtttaaattcttctcttctcatggtaaaagtagagttttctcaacagttagaggtgatatatggtcatcttgtatccttacactaatgtcgttatttgtcaagtgaatttatttctatagaataatgatctctctaggttctaacacatttgttaaatagcattggccacacatctctaaaaaattggaggaatgtttctagctttttggttaaatcttcaaaatggttctagctttttggttaaatcttcaaaattgattttcaccagaaaatataccctgttaaacagcatcctgcattgtccatctggagagcacaactccccagtcatcaaggtgtcttgtatatgaaagctggaaattaaaaaattggtatcgttaagatacaatttaaacatataagatctttgattaaactggcaatgtaattttaaaaaattctatccttaaaggcatttaaattcagaaaagaggaatatttttaaaggaagatttgaatttgattgaatttccctgctggtctaaagaggtcatcaaagagaatattattactactaaaagtacattacaaattactgctaaatcaatgctgctaaaagttaataaacaaaattcagggatttaagaaacaggacaatatttaaaacaaatgtgcacttctgtttcttaaattttttaagtaaattaattccaagcagatctttattaaaatcagttgtaaaactggctctatttaatggatctataataattgaacttactttaaccactttaagaggttaccattattaacattcagtggaatgagtttctaagaaaaaaatgtgcatatatttgtcattttcccaaggatttcctgaaagtgaatattattcctttgaatgttgtccgtaatatctaagcagatatttaattttgacaacaatatagtttataaattttagtaatttgataaacaggataattctcattatcatttcagttcttgagtatgaagcatattgtttgatttgtaatatatgcattccataactttatatttgtccccatgttttagaaacagaatactcaaattttaaaatcatagttccagtaaaaaatgtctaatgaaaaagtttctatttaatttaactgaaaatttaataacttataagtatacttcttatatataatagtcttatttctttaataactgtttttaaatgtaaggtttcattaatgctagtgattcctgtaggaaaaaaaataacgtgatagaatcaaataacaagaataactggtgaaagttcttaataaaataggatgatcttaattctaacattttttaatgtctggaaaaatatatatgatattcagcaaatactattttcagtaattacctgtaacatctcaacccatttatgcctagggttccattattggaacgctaagcatgtgggagttatttatattctactgctcaaggtcattaccaaggtctgattgcaaaaactaaaaaagactgcagcctcaggcataaataggttaaaatactattttttaccattccatttcaaacagaatatgaagattattttcatcttgggtatttagtatattctttcacttaaaaatactattcaaactccagtttctgaaagagtacatctatatttacctgatatttttatcttttggaaataaaacatggaattccgtttgcttatggttggtaaaagatattttttaaacgtgtgccttaattatatttttactttagaaatacagtaaagtgcagaaaaacattaaagtgaaacatgtagcaacaataatggctcatgagtgtaatattaatgttttatgagtatatattacatatacttgaaaatgtgtatttttctttacacatataaaacaaaattgccagcttcctatgtttatggtattatcttttgttcatatgtgatcataaacacttcctcagaacagtaatcatattctgagattacccacttttaatggattaatagatgtttggtttttttgtgtatattatataataacttacgaatggtttaatatttgacatgtaagtcatttaaaatattttattaatccaatgaaagcctatggatttttttggtgtaccagtcaatgaaaacattgctgactatttatttgcataagaacatgaatttttttattctcatgaacctagcttgactttatgtaatgtgacaacaatgtgtgaaagtatattaacatgctgttcaatatttggcccttattggttaagatcacattaatggttttaatctattgatgtttgatcatatgcaaaagtggcatttcacattttcacatttttatgaattttctcttacatagatgtccttttctgtttggtcatgtttgtttggcactctgtgcactaggtactgagtgtggtggtgcaattatgtcagacctagtctgttcagtcctacagctatgaaggagagcatatgtatttttaagaagagtttattatatagtggagctactaatcattttgtaatgttttcttgttttcaagttcgtttatgggggctttatgaatagcccactttttgaatatttatttttatgtagtgttcacattaacttttctactgaaatgaccttctttgaatttgattagtccattgcaaggccaaacacacctacttctaaaatatgcctcctgatgaaggtaataacagtgtgagaataacaattgacagagctatcattttcctctacatttgtggggtggcatcttgagtgactgcatagcatgcccaaacacacctcagctccttttctgttttccagactccaccataccaaagtagcaagcccaaggcccttacttctctgatctgcatgttgggtgccaaatttcttgctgtttggggtttaaggtttggatgactctccgtgagggcactgctgctacctctgtatcgttgattgcttgtgtgtcctctgtagggctagtgtgcagggtcggcagtggaacagtgtgagccacaaggagacaaaccaaatgtgagtctgtatttccttttccatattcttcaaacatgtactggtctttcaaatgtgaatctcatagactatttctggaaatttctaaaaaatatttctaaatgaagagatcacagaaatgttcattcatatcttcttccaggaaacttctttcagcctcattttgtttccttgaaatagttcctctttccctctgtctgtattcaattgttttttctttccttatttttcagcagttttactatggtgggctcaaaattagtagattttcttaaatttgtagattaatggctttatccatttggaaaattttcagctcttccacactattccattctctctctgcttttcttccaggatgccaattgcatgcatcccaaaaatgttttacagctttatgtcttatgctcaggtctttgggttaatttttgaatataatgtaatggaaggtccagcttcatgattttgcatatgaatttccagttttcttagaatcattagttaatacgactgtcttttttccattgagtggttttggcatctgtgttaaaaattatttgaacatatatgagggcttatttctggactctattctattctatgtatctatgtgcccgtttttagacctatagcacatagtttactgtagtaggaagttttgaaatcaagaaatacgtgttctctggtattgttctttgttaagattgttttggcaattcgggagggcccttgagattccacgcaaatttttggatagattttttatttctgtaaaacacctcattgaaattttgataaggtttgagggaatctgtgagttcccttgagtagtgttgctgtcttaataatattaaatcttcacatctatgaagatggaattttttccatttatttgtcttgtttaattttttaagaaatgttttgtagattacattttataagcgtttcacctcttacttaattcctaagtattttattctctttgatacttttgatactattataaataaaaattttaagttttcttttcagattgttcattgttattacatagaaatgcaatttattttgcatgttgaatctgtaatcagatagttttctaatttattaattataacaattacttttggataaagctttagaattttccacatatgagatcatatcatctatgaacaatgataacattattttttccttttcaattctttcttatatttcttttttcttgcttaattacagctgctaggacttgaagtactgtgtcaaataatatggtgaaaagcaggcatctttgtcttgttcctgatcacataggaacatattatccttttcataggaaaaggtttcagtcttctaccattgagtatgatattccctggcggtttttatgtatggcttatgttccgttaaggtagtttccttctatttctagtatgtggagtgtgtttatcataaaagagtgtagaattttgtcaattgctttttctgcatcagttgagatgattatctgctttttgctttcattttgttaatgtggtgaactacttcgattgattttcatgtgttgaaccaatcttccattccaggaataaaacccacttgataattgtatataatctttttaatgtgctgttgcactgttgaatgtgctgttgaattcactttcttagtattttgttgaggatattttcattaggttcataaataatattggtccatagttttttttttttgtttttttttttcttctggtgtctttgtgtggctttggtatcagagtgataatggcctcgtaaaatgagttaggaaatgctccttctttattttttggaaaagttgaagaaggattggtgtagtacttctttaaatgtttatacattgagatttgacataaaatacatttttagaaaacataataaatatggaacactgtgttatatgttggcaaagcaagaatgtgtcaaatcttagtgttaacttccctcattagtcaggaaaatatactaacttgatgatttccattattgttgcactgctgttcttttacttatgttaaaatcattgacaaagtagaaaatgaggtttctttaacaaactacaagatgttgagattatacaaagaaagaggttaaatcagcttctagtaaaagaagaattaagaagcctgaccagttatagattttcaaagtccagtcctcagtgataagatgcaaagcaccaagagcacagaaagagaaaatggcattatgtttattcagagctagaatcctcaaagcatttgaaaagatagaagtggcatacagtttacctcaaaagatagctaattttttctgataacacttgttagggtcatatggacattctgctagactgagggaagttaaaatgaataagacacatgtctcttcttaaggattacactgcatttagtaaacacatgcagcaagaggaatagcagatggaaatgtagacccaaagagaaagtcaccagacattctttctgagtcctcagaaaagctttcatggcagatatggttttgattatgtggtacatgggcatagcctttgtgtcagactgaattagctggtgccaatttcagggtgaattaaaggatatttaatctctgtgtacctcagctaaacatgaaaataaaatagattcttgctaggtgaaaaagtgagaggatgagagagaaagagagagagagagacagcaagagcaagggagggtgggaggaacaaaagagggagagaaaaataaaacagggatgaactgagctttggtgggtgatatgatttggccgtgtgcccacccatatctcatcttgaattatagttcctataatgcccacatgttgtgggagggacctgattgtggaggtaatcgaataatgggggtagttaccctcatgctgttctcattatagcgagtgagttctcacaagatctgatgactttataaggggcttttccccatttgcttggcatttctccttgctgccgccacgtaaagaaggatgtgtttgcttccccttttgccataattgtgtttcctgagggcctccctagccgtgctgaactgtgagtcaattaaatctgtcttctttataaattacccagacttgggtatgtcttaattagcagtgtgaagatggactaatatagtaaattggttcaggagtggggtgtggctataaggatacctgaaaatgtggaagtgacttgggagctgggtaccagttagagcttggaacagtttaaaggactcagaagaaaacaggagaatgtaggaaagtttggaacttcctagagacttagagggctcagaagacagaaagttgtggggaagttaggaacttccttgacacttgttgaatggctttgaccaaaatgctgatagtgatatggacaatgaagtccaggctgagatggtctcagatggagatgaggaacttgttgggaactggagtaaaggtcactcttgctattcaatgagactggtggcattttgcccctccccagagatctgtggaactttgaacttgagagagatgatttagggtatctgatggaagaaatttctaggcagcaaagaggaatcagagcataaatgtttggaaattttccagtctgacaatgcaatggaaaagagaaccccgttttctagggtgacattcaagtaggctgcagacatcagcataagtagtgaagagctgaaagttaattaccaagacaatggggaaaatgtcttcagggcgtgtcagagaccttcatggcagcccctcccatcacagccacagaggaaggaaaaatggttttctgggcctggtccaggcccccctgctatgtgcatccctggggcatggtgccctgcatcgcagctgctctggctatggctaaaaaggccaatgcataaagtataataataaaaaaaagggggccaatgcgcagttcaggccgttgcttcagatgatgcaagtcccaagctttggcagcttccatgtggtgtttgccctttgagtgcgcagaaaacaaaaattgaggtttgggaacttctgcctagatttcagaagatgtatggacatgtctgggtgtccaggcagaagtttgctgcagcagtggagccctcatggagaatctctgctagggcagtgaagaagagaaatgtggggtaggcactgcccagtggagctgtgagaaggccaccattctccacaccccataatggtagaactactgacggcttgcaccgtgtgctgggaaaaggaacagacactcaatgtcagcctgtgatagcagccaggaggggagctataccctgcaaagccacaggggtggacctgcccaaggccatgggagcccacctcttgcatcagcatgacttggatgtgagacattgagtcaaaggagatcattttcgaaccttaaagtttaacaactgccctattggattttggacttgcatggggcctttagcccctttgttttgacaaatttgtcccatttagaacaggtatatttactcaattcctgtacccctattgtatctaggaagtaactgacttgcttttgatttcacagggttatagatggaagagacttgccttgtctcagatgaagctttggacttggacttttgagttaatgctggaatgagttaaggctttgggggactgttggaagggcatgatggtgttttgaaatgggaagacatgattttgggaggggccaggggcagaatgatatggttgggttgtgtccccacccaaatctcatcttgaactatagttcccattagcccaatgtgtcatgggaggaacccagtgggaggtaactgaatcatggggatggttaccctcatgctgttctcattatagtgagttctcaggagatctgatggttttataaggggattttccctcttttgcttggcacttctccttgctgccacaatatgatgaaggacgtctttgcttccccttccatcatgactgtgtttcttgaggcctccccaggcatgcttaactgtgagtcaatgaaaccacttttcattataaattacccagtcttgggtatgtctttatcaatagagtgagaatggactaatagagtgggcctggggagagtgaacatgagcaaagacactgtgctgtggcaggacagggcctacatcctagagttcatacatacaaggacctgatacagaagtgactcctgagagacacatgggccaggatgtggaaggatttgaattatatgtgattttgttcttttgtttctgaagtaatggacagtgtgtaattacttaagtaaaaaatggccatttcaaatttacatttttaaaatgctcctgtagaaacaataggtgcatatataatagaaggtcaaacctaaaatattattcttaatcatccatcttatcaagagcacataaaattataagaatgtgcacttgcatttatgatgttcttttgtgttaaatgataaatgggatgactaaattccaaaatctgctctgcaacaaaggaggtagatcacttgcagaagtcaccagtgataaggagtgacaagatgctaggaaatcctactgagaaggttatatttaagaatcaataaattctatggtcatgtttcataagactacatctctcttttttgaacagaaatcaatttaaatttcatcatatttactctatattttctactgatacttcagatgcctctctctctccatgtttcatttcagcccagaaacaattattattgtaatataagaacttccttttaaattataagtattcctttcaaatcttgtatgcatggtatgaattctacattttgaagccatcagaattactattgtcaatctaaaaaaaattagagattagtatctccaaatatgttgcatttactcaggaatgaaatatgaggattaatatttgggatgccacagtgtatcaagtgagggaaggggaaatggaagcttttattggcacaatgggaagggattacataagttgcttagaaacaaagttctttggtttcacagactcaagctcagttcgttgttggagatgtccttactcggcaagtgttcttggcagagcatcctattgaaaatattgcagtcctaaagaatgtctagtgatagaccttgtcatacaaacataagtatatgtgcaaaatttgcaagccatgcaaaggataagatgcttgaaggaggttaagaaatttcttgtggagttttagagagtccttggaaacagttcttttcttagacatgtaatcatgagttccctctccttcatgtcttcccagccctattttgtctggatctgacaaaaacaatcatccagtatctgcaggtttcacactatagacattaagactcaagaacttagagggtttttggttgtttgattttgtttgtttgattgcttgtttgttttgctttttaagtgattagctttcaaggcaaagttaaacttcaaattcatgagtttaactttgttgtaactgagctattctctgtcttcattcattcaacaaatattaattgagcacctactaagacctaggccttctctaggtgcaagtcggtgcagtatagactgagacagacagaagtctgtgacctagaacttacattctagtgaggggagcaaataaattacaaaagaaaagtattaaaataagcagttattagatactgataagtatctctatactgataagtatcctctatactgatagtatagaggaaataaagatataattaagcacaatgtcacatttttagtgtgtatgggtgtgtgggtgtgtgtgtgtgtacatgtactatgcatctgaaagtatcatcctgtctgatttatttgaggtactgcaatttttcttttagcagaaaatattccaatacaattctagaaaaaaacaggaattcaagcataacatattttttttattgaataagtctggaggttcccatttaagcaaatacgatgacctaggcttggttttgaatagcatattttaatgaatgtccttttaagaaaatactacacaaaagtgtcatttttaactttctgttctatgttttgggtcattcatagaactaaaatcacatattttgggaattaaaagatagaaaaatacagaattcccaagctcaaagagcctatagttttctagaaatcaaagataattataagaatgacccaatgagtttccttatcacaactgcagcataaaatgaaataaactgatatttaaaaaaattgaattttatattttatgttcttaaaaaaataagaacttaacactacttagattttgtttcctttgtgtaggtcacaccatcctgaatctaggtatgctctttgagaatacacatgagagcaggcatggtggctcatgcctgtaatcttaagtactttgggaagccgaggcgagtggatcacctgaggccaggagttcgagaccaacctggccaacatggtgaaaccctgtctctactaagaatacaaaaattatcagggcatggtggcggcgcctataatcctagtgacttgggaggctgaggtgggagaattgcttaaacctgggaggcggaggctggagtgaactgagatcacactactgcctccagcctgggcgacagagtgagactcaaaaaaaaaaaaaaaaaaaagaaagaaaatacatgagccattaaaccaatttatatgatagaaaataactagcatcaaaaattcttggagctgcaaagccctctgtcatagacatatcactcagcctcagttcctttttgcgatagtcatcctgaggaaggatattcacaatacattttactacccaatggaaggaaataggtcaaatcaaatgtttcttatgcagtaatacgaattttcttttttgctggaagtctctataaagtttcaaagtgtctataaatcccctggaactgtaagtaaatagcaaaatgctgagcttttttttttttttctgctagaggtcaggtaagtttcttcagatttgttttttcttttctttttttttttaattatgctttaagttctagggtacatgtgcacaacatgcaggtctgttacatatgtatacatgggccatgttggtgtgctggacccattaattcctcatttacattaggtatatctcctaatgctatccctccccgctccctccaccccacgacaggccccagagtgtgatgttccccttcctgcgtccaggtgttctcattgttcaattcccacctatgagtgagaacatgcggtgtttggttttctgtccttgcaatagtttgctcagaatgatggtttccagcttcatccatgtccctacaaaggacatgaactcatccttctttatggctacatagtattccatggtgtatatatgccatattttcttaatccagtctatcattgatggacattagggttggttccaagtctttgctcttgtaaatagggccgcaataaatgtatgtgtgcatgtgtctttatagcagcatgatcctttgggtatatacccagtaatgggatggctgggtcaaatggtatttctagttctagatccttgaggaatcaccacactgtcttccacaatggttgaactagtttaccgtcccaccaacagcgtaaaagtgttcctatgtctccacatcctctccagcacctactgtttcctgactttttgatgattgccattctaactggtgtgagatggtatctcattgtggttttgatttacatttctctgattcttttttttttttttttttgacacggtgtttcgcactgtctcctgggctggagtgcagtggtgcgttctcgatgacactgagagagtccacactagctcctgaaagagacaacaatgctgctgtcacaagcatatcccagcatagcacctgaacagtggtagccctctaggttttagtttagacagtatctggaaagaaacttgattgctaagatttactttagtggtggaaggatgatgcattagtgtgcctgtaacagaagaataccagtcttcttactgtgatctggcaccgaccacaactgtgcaagtcaaacatgatgaagtccccgcagatggagctgcccttctgctgtgttgtgctgaacagccactgacctgggtgggcactgggtccatgcgttgtttgtttctctctgcctggaaagcccaaagtgcttggaaaggaaagtgctctcagtcaaggaagcctgaggccagtatttgggaagaaggggcaggcattggctctgggtcattcatacagaattttcatagatagaacttacttgtctgctacctgaaacaagaacacaagaaaacaagaccgtatgctttggcagctgtctgaaaaatgagtttccaagaaatcaagcagagatgaatataatttatgaatttatcttctgtttttcatttttaaaaggcttaacgtggccttcatttatctgaatccattttactttgtggtcatttatagctcttgctggttttgtagagtgatgtgttgggcaaccctggtctaagccattctgctccttttacagccagaggattaatagcttaaataactgtgatccaaaagcagccggttttgtgatacggacagaaattatgtcctttgatctctaaaagccttcaagttcaaacacagcctttattttagtcaaaattatactccctttttagctacgtataacacaaattgttctgataacataaaattagcattggtttctaagaagtgtaacatggaaaatgcctttttgaaaaacactgatttgtcttatttgaagatcagtcttaaaatgatgcagagaatttagaattttcattatttggaaatagtattactaccaagagtagaaaatttttaaaactttgctctctgaatgcattttattactaaaaatatttattttttaatatttgactgtatataatatagcagacactatattaatcatatgaataataccatgttttaaaaataaatttaaattgtaattaatgtatctttttgggttttctaattaaattttaatttgctttattgatattaatgttataattaaaaagtaagtatttttcaaagcaaattattgccagtatctttatattgagagttcacttataatttaggtttcctagagaatggttgtaaacagaaatgaaggtatactatgtccaattgataaacactaggatattccaccagtgccacttatgagaaagcatcaatggattcattttccctctatctgttcattccccacccagcctgattcacacatgattgtcacccatttggcacctgagtgtgcaaatcctagtctagagttgacaagaaaatagaagggagtatgaaaactacagtgtaagaaagacatctttgctcagcattctttaaaatgcacttcttatcttcaaagggaattcaagcttactttatattaattataatcactacttattaagctctatattcctgtcaatttttccaacaaatatatgcagttaatgtcattattgatgttttacaaatgaagggatctagatatttgataattaatgatctgtctgaggatatttagtaataattacaactggaattcaacaccagatctgtctgactgcacagcctgacaaagtcttatgcaactacattttagctcctgtgttgaacttatcctcattcccctctgcagcctccttggattgtttggattctgtaaagggggcatccttatgccattgtctctgcatgggatctttcatttccatgttctagcacttatcaccatgagtcacacttggtagaaggtcattaaaagattttagaagtaaataatgacattctctcctgtcttcatttcattaatacacacacacacacacacacacacacattactgaggactgaggatccttataagcctttaaaatgttgtgaaagatttaaaagtttagctagagagaggaaaaataaaacaggtgtttttgaaaaatgtgtattctgggggttgttttgatgacattttagattttcgaagttttaaacaatggagagcttcgttaaaaaaaaagtaaagattaaactaattttattttctaatgataaaagttatatttcaaaataataataattataaaatacaaagcagcaaaggaagcattcatgtaataacccctaaataaaaaacaaaactgtttgaattttgtatttataactgtcagtatcattgtcatacacatatgtctacttatgtatgcacattaaacataaaatcaatttcggttcacgcttacagacattaatctaaatttgtaagactggatgtatgcccaaattatcaatctttgtgcatgtgtatatatatgcatatataaatttatatatgtttaatatacatacacatatatgcatacatacatatatgtatatacatatatgtaggtatatatgtatgtatgcatatatatgtgtatatgtaatttttaaaatactgcataaaactgccttgaaattagaacattttgtaagcatcgtatcttatcaatcttatcaatcttatcaatcggtaaatatcaccataagcatttgtaatgaatgcacagtgttataaagttttggatatattgattattgtttagcataataaatacttcagtgtatgctacatatgttttaattgctgtgatttttccacttactttatactctctgtgtgtgtatatttaaaaatgttagactgttaaaaattagtggcttggccgggcgcagtggctcacgcctgaaatcccaccattttgggtggccgaggcgggcggatcacctgaagtcaggagttcgagaccagactggctaacatggcgaaaccctgtctctactaaaaatacaaaaattagctgggtgtggtggtgcacgcctgtagtcctggctacgcgcgagggtgaggcaggagaatcgcttgaacccgggaggcggagattgccagcctgggggacgagagtgagacttcgtctcaaaaaaaaaaagaaaagaaaaagaaaaaaaaatttagcggctcatggctcatgcctgtaatcccagtattttgggaggccgaggcgggcggatcacgaggtagggagatcgagaccattctggccaacatggtgaaaccctatctctactaaaaattaaaaaataaaaaaaaattagccaggtgtggtggtgggcacctatagtcccagctactcaacaggctgaggcaggagaatcgcttgaacccaggaaacggaggctgcagtgagctgagattgcactgctgcactacagcctgggtgacagaatgagactccgactcaaaaaaaaaaaaaattgaagatatgaaatgttctaattagacctactttaagttattgttttattttaaaatgttagtataagtactaacaatataacattttatattgttatattccacttggtacaggaaagatggaaattatctttaaaatggatgtgggtgtgtgtacagattttaaatcttaacaaggaattattttgtatctacaacaccaggaaaaatttctgaatacaatggaagcacatttcttgctgccacagtgagggtaacaggcggacggagttttctgtgctggacatcccactccccattttggttacccgccttccattcctgtgcagtcagtagtttggttagttaagtgtatatttccactgaaacatgaataaacatgaatagattatattaccctaatacacaattaaaaagctacaaatttcagtagaaatcagcttacacaatttattttcttgccaaataaatctattaatactacacacagcagtattcaagcattgactcattctttttgaatatttttacataatcctgggataacataaattgttcaagtataaagtattatgaagttacagagaagaagtatttgaaaagttatgatgatatcatttgactaagaggcgcacaatttattagtatttccactttaaagaatattacttcttcaataattgacttaatgtcttgttctactttattattttattattgtattcgccacattacaaagacaatctacacataatttctaaaggccattttcatattttgcaaacatagtttttacatattattattattatttacattttattctagttgttggcatatcacactgtcttgtcattctctctagtcattaatatactacctcttttctgtattctaatttctgatacagatattctaatgtaaaatataatatattctatattctaaattgctcccactttcttgccttatttttgagccgtggtaggaaatacaccatacattttattattttaatagtagtaatgttatgtaataaaccattcaaaggatagagatggtaacattcacatatcagttaataagttgatcttttccaaggtaagtcaggtatgtactaagggaaactaacaaaaacaaaaaattataatataacaattcctcacaggtaaataattctgatggtctagtaaacactctagtgggacagaaagtagatctctgtgggagaaaacatctcaattctgcaaacgctcccaagggtgggttagcaggacaagacgtctgtgcttggctcagaagtttggctcaatcactactttctatcccgtgttttgctcaaccactactttctatcccgtgttttgctcaaccactactttctatcatgaagtgtttactttcatagctgatcttcaagtttcctagaaagatggttcagactatttttcagattaaaaaaaaaaaaaacattgcagtttacgaagctacatagtacattattgaagacaagggcccacataaaatattagttgaattttagaattctttataacaattcatatgaattagcaaaaagtagatttccacaaagtactcagtatagattttttaattgattaataaaaatgtttagagatcagttttttccatctgtatttccaggctatgctgattttagctgaaggcatatatgagtaggttcagagattccttagcagagccagaaggtattttgaaatgattataataatgtaagaagtacatggtttctgtacctaaccttgctcagatcacacatatgttctcaaattttcttttctttttacattttaagtgagaaatatcttgctagtaaatctgttcttgtagatgtgacttttgttgattttccaactttgtgtactttttctgtttaaatgaactgttatttcacactagtcagtaggataaaagggaaccaaaaaaggacaaaataaaataagtcagtggcatgatttataaatgaaaatagtctgcattacttctgctgtaagtgtataccatagagagttagcatgcttaagtttctctacaaagctattggaaggtaattattttattcagcaaaagcactattgaagaaagactttgtgtaatgtcctttatccaagcctaatgttcatttttattaggtttttaaagtttgtttccatggcatatgacagaggaaatgctttctctggagacctactttaaattcttataaaatgtcattgattaaattttcttaaagtaaatgttagactctatctggagtcttgactgaaaatgttcaacacacatactttatcctttagcgtttggatattgcgcttccctgttctcttgagtgctaaaacaaattggatataatataatttcaaagtgcaaaaaataaaccacagaaagttacactctgcattcttgatagataatcatttagtattgtttgaacacaggcttttggtttctctgagttaaaaaaattttaaagggaaatcttttccaaactgtttacataagaagtgtgggataattttgatagccaattttaaaaagaaaaaatctgtttatatatgttgttttatatgtgatgatttcagcatatcaaaataggatattagtatatattagctcactaaaaataatctgcataaaattctggggaccttgtgttaccatctattgttcttctcacttttattatttatttatcattgcagattaaaaaaatcaacagaaactttcctgtaaaccagcaggtaagatcaaagcatacttggaaagctaaataatatatttctttaattttattgattatagaagataacgttacctgatttctagacagaaataattggtactgtcatttactatcttcagtgagaaacatacatttcagatatctccttcatattatgtaatatattggttcctctacttatattaaaaagtactttaaaaatgtttatctaagtcaaaaattattgtttctacaaaataatttatttgaatacattgttgaagaacttagagttttatttacatatgttagttttagtatatcttaacttctgggagacctacttttaatttatctcaaaattcaaatgaatttttcacaatttgctgacagtatttcaaacgagtctaagttaatgcatagaacaaaaataattttgattattcagttctataaacctcttactcttgatatcaactttgatttgaaaccactgacaaatctaaatatctatgatagctatttataaatgatacataaattacaaattaattttaatgataaaaatgtttaaatgctcttcaacttataaaatgtaagatatttttcttatctaaacctcagttcccctatgtgcaacatttgtgtaagggcgactatcctgtaagtttattttgaggattaaataatagcacatgtaaagttctcaatctatgctatcattatcatcaaagtttctaaatgtttacacttgttctttggaatacagaatttatgttttgtagaaattgtatcattaatgatgctgctagcccaaatcagcctccaaagccatgtgtaactagaacactgtagagaacagctttggagagttaattgtgtctacaatgctctgattagttcttttcagctccagaggtcccctccctcctaccttaagtccctctgccctgagccaagttgatatcttggataaatgcagaggttggagagatgtacgtgtcttgccacatgctgcagcagcctgtagttgtttttaaggcccttacttacagtgtggaaaccagagctgtcaccagcagcttctgcttacttgctctgtaacaacacctgggatgttccctttgttgctcccatgctgtcccaggtgattctggtatgggtgtcatcttgagaactgcagataagtgtagttcaagataggtgtcatcctgagagctacagtttaatgcttttacagggttccagtagagggaaaatgtcattaataagaaattactcaaatagaagaaagtatcagctatgagggaagattataatgtccatcagtagacaaggctgttttatagtcagatctttaaaaatggaaatctactgttttgtaagttcctctccaaaataaaaaatggtgaattattttttaatttaagaatgactctagagctgtgtcgtcaccctctcatgccctttctaaactcaacatgggagatattaatattggtgtaatatattactacagaggtcattccgctgatagccccaaagctattctgtaatcaatgacaactacagctaacacttctcatgtagtcagcttgctgactgggagcacttcttgccacctttgcttatacccaggtttagaatagtattaagtaaaataagtgagaatttgaataaatcacacatagaacaagtaataaaaactttaatattctaacactataatattctgacacatactcatatgtaagcatagatgttcattagtattcatcatttttatttgctagcctgttaatattattcattatataataatttcaaatccaaaattatataattcaaaactatttcagattttatttcaattatcttggcagctcacagttttgaaaattgtaacaaattcatcctgatatttaagaaacctgaaaagaagggttaatagacttttttccttactacttcccattgtgtacatgaagaattttaagaaataggattaatttatagttaaacatttatattattgcataattaggaaaactcactgcacagtatgataacaacgcattaattgactagagtacatttcctatttagtaaaatctgagccagttttaaaaacacatataatcccatttctgatgatatctacattaaataactccctcatattcctgatgttctaggtatcaaaacagaaattaaaagtcacccaagctacaatgaatccgaagttctctgctccctgagatttgattttcaatttgtgctacccagatggtaccactaccctaaccagagaaattaaaatgaaagcaaaacatagggagaaagccactgcggtccagctgagacaaccgctaagattagctccacatgaactctgccacactccagaatgcataaggctttcagacactgtgtctgaagaagagagttgggcccaaaattataaaccatatgaggaaataaaccattataaagaaatgcataatctagacactaaagaactatccaaaatatttttaatcatgattttttaaataaagaaatcaaaatcataagacaagaagaggacatggtgctaaaatttgtagttgtaaaaaaaaccaaacaggagttcaaaaatgaaaaaaaaacctacatttaaaattagttaaccaactaaataatcttagttattgcctccacttgaaatcatattagtgtatctcctacttcacttttcatgaggagtaagttttccattttttctatgcatctggaacacattcatgtgcttttgttctattaagattctgatttggttcttttttttttttttttgagagacagagtctcattctgtcacccaggctggagtgcagtggcacaatcttggctcactgcaacctccgcctccctggttcgagcgattctcctgcctcagcctcccaagcagctgggattacaggcatgcaccaccacgcctggataatttttgtatttttagtagaaacagggattcaccgtgttggccagcctggtctcaaactcccgaccttaagtgatctgcctgccttggcctcccgaagtgctgggattacaggcatgagccacaacacccaacctgatttggttcatttttacagtgaacacactgaaattaaacttgccctggtaactttctgttgaaaagatgaaaggcgggacagttgtcttgctgatgaacaaaacagggataactgaatggaagtcaagtgatgttgtgataattctctcaatgtattagaggtaaaggcatataggcccagacaaccaggcctacatcacactactatatgtacctagaccattaggttataatttattatgtgtgtcatttttactcatttttaactgaaatttcttcatcctgaaatatatctcattcctcccacaaaaatatcatttttcaataagtttcttctataattacctgggagtaacattataaagtattaatttgtcattaaaatattaatatagtgagctttatattaggcagtatacaaaataatataatcaaattatttatattagtttaaattaataaggttatacttatttaaaataacatattagctctggtagctattcctatagaaatattgacatttgacgaaccataataatttggacacattattatagatgtgtacataccatacatagaatgttggcagctggaattaaaagtgactagagtcactagtcatgctggggagaattagggaattacaggacactttaaaaatctatttctgtagtggtatcagaaaagaaagaaaagtaggataaattttgtcagttttgcttctctataaaagcaacagaaaaatggcaaaaatagaatcaacttttaacaaatatggaaattcacaaaggctcactgaacccagggagcatttattcaagaaaaacagctgagtcttggtaagaacagtaagctttgtggcattataactggacctggtcccaacccctctcttttctctggcaatatgttggcttacataataatgatgcataccctaaaatttataatctaatcagttgtatatttaattcatgaaattttagctttattgaagatgtgtgtgtgtgtgtgtgtgtgtgtgtgtgtgtgtgtatttagacaaaatattctattaatgaaactgacaattggtctttatttttggggaatgtcaaaaatctatttttttcaatttgagaaagaaactctcctagttctttatacattcaatttattaatgttaaaaacacattatagagtcacacaatctgaagataatgagcctgtttttgttctggtctatttcataacacttggtgataaaatatgctggcactttatgatctaaaggagaatccacctcaaaaaaagtaatgtgtctgtataaattaactcttggaaaatcaaccagctcataaatcatttgataacaaacatgatggatatttcccaggaaaaagaggtgtaaatgttattttaagttaaactaaaggagcccacacctaattatgtaaaaatttatgtattacagttaaaataaaatatacacttcagaagacttggaaaagtgttattcaaataatagaaagttgtatatgtgtgtgtgttgaatttatacacataagtacctgggtttcattattgaaagaactgtcttaattctcattggctttcttttctaaatatatagattttcaaaatcctgagggagcggggaacaaatgtagcaaaattgtcttgttttacattttccagattgttatataaatgggatcatactgtatgtatgaatttttgtggcttctttcatacagcataattctttttaatattgctcatttagcagcgtgcatcaatccatcattctttctaatgctgggtagtattttatcggtggctctactaccatttgtgtattgtgtattatcccattaatgcacatttgcttcattttaagttttagtgtattacagataaagctgatataaatatttatgaaaagtctttgtcttgacatatgtttttattatatttgggtaaaatcctagtagtgtaataactcaatattatggttgtgtattttgaacattttaagaaactgcagaactgttttccgaagggttttacatttcacattgacactagcagggtaaagataatctcgtagatatccctatggtcaggcttttaatttttggacattctaatagatgtgtcatgatctgttaaattttaatttacatttctctatagaataatgatgttgagcatcttttcatgtgcttatttgacatctgtatatattcttttgtgaattatctcttcaaatgttgcccaaggacagaattttttaaatttgatgaattccaattcactgtattttaatgagtcatgcttttgaaattgtatttagtaaatatctgcctaacacaggaaataaattttcaactattttttatcctaggttttttacagtattctttttatttttaatctatgatttatttttatttaacacttgtttcaaaagtgaggtatagattaaagctatttttaaggggaggtacaatagttccagcatatgtgttgaaagtattattctttcttcactgtattattattcctctaccaaaatacaaattgatcacatacatgtgggcctatttctggactccaaatgctgttgccttggtctatttgtatctcatgacacaaatacaaaaccgtcttgaatactgtagtactacgatgtctaacatgagtagtgtaagtcccctagctttgtaattatttgctgttgttgataaaacttctaatattttttattaatgtttttatataattgaaacataataattgtacacatgtttgggggacagtgtaatatttcaaatcatatatacactgtataatgagtcaatcagagtaattgccaaatccatcactttaaacatttatcatttattttggtagtaacattcaaaatctcctctagctatgctgaagtttacactacatggttatttgctgtagttaccctactgtgtaatagaacatcagaacttactcttcctgtgtaactgtaactttgtacccacaggcgaacctctcccaatctcccctcactcttcccctccctagcctctggtaaccactattgtactctctacttgtatgagatcaacttttttttcgataacactgatgattgagatcatgtgatgtttgtctttctatgcatgggtcattttacttaacataatgtcttccaagttcattcatgttgctgtgaatgacaagatttcattcccttgtatagctgcagagaatatatacatatatatatacacacacatatatatacatatatacacgtatatatacacatatatatacatatatacacgtatatatacacatatacatgtatatatacacatatatacatatatacatatatacatatatacatatatacatatatatatgccacatgttctttattcattcatctgtatatgaacatttaagttgataccatatctcagctattttgaatagtgttgcttattgggagtgcagctatctctttgacatactgatttcatggtcttttgagtgtatactcagtaatggattgctggatcatgtggtaattcaattttgattttttgaggaaccaccatactgttttccataatgggtgtaccaatttacattcccaacaacagtacaaaagagttgccctttcttcacatcctttccaacatttgttattttttttgtcttgttttttgataatagtcatttgaactggtgtgaggtgatacctcattttggttttgatttgtatttcactaatgattagtgattttgagcatttttaaatgtaaatgttggccatttgtatgtattcttttgagaaatgtctattcagatcttttgcccattttaaaatccaattacatggtttcttgctattgagttttttgagcttcttatatattacggttattaatatcttgtctgtgagttgtctcttcactttgttggttatttcctttgatgagcagaagttttttgtttgttcgtttgtttgtttttgttttttgtttttttttagtttgatgcaatcccatttgtctatttttgctattgtcacctgtgcttttgaagtcttattttaaaaactccttgcccagcccaatttcatgaagcaatttccctatgctttcttcaagtgcttccatagtttcaggtcttacttaaagttcaagtcttacttaaatttaagtctttaagacattttgatttgatttttgtgtgtggtgagagataggggtctagtttcatttttctgagtatagacatgcagttttcccaacattgttattgaaaaaactgttctttccctaatatgtgttcttgacacttttgttggctataagtgtattgatttattcttaggttttcttttctgttccattggtttatgtatctgtttttatgccagaaccatacattttatttactatatctttgtagtatacttttaaagtcatgtcgtgtgatgccttaactttgttctttgtgttcaagatggctttgactactgggagtcttttacatttccatatgaatttgaacattgctttaaaaaatctgtgaaaatggcattgtcatttgataaggatttcattaaatatgtagatggctttggttaatattgacattttaataatattaattatcccaatccatgaacacagactacctttctatttgtttggattccctccaatttctttcatcaatgctttatagtttttattatagagatctttcatttttctggctaagtttattcttaagtatttctctgtggccattgtaaatgaaattgcttcctaatttttttatgataggttgctattggtgtagggaaatactactaattctatgttgattgcatattctgcaaatttactaaagtcattcattagttataacaactttttggagtctttaaggttttctacatctatggtaggtgtgtatatttattgggtgcaagaggtactttaatataggcatgcaatgcataataatcacatcatggaaaatggagtgtttatcctccatccagttttcccagcaccattgattgaagagactgtcatttccgccaatgtatattcttggtacacttgttggaaatgaattcactgtaggtgtataaacttgtttctgggttctctattctgttccaatgatctgtgtgtctgtttttaacagtaccatgccatttttcttactatatctctatagtataattagaaatgaagtaatgtgattcctctagttttcttctttttgctcaggatagctttgtttattctggatattttgtggttccaaataaattttaggattgtttttctatttatgtaaagaatgtcattggcattttgttaggaattgcattgagtctgtagattgctttgggtagtatggacattttaataatattgattcttcaaatccatgaatataaaatgtctttctttttttgcatcctttttaatttctttcaccaatgttttatagttttctttgaggtgatctttcatttctttgttatttgtgactattacaaatggggttacagttttgatttcattttcagattgttcactgttggcatttagaaatcccactgatttttgtatgttgattttaaatcctacagccttaatgaatttgtttatcagttctaatagttttttggtgtctttggatttttccaaacaaggataatttgacttcttcttttccaatttcgatgctgtttatttctttctcttctttgattgctctagctaggacttccagtactattttgagtaacagttgggaaagtgggcttgtcatgatccagacaaagatgctttcaagaaaggctttcagtttttctctattcattataatactaccttgggtctgtaatacatggattttatcatgttgagatatgttccttgtattcccggtattttttaatcatgaagggatattgaattttatcaaatgtttttacagcatcaattgaaatgatcatatggttgttgttcctcattctgttgacatgatgtgtcacattgattgatttgtgtatgttaaaccattgttgaatctctgtgataaatcccacttggtcatgatgaatgatctttttagtgtgttgaatttgcgttgacagtattttgttgaggatttttgcatcagttttcatcagaaatattggcctgtaattttttttttcagatatgcctttgtctgattttggtatgagggaaaactgtccttatagaataagtttggaagtattcacttctccattttttggaagagtttaagtaggattggtattagttctttaaatgtttgatagaatttagcagtgaagccattgggtcctcagattttctttactgggagactcattagagctccaatctccttctttgtgattggtatggtttggtattggattcttcctgattcaatcttggtaagttgtatatgtctacgaatttacctatttcctttggattttccaatttattgccatatatttttgctcataatagcaaatatataaatttctattgaatttatgtggtatcagttgtaattagaaattcatctctaattttatttatttggttcttctttctttttttcttagttttggtaaaggtttgtcaatattatttatctgtttaaaaaacaacttttcactttgttatcttttgtattgttttatttgtttatttgtatataatttatttctgctctgatctttattctatttttttttccttctactaatattgggtttggtttgctgttgcttgtctagttctttaaggcatattaggctagctgggcacggtggctcactcctgtaatcctaggactttgggaggccaaggtgggcagattatgaggtcaagagattgagaccatcctggccaacatggtgaaaccccatctctactgaaaatacaagaaacattagttgggcatggtggcatgcacctgtagtcccagctgcttgggagaatcgcttgaacctgggaggtggaggtttcagtgagccgagatcgcgtcacttcactccagcctggtgacagagccagcgagacaaaaaaaaaaaaaaaaaaaaaaaaaaaaaaaagacatgttaggctattaagctatttctttgaaggctttttgtttgtttggctttgttttttatgtaggcacttatagctataaattttcctcttagctctgcttttgctgcatcccataggttttattatgttgtgtttccattaccatttgtttcaagaggtttttcaatttccctcttaatttcttcattgaccaactggtcattcaggagcatgtgcttaatttccatgtgtttgtatggcttctaaaattcctcttgttatttatttctaatttcattccattgcagtcagagaaaatgcttgagatgattttaattttttcagtattttcagacatgttttgttagctgacatatggtatctcctttagaataatctatgtgctgaggagaagaatgtttattctgaagctgttggatgaaatattctgtaaatatttattaggttcatttgttctaaagtgcaagattaaatatgattttctttgttgattttctttctggaagatttgtccagtgctgaaagttgggtgttgaagtgtgtagctattcttgtattgagatctgtctctcttttttactttaataatatttactttctatatctgggtgctttggtactgggtgcatatgtaattgctatatcctcttgatgaatttaactttttatcattatatagtaactttctttgtctcctcttgtagtttttgtcttgaaatatattttgtctggtataagtatagctacttctgctattttttgtttcaattagcatggaatatctttcattattcctttattttcagtctttgtgtatcttcagaggtgaagtgtgtttacattaagcaacagataattgagtcttctttttttaatccattctgccactctatgtcttttgattgagaggttagtctatttacattcaatgttattattgataagtaaggacttactcttattttgctatttgttttcttgttgttttgtggtcttctcattcttatttcctttcatctagtcttccttttagttaacatgattttatctggtggtatgatttaaattcttttttatattatttgtgtatccattgtatggttttcaatttgaggttgccatgaggattgatagagtatcttaaaactcgtaattttaaactaatgacaacttaaaaattgttgcataaaccaaaactaatataaactctacactttaacttcttcctccaactttttaacttgttgtttctctttatgtcttatagtactgtttgtcttgaaaagttgtagttattatttttgattggtttatcatttagtctttctacttaagatgaatagtttacacaccacaattacagtgttataatagtttgtgtttttctgtttgcttactattactagtgagttttgtactttcaggtgattttttcttgttcattaacatcattttctttcatgtcgacaaactgcttatagcatttcttgtaggacaggtctggtgttgatgaaatccctaagcttttgtttgtctgggaaggtctttatttcttcctcatgcttaatgcatattttcactggatatactattctaatgtaatagttattttccttcatcgctttaaacatgctgtgctagcctctactggcctgtcaggtttccactgaaaagtcagctgccagatgtattggagctccactgtaaggtatttttttttttttttttcagttctcttgctggttttagagttctttcattttctctggcctttggaagtttgattgttaaatgccttgagattgtcttctttagatgaagtccacttggtgctttataaccttcttgtacttgaatgttatctttctctatgttttggaagttctctattattatttctttgaataaactttccactcttatctctttctctaccttctctttcagaccaataacttttagatttgccttttcaaggctattttcttgatcttgtgaatgtgcttgattaatttgtttttccattgtctcttctgtgattttcaaataacctgtcatcaaggtcactaattctcttttctgctccacagttctgctattaagacactctgatgcattcttcagtaggtcagttgcatttttcaactctagaatttctgcttgattcttttaaaccatttcaatcactttgtgaaatttatttgatagaattctaaattccttctctgtgttgtcttaaatcgctttgagtttcttcaaaccagctactttgaattttctttgtgaaaggtcatacatctgtatttctccaggacttgtccttagtgtcttatttattttttttggagaagttatgttttcctggatagtcttgatgcttatggaggtttgtcagcatctgggcattgaaaatttggatatttattgtagtcctcacagtctaggcttgttagtacctttctttcttggggaggctttccagctattcgatgcaacttggaccccaagaccaataacagtgattcttgcagactcataggtgtgctgacttggtggccttggataagatcagaagaattatctggttttcagaaagacatttttgttctcttctcttacttttttcccaaaaagaagactccctctctgtgctgatcagcttagaactggaggatgggtgatgcaagacccctgtggccaccatcattaggactgcactgggtcaaacccgaagccagcagagcactgagtctagctcaaggccagctgtgatcactacctggctaccacctaggttcactcaaagccctagggctctacagtcagcaagtgaggaagccagcaagggtaatgtcttgtacttcagggcagtgagtacctccatgacccagaagggttcagacatgttttctaggggccagggactagagtcaaaaaccttagaaatctactgggtacagaggctcatgcctgtaatcctagcactttgggaggctgaggcaggcagatcactttagctcaggagtttgagatcatcctgggcacttgatgaaactcatctgtacttaaaaatacaaaaattagctgggcatgatggcacatgcctgtagtcccagctacagggggctgaggtgggaggatcacttgagcccagcaggtggaggttgcagtgagccaagatcacaccactgcacttcagcctagatgacagaggaagaccctctttcaaaaaagaaagaaaaaaaaaaagaaaaccttagaaatatacctggtgttctattctgcatggctaagatggacctcaaactacaaggcaatgccctttccacttttccctcccctttttacaggcaggggagttctgccaggctaccaccaatattcacttaaagtccaagggctcttcagtgtgcttgtggtgaatgctgccaggccttggagtcattcttcagggcagtgggctcccttctactacaggacaggttcagaaatgtccaagagtctaggcctggatttagccaccacaatagcctgcttggtgctctaccccattgtggctgagctggtttctagggtgtgagacaaagtccccttcattttttcctcgcttttctcaagcaaaaggattctttcaccctagtcacaacagctggaaatgtactaggtctcacctgaagccagcatgtcttagggtgtcaccaaaggccatggcatacgaacaaggtatccctgcaggttattcagggcccaaaggttctttagtcagcaggtgatgaattgtccccagactgggtccctcccttcaaggcagtgggtttccttctggcccaaggtgtatctagaaatgtctaggagctagagcctggaatgtggcctcacaactctgccctgtgccctgtcctattatgactgagctgatatgcaagatttaagacaaagtcctgtttactcttcctgctcctgtcttgaagcagaatgaaggagtcactttcatttctgtgagctgcacagcctgaggttaggggaggggtggtgcaagccctcccttagctgccttggctggtatctccctaggtcaggtgtttccctgttccactggctctaagcccagcctagcactaggaattccataggaatgtcagtccttgtggcttagactgcctttcaactttacttaggatgctggagcattttagactgcagtggtgaggcttgccaaaactcaagttctgatatctgggatgggtaattcctttctggctgctccgaatgctccttccatgggcaggaaccagctgagcaacagtctttggtctttattgtgacagtgcagcaaaacagttcaatggcaagcccgccagtcgctgtgctagtcttcccccaagtgcacagattctctcttcacaccatgaagccactgctagaggatgggggaggggtggtctcagtgattcaaaattttcttttctatcctcttcagtactttctcaacaatatgaagttaaagccaggtactgttattgttcacctgatttttggttctttcaatcgtgctatttgatgtgtggttgttggttaaaatttggtgcttctgttggggagaggggattatccacggaggcttttattcagccatcttgctctgacctaactgaaaaaaataaaataacacaaaaataaaataaaaacatctgtcatatttttgtccttgattctatttatgtgatatattatgtctgttgattggtatatgttgaaccatgtttgcatccctttggtgaatcccacttgatcatggtgagtgatctttttgatgtgtatttgaatttcctttgctagtattttgttgagagtttttgcattggtgttcatcatagctattagcctgtagttttcttttctttgttgttgttgtgtccttgtttttattcgaagtaattttgtctactctggaatcttgctctttctaaacagaaagttagaaacacgtgaacaacttgtagacttattcaagagtagttgggtatttttgaaattgcattgaatctttatatttaggaaagttgacatattatgaatattgagtcttgagatccatgaagataggttagctctctacctttcttagaactttaaaaatttctcttagaaaccattctagtttccagtgtatacatatcatgcatactttatcagatttattcctaagtacctcatatttttaatgttaatataaatgacaaatttttgatttttatattgatttagtttcctgcattatttctaaaatgacttctaagatgtaggaacaatagacaattatgttatctacataaatataaatattttgaattctttatttcattttggatacattttatttctttttaataattcatggcactgtgagattctccagtataatgcagaatgtaactgataaacacataccttgtatctgatcataggggaaatcattaaatatttcaacattaaatatgttaatagctagatgtttttcataaatgttctttagcatgttgatgaaatacctttctgttactagtttgttaaaaattttaatcagaataaatgttcaactgtgttaaatgccttttctgtgactattaataaatatactgtgccttatgccttttttttatttctatcaatatgctatgttctattaatgtattgttagatatgaaaccaagtttgaattttgcgaatatatcccagttaatcataatgtttttatcctttttatttattgttggactcaattttctaaaataagaaaatttaagaaatttttcaactgtgtttctgagagacattgatatgcagatttctctgcttttaacgtctctcaaaaaaatcaaattcgatatgttacattttatttacattgcccttcaagatcgtttctaacttattttttactttttattttacatgtgaatatttggaagtattatttaattttcatatatttgggaatgtatatgatctggtatcagagtaatggtagctttgtagattgaatgagaaagcatttacgcttcctaaattttctggagaagtttgtgtaggatgggttttatttattcattatctggcaaaaatctcccagttaagctatctagtcctggaatttgatttatatgtagggttttaactattttttttttgttcttttaaaagtacagagctattcaagttatcaaatttatttttgagtaagctttggtattttgtgtctttctaggaattcatgcatttcattttacttatttaagtcattggtatatatttatttgtaatattctcttataatactttaacgtttcttcttgcttttcaattttggtaatctgtgactttttattctttccctctctcttttttgtaatttatcagtcaacataaagccttatcaattttgttgatttttccaaagaaccacatttgatttctgtgacttcttcgttgtctttctttctttattttttactgtttttcattccaatatttatttatggatatttattattttcttccttcttttggctttctgtttaatttactcttcttttttagcttattgaaatgtaacataagttttacatctttcagcctaacatatgttttaaaggtatgaattttttctgaaataatgctttactgcatctcattgaatttgatgttatactttcccttataaactcattcatggtagtttcttaatttgcctgtaatttatttcttctacacttgtctatttagaagagtggtgttgtttaattttcacgtttttggagctcccctattttatttattttttaagtatttctaatttaattatgtttttagtcagagaacatatttcacgtgattacaaatctttcaattttactggcatccatgttacttttcctggatcatgttgcagggatttttataaaacatggatatgtactctgctattttggaatcaatagtatttttcaaatgtcaagtatgtcaaactgactgatagttttgttcaggttttctatatttctattgactattcagttagtttttctatcaattattatgagagtaatacgtaaatctccaactctcatttaaaaattttttttctttgaattttgtcttattttgtttcattatatattgtgtttctgttgttaggtacttatatatttataactgttatgtattcaaaatatattgacatttgtgtcatcatgaaatgtcgttctttttctgtataatatttcttggcttaaaatctattttctatgatgtcaatattgcttttccatctctcttatggttgctattttcttggcatattattttctaatcttttagcttcaatctgttttccaatggtaaatcaaatgcacatttgttccagtcagaataaacttgggttatgtgtgtttttttaaattcagactgacaatatctaccatttgattaaggtgtttcagtcaatcacatttgaaataattatggatatgcttagatgtatgcctgcaattctgctattttttctagatgttttatgtctttttaattttctatttctttttactgcctaagttatattaaagagatagcttcaatgtagtgctttaatttgtctgttgattttttaactatatattttgatttttgaaaaagattgctcttgggaatcacatatgcatctttaagtgatcataatccacttcaattttatactgatttaattttggaattatataaatattttgctgcattgcagtatagatctatttcaaactattgtttttcatattacatgcatgtataaactcaacagtccaggattattcatgttttaagcaatctcattctttaagttattaaaacagaaaagttccttttttaataaaaataagtaacagcttaattatccttttctttcctgtgaatacaagttactgcctggcattagttttcgtttctcacactgtcggacttcgttaagtatttcatgtggggaatattttgtagctgtgaattctctcacttcttgtttatctggtaaagtattttgttgttgcttctgaaggatagttttattagaaattgaaatctttgttgaccttttttgtttgtatcattcaacactttaaatgtcactccagtcttctggcattcattttctgatataaagttagctgttacacatattgatactttcctatatttgataaatgtttttttgctttcagtattttcttttatctttgtcttccagaagtttaatattcctagctgtacatctctttgtgtttattccacttgagacttcttgaatttcttgaatctccagattaatgttgttccttgagtttttaaagttgtcaattatttctttgaataataatgttattctccctcttctctctcctttctgccttagactatcaatacacatgttgatatgcttaacacttttccaaaggtctctaaacctgtccatttcttcaatccattattcattctgcctttcagattggataatttctattaatctatcttttagtttactaattatttttcctggctgttttctattcttttctactctaaaagtttcatttgtttcttatttttaaatttctgtttctctattgaagttgtctatttgttgagtcattgctataataaattatttgaacatatttagaaaacttctgtaagtttttgtttgctaaacaaaacttgttttttcatccagagtcagtttctatcaactgcttcttttttcccccagaaatgaatctcactttcttcttcgttttcttgtttgatactctttcgttgaaaattggacattttagataataaacgttaccaattctggatttttgtctgaaaatttttaattgtgtcttattgtaatatgcctgagcagtagctgtaggatctgtctcccttgtggtgtgcagccactgatgtctatgtattttaattcttatttttattttttgcttgacttccttgggcccagttctctattttaatggctagccaatgatttggaaggaggttctgtgaagacatcttacacccataggattccactatctactgatcaatctgttcaggttgaggtgtgtattcaaagtgcagccagttctcaagttctacttggcttcctccccactgtgatttgggggctcttttctctgcatgtgcatagcttcctactcagccaggtgtatgtggaaaactcatttaggccttatttgactttctcatttctagggtcaacctgttaaatttgtcagtgtctgacaatttccccagtaagcatcacaactgcactgtaccaaactgtgaattgtggccatttgtaaactaccaaatttgttatttcagttgtcaaagccacaagtttatgctactcactcctatttgattccatgccatcagatatcaaagttgttgggtttcgtgtcatgttcatgtgaacaaagtaagtaatttcatcgaccgctgagagtaggggtggaaaatgggaataaaatgaggtagtaagaccataaactcctactgttcttacccaaagttatagcagtttttgaaagacaacacttctcaatttatagtctgcattaggttgactatgaagttcccaaatcattgttcgtgactgtttatttttcagctttatatttgttttatgtgattaggatttctttttcgtatcattcacttcatgacactggtagataagaaatagcaaaaaaaaattaaacttttaacttaaggatattaaaattaaggaactgtttaaaaatgcatggaactttttttgagaaactaaaaagattatatatagtcacgagggaggcactaactcggcctgaagaggaaaggaaagggaactgttatattaattattaaacagtggttatatgtacaagaatgcctgagaggagatgtatcctttggcaaagggtcctgttccaaccttagcagtctctgcagggacagagttagaaaatatacagcatcatctcactctccttcttccctttgcctctgagtagtttctctgatagaaggacttcaacaggaagctacagggcaaggacatttcttcgtgagctgcataaaagtgagaatcccagacagagaacagagggtaggaggattaaaattatagttagtgtggggaggggtagggaactgtagatacacagcatacttcgtaagtaccatcatatttgattgttttcactgctggattataatcgatttgctggaaatttttattcagaaaaaaggcataaaataagtgactatgatatttattctattatacaccatagtaaatttatatttaaaagcattgaagaatgtattttgcttttactactgtgatacccttaatatgttgaataagccaagtgtggtggtacatgcttatagtcccagccacttaaggaggctgaggtagtagaattgctggagtccaagagtttcagtttagtctgggcaacacggagagactccgttttttaaatttactttaatttaattttttttgagtcagggtctcactctgtcacccagtctggagtgcagtggaatgatcttggctcaccacacccttgacctcctgggttcaaacaatcctcctacctcagcctcctccatagctgggactacaggcatttgccaccatgtacagctattttttgtggagactgggtctccccatgttgtccaggctgatctcgaactcctgggttcaaacggttcatctgcctcggcctcccaaagtgctgggattgcaggtgtgagccaccacacccggacaagaccctgtctttaaaacaaacaaacaaaaaaatctgaagcacatgtgagagcataatgttcattgtagtaactttacagcaaataaaattaatgcctaatattgtattttgtaatcaccttgtcaacctttgtgctttctaagagtttttgaaaacctttatctccatagtaacagctggaagatttttctaatgtagtgaaatatacaggatcttttacacattcttcatgcacagaaaaaaagtatttcatttaaaaatgtctttagatctagtagaatccttgactactatatgaatgctctaaaatgtactcacttgtgttactaaacatataattttattaaaatgctttctctaaatttctcttcataatacattacatttcaagtaaaaggagagagaattcagctattctcctttgtcacttttcattaattctgtaatatgttagactatatattagaaaagaatgttccaccttcagttttctatgtgaaatcagtgtgatattaggaagtagacagtaggctagcagttggaaaattagagtcatagttatgttccctactatgcctatgacgttaaaaagttctggtgtatgtgctttactatgtatatctgacttattttctatattaacttgaatacaaagccaagatttctaactgattaaatagaagtccaagtaggtgaatttttcaggacgtaagagcaatagagtcgtgggcagtttcaggtagccatttagagtctggactctataggtgtagcatttaccttactagcagttgcacatggagacatgaatatcttgcagcagatgtgattcagaaatgcaagcaataatttagttgcagagttcaattcttcggtggttaaagaaatcggtaataagatgaaagccaagtgtacaggaaaaaaaacactagccaggattactgaggttaccaaggctgcttcttagacatataagacaaaaagtgccccacttactaattgaagaagaaggagaagagcatctgttaaaatccaagagcaatattagaattcaataatagaaacattgcaaagtttatggtgagtctccctttcctgctagagtgcaattcaaatcaatgttttctgcatatagaatgcatatgaaagacttgggtgaagttcgttttaagcctgttgtggtgagactagaaacgtagggtattgatggctcaaaatttcctgagtttagggtacctttattttgaaatttggaacaagtaaaatatgtgtcttccaacaaaacatagaatgtgtgccttgaactgatgtatttatcaccaggaatgcccttagagggcaatgataaattgcaataacacttttgaaaattcaaaagaaataatatgaatttaataatttaagttttaattatgatcaggtgaagtacagagacagaatgcaggaagatacattttagctatactctttcatattctaatgaattgatgaatacagatattttgggaagcacagatatcatcatttacatttaattaatctgcttatgtttataaaaacatatgttattcaaaatacacatacatggctggtgagtgtgaattgttatataacttttggagggtagttttgtgctgagtatcagattttaaattgcacacaccattttttccaactcttctttttagaagaagttttttaacaaaatattacatgtaatagaaaaatgaagacaacataattgtcttcattataggaacgataacataaatttgtacaatcactccatagattataccaaaatccttgagtaggtctatatgtgtaaaaataaaagttgtaaaataaaacactcacacattcacaaaataattccatctgtttatgtcttgttatgcctatgaacacaagttttgattcaacttttagaatgatgtctatgagattgtacaccctgagtggtcctaaaacagacactggagctggaggagagaaagaactaagcttccatattttattttgtgtatttttatatgtttgacttatttttaatcaacatttatttagatattatttaatgacttaagaaacaattgaaaataataacatattacatacaatttattacaaaggaataagaaaaattagatgggatatatattttttgtggcattgtgattcttacagtttcaagtaaattgtaactcaattatattttgagaaaatgtgaacatatttctgaaacatagaaaagcattcaatattaagcttgaaatagtttctttctagataagaaggcctacaattcctacagaaggagaattataccatttacagtagcaaggaatcaagagatcattttattttaccatctaaggaaaatttctgggttgctaattttactttatctaaaaaaaagaaattggatatctaatggtagatttaattggagtatgttgtgacaaattgacgtatagtagaatgctatgataacatttgtagttatttttaactactcaatgagcaatgacctatgttgaaatttgcattttaattatacaatcatacccacagaagcatgagtaaattttaattatagtttgaacaatatgcacatttagaagaatggctaaaatggatgtgctttatatgtatttgtgtcaattattgaaaatgaaatttcaaaaaataaaatttatttggatttcttacattccataaaataattcattttgttccattagcaaaaccatgaatgcattatacataccaatgcatatgttaaatatatcaaaatattaattattacttaatacaattattttaaacatttctgattatgtaatgttttaagataatcaggggtttcaagaagtagttttttcttttttttttttttttgagacggagtctcactctgtcgcccaggctggagtacagtggtgcgacctcggctcactccaagctctgcctcctgggttcaagccattctcctgcctcagcctcccgagtagctaggactacccgcgcctgacaccatgcccagctaattttttgtttgtttgtttgtttttgtatttttagtagagacggggtttcaccagtttagccaggatggtctcgatctcttgacctcatgatctgcctgcctcggcctcccaaagtgctgggattacaggcatgagccaccgtgcttccttagaaaattagaagttaatgaatattgaatagttgctgatatttcttagaagaaaaaaagtatagcagctgaatggaactgtggctggaataagaaacatggaagcaaatacttatcagcttattttgacatttagtttaattaaagcatcttaggatttccatggggagaaaactattctgctgtactttctataaagaccttgaaaaagcaggatgaggaggaagcataaccgaatacagagacagtcgacaacatgtttctactaggtgaccagggacttgttggaagtagagggataagaaatcatcatgccataggaactctacaaaagcttccagtcactcttagaataatgttcaaagcctttacaagaaagcatcagagtgcatcaagagacagaaatcacaccagttatttaactagagagaacttaatgtaaagaattttacctagatatataacatgttaaatacgtaactgaaaaggtgaaaagacacagctgacttgtgtgccacaaaaatagcagctgtaggaaacagacaccacatctggggctgcaaagatacaggaaagaggcaacgcatttgtcagtgttctccagagaaacagaaccatggcacatactgatcaatcaatcacttgatccagacaaattttaagaaattggcttatgtgagtattgagcaagtgtgaaacctgtaaaacaggccagcagacagaaagtggaggcagaattcctgtattaaggcttgagacacaatttcttcttctccaggagttctcagtttttgctcttacaacctttatgtggtttgaagagccctgccacattattaagagtaacttgctttacttagtcaactgattgtaaatgttaatcacatatacaaaatagtttcacagcaacatctgctctacggtttgaccaaacagctagcccagatgacatataaaattaactgttacagtaagaataattaaaagaataattaaaacataaaaccttagataaagtgttttaaggaaatgagattcgggcttctaagaaagagaagtcggtacttagctagtgctggtgtccctgagctcagagaagggactttatgggtcagggtcatagacttgtgtaaagggccactgacactatccctgagatgagcatacaatgaactgggttctgaaaatgtggaaaaaagcaagaacaggattcagctgctgctacagaaaggaattgccactgacaaggtgaaaaagccttgctggagtgatgctcacaggaagcacgagcaggcaggaagccacaggcaggcaataggacatggatgagaacaaccaagtcctttttcactctttcagtctctctcttgagccctccccctcagcttctcagagtgcacacagccaaagccaatcaacaagatgtcaccagtgtagtggacctgtgtttcatgtgcagaatgattagataattgtgcctttctgtggaacatattacagaaaatgcaggagcattaacagaccagaggcaggattgtggcagatttactccgtaaggctttaaataccctgccttctgcatatcactcagcattagtgcttaactattctcttcctccgtcacgcaagccccagctgtagtgatctacttgctacccatctacacaacagctgcattcccaactcagggatgtggcatttgcttttgcctcagctcataaagcttttctatcagacaggaacttgattcagtcacttgcttcatttgtttctcagcaaatgtcacccctaagctacatttttccagatactgtatctgagatatcatctctattgtcctgtgattgtttatctcactcatcctgttttactactccgcataacacttatcactgcctgaaaccacagtatacatccatttactcctttattgtttacttgacctgcaagaatacaagcttggaagggaaggaacctgctaatttatgttcactgaactttgacctataactgtgctttgcattttttcaatcctcagttaatttgttcaatgagcaaatgaatcttggcatgcataaaaggttaatatgaccacaccaattaagatcaagtaagcatttcacacacacacacacacacacacacacacacacacataaataacgaaaaacaagaaaaataataaaaatgtgctccactgggaaagctaagctgagctaagaaaatataaggcctgtggaaacagaaatcttgttgccctttcttcattgtactcttgaagcagaatgagccacagacaaaactcctcagacaccaagttaaagaaggaaggggtgtattcggcctggggcatcggcaagactcctgtctcaagagccgagctccccgagtgagcaatccctgtcccttttaagggctcacaactctaaggggttcccgtgagagggtcgtgatcgattgagcaagaagtgggtacatgactgggggctgcatgcaccagtaattagatcggaacaaaacaggatagggattttcacagtgcttttctatacaatgtctgtaatttatagataccataaccgattaggtcaggggttgatctttaactaccaggcccagggtgtggcaccgggctgtctgcttgtggatttcatttctgccttttagtttttactttttctttctttggaggcagaaattgggcataagacaatatgaggggtggtctcctcccttactctcagtatatggaagaaagtctggcagacagcaacttctcaattatgaattaatttaatttataaaaatgaaagtgaaagacattacttatcttcgcctaagttgttatgatgtttgcattaaactacttataattttgtgatttccacaaagctgcaaattacaagtaactggaatatagtcaaaagagaaacaaccagtaccactaccacagcaatgacaaaaacttagaaatacctaaatatacctgtaactgttcctttgttctcccctaatattttttctgtgtatttcattttcaccaagcaattttactttctacgtttttatttcatactgaaagtattttcttactgttgcatgcataatcactattttggtatctacatactattcacattataattctaccatatactacatttatctctatggtaaaatgtttacttcaagaaaaaatatttgactagaagcctgattagttttctctcactgctataataaattaccacaaaccaagaggcttaaaacagcacacattacataagctcacagttctcaaggccaagattcctgaaaaactaagcttgtttcacaaggctgcaatcaagttgtttgtcagactgtattctcatctggaggctccgctgtggaagaatttgcatccttgcccattaggtcgttggcaaaattcagtttcttgtagctgtatgactgatggcccagcttcttactggttgtcagttggagacctctaaattttacagaccaccctcaattctctgtcatggggccctgtatatatagagttcacaatatggctgtttgcttttcaaggccagcaggaaatgcattttagagtgtgctagcaagatggaattatatatgtgtatatgtgtgtgtgtgtgtgtgtatatatatatatgtctatgtgtgtgtgtgtaattaaatgatcaagtgacattgatcactgcccaaggacaatcactataaacatgcattttccctagtctgtcttgtgcatatggctgtttatttttctgtttcctgctatcatttttataaaacaatgttttgttctctataatttaagctttatattatgtgcaaattttgattttctatgatagagcatcaaagtggttctgctattattagagcactatgctgaatatcatggcagatgaaaatgttctacttctcagataagaatttaagattcactctaggaatagattttattttaagtatgatgaatattttaatttttatgatagtaatagcaaaattagattcagaaagggtgcttacacccatctggagtacctatatatgcttaagtacctatttatctgctttctgttcagtgttgggtgctcttattttaatttttaaatattttcccaaagtttttatcatctctgggccattataagctacatggctcacaggggccgggcaaggtggctcacgcctgtaatcccagctctttgggaggccgaggcgggcagatcacgaggtcaggagaccgagaccatcccggctaacacggtgaaactctgtatctactaaaagtataaaaaattagctgggcgtggtggcgggcgcctgtagtcccagctactgaggaggctgaagcaggagaatggcatgaacccgggaggcggaggttgcagtgagccgagatcgtgccactgcactgcagcctgggcgacagagcgagactccgtctcgaaaaaaaaaaaaaaaaaaagaaagatacatggttcccaggaatcagagtcagttgccttttacccatgctactaagactcctattatctttttcctttcatagactcctgatttaacccctttctatttgaaatatattggcttctactcttcagcctctcttccaggcatgtctgcagaaaaaaaaaaaaaaagcaagcatgattctattagttttgcattgcagccatatcaaattgacacaaattcagcagcttaaacagcacagatttctcaccttgtgttcctgtaggtctgaagatgcacatgagtctcattgggctaatccaggtgtgggcaggctgtgctcctttccaggggatctaagggagacttgtttcctagcttcctatgactggcatcctgctgttcttgtggttgacgatctgaggtcccgatttcctttctggctgtcatctgggggccattccaagactctccaggttcactgcatcccttgtctctctccatctttaaaactagtgacgtggggtgagtccgtctcatatttttaatctctgctcatttttctgtcacgtctctgatggattcttctgctttcctctcccgctgtgaagggtctatgtgattggatggatcctacctgaaattcagggtcatgtcagcagcacaaactccttcatcttaatcacacttgaaaagtccctttggcacctgtaggaacacagtcccatgttctggggtttgggagacaggcatgtgtcaggcgtactattctattgctgtgatgtaggagtgaagagcacatacagaattcagagctagacatagctccagatatttgctggggtgcctcagagagagtagctaatttttctgcacttccacgttatcatctatagaatgggcataatagttccagttaagagaggtaaacaatgaacaaatacatatttacaggagaagtaacaggttgttccatgtggaggagactgggtagcaacttttgcttgtatattaaataaaagtctcactcaaggagttatcttttaaactgacttctagatagaagtcaccagcttgggaaagaagtataagaagggtggagcaaccctgttcagaggtgaatgatcttggcctttatctagaaataaataaagtgattgtggctagagaggcatggatgatagaaagcaggatctctggtgagcttggagacataggctattgccaggccatgcagaatttgccatcagagcaagggggttggaggcaattaactgaaacagaaacacatatagttatgcagggctgtaaccataaagagataacttttttttttttttttgagatgtggttagagttttacattctataccattttcttttggtggagtatagtcataattttatatgttttttactctatttttctcagatctttcaagtaaatatagcattttttgagatgccacactggtcctaaaactgaacacaggctgtgactcagaccatgcctccagggagatagttcacactttcataggcaagataaacagattattcccacatggctgggctgtcactaccccaagatacggccttacaagcacaaagtaggtgattcatgaagtaacatcacaagtcctccaacaacaggaagaggtgtagaagcaggggaagaaagttcttgttatttccttttaatattttgttcagacaaatttaaacagactttgctaatgtttgatagccattattagcttagagttaataaaaagcaaagatatcaattgctttctagttatttttagagtagagcctcgataatacaaacaatgaaataagtaagcactaatacaaacttaggtgtttgtccaaaagaaactattgatttgtaattcctcagcctgagacagccaacagacaactgccaagcctcattaatgcattatcctgacaagtctatatgagccactgatttgtaggtaattcagtacacatagatagcttttattgatttagaaatcaacttggaaatgaaatttagcatcatgataacctataaatatttgattttattttagttgtataaaactcttagaaataattagtcaataaaataacttttagaaataattaatgacttgcactaaatgaagagtcatatatctctgatttcatacccagatgctttctgtcttctttcctctgctccagccttgctcctatatgggctaggtgtcaaatgcactgagggttctcattctctgagactttgtgctcaccctctatgccagcagtgctcttccacctgatatattcatgctaattctccaacttgcctcaagattttcctcataggtattgcatctgccccaatctctctgcttaccctattagcaactaccacatcccatatgctgatctactcttctctcctgtagaacattaaaaactgccagtggaagaaagtttgtcaatgtggttcaccagggtatcctacgtagttaaaatagtgcttggaaaataataagtgtttagtaaacacttgctgaatgtaagaataaatagtgttccataaatgatgctaataccatttatattacttccaaacacctcaacttgtatagaaacagttaatgtttaataacatactttgataataatctgtaggtttttttccttaagtttaattgttatagaaaacttaatttagggaaaatagtgtttgaatgtatgatatgtattttgtccttgggaagctcaccattaaagtttatgtcttaaggtagtcgtttagttagggtaaactataagttctctttatttgtaaattaaccataatcaatttacatttaaaattatattttaccaatgacatttccatatttctgttgaaattgtgaatctgaccattggtaataaagaatatatatgtaaatattaaattaccgataatcatacagatagttaatagtgtattacagatgagattataataaaaaaggtcggtggtaacattgttgctttcttgtaatttcaaagacattagcagatgaaatttctaagaacataataaaatagaaatctttaaatagttaggagttttgaagatttcagttacatcttctcaaaggtaaatatgtctccttataatgaattctttcaagatgaattaccgatgttttcggtgaaaatgttttctgaaattccatttataagtgtttttaaaaatttatttttaatgcacagaaatgcgactgacttttatgtattgattttgtatcctgaaacttcactgaatttgttagtctaacaatttttggttttgttttttgtgtgtggaatctttaggattttgtacatgtaagatcatcttttctatgaagagataattttagtctctcctttacaacttagacacatttattctttgtgatcaattgttctgacaaggatttccagtattatttttaaaagaagtggcaaaagtgggccaccttgtcttgtttttgatctgagaggaaaaaatttcagttttcaccactaagtgtgatggtagctgtggggttgttatacatggcctttgctttgttgaaaaaatttcctctttggcttctatgtccagttttttgattgtctttgtcataaaagggtgttgaatttttcaaatgtaatttttcttcaatttattttcttgtagaatatagttgatttatataaaaacatctgagtatcttgtagcaatgaagttctagaataggaagaacctatttaattcaatgatcaagaaattcaatttccagattccatgtccctgtatgtgcccatttctaccccacaaaaacattttcagaatgttcacaaactattattcttcacatcaattttaacataaaatatatcatgactttttgaaaatttctttctctatatcatgaagtatttgaaaatatttgtttttatatattgattttaaaatcaatgtttttattatgaaaagttgaaaaatacatacaaataaaataaagtgttggtctcataatatcaacatacagaactagtaatcttttaaaaatcatggatttgttttgtttatatcatatgtaatttttgttgagatcatacttttgtttttattatctctttttttaaactcttaaaattatactcaattactttattgtgagatttttcccatattcttttgaaatatgattttcagtggttatgttaagctatctggaagtaatcctctattaatgtaaattcattttttctatattctccctcttacaaatactaattcaataaacaggcttttgtgtttggtggtatggatttctaataatttccttagaaattctctaacagtggaattcttgagccagagatgattttctcatggctatggttatacacatagtcatatatcacaaagctcctaaagaaatataaaaaatgtttctttatagctatgttagagtaaccactactgacatttaattctaatgcctctcactagaattcatgcatttactctcctttggtgagataatttagcttttgacctctgaaagaaaaacaaaaaaaaaaattatattttttttcaacaatagcaagtagctttttataattttgtttggcagctctaaaggagagttttatctgctcatatgtcaagaatttctggttgttattgggtcactaaaatgaccaaaatggccctggatgtcattttaagtcagaagaggcataaatggaatttggtacttgaaattctcgagagaatgaagccaattccagctaagaaagttaccttggtagtactgctactagaaatataatggttttgatttaaagtagtctgaggcagtattgacatctctttattgagctatagcactctagccttgaaaaagtcatacacgttttgtgaactaacctccattccttaacatcaccgtctttcaagtttacagtacttagttcatgcattgcactttcacaactaactccattatttgtaggttagttttttctatttctgaaaaatctatactttgaaagctttcttgaaatgacaagaagtcaagttccaacggcattgaggttcatactgcaagacacaaggaaagtgactctgtcttccacacggagacgttcatagagtcaaagaaatgtcccttcctctacaccttctcttctgtggtccaaagtactcaatttattttcctgttttccttggcacttgctttccaaaagcttcagcatttcttttgctcttccctaatcatacattaactggtcaatttctctattataatatcactacagattaatgataataaccaagggccttgtctaagctcttcacatatattatctcatttaatcccatcacatgtatacactaagttcaatgacctcaacttacaggtaagaccctacagcacatgaaggtgaagaaactgagcagaactacatgggtagttgttgacatgattagctgctgggctttatcaatacatcctttcctaaatttttctgcaggcattgccccagatgtggcagatcaatgcagatacaagaggtttcccacttccctttttgtaagcactgtatttaatgaacgttgtgaaggatgctgtcagcagttctgatgactatgtcaagatgaagtcatgggtatactgatcaacttggtttaaccatcccataacacatgcatatagcaaaacaccctgtagaacaccataaatatatacaatttttgtcaactaaaaatcaataaataaggaccaaaaaagaacaaatcatttgcttgttttgatcattgtcagttacttttgtttctgaatcatagattatcatagataatcccactcacacttgtgaagtcaacttgctaaaagtaaatgaatactttaaatactcttaaatcccatcactttgtttcagtatgacaaaaagtattcaattcttgcttttaaactccaattcattagcgaatattcccaactttgtagcaaggcagttttgatagaatattttctgttttcatctaaatttgtcataaaattcttaaaaatgacaagagttttctgatatatgtagatatgatacaggcagttggaatagagataagagtacatatttattgaattatttttaaaactccttttggaagatggacaccccatgtgtgctttccttcccagtgagactatggtggtggatttttttacacagccaaaagatacacacatggcttcaaaccgattatataagttgttcaaagttttttctgatatgagaattcaaacccaggtttgcctggtctgccagcatatgcttttttgtaatattcttctagatccgtgggcttcctacatacattcttgggcattactatgtttatgagaatatatgtgctgaacttcctttatataacactcgttttactatgaatttcttcttggaatctatcaaaatatttcaaaaggatgatgagaatatttgttgcaggcagttactgaccactcattgaagtagacaacaaaggcagaagtgcaagtggagattccatagttcaatttgagaaactagatacaatgtgttattggactgtcccaagaccagctcggttgaggagaccctaacccagtagcactagatgaaataaagacacacacagaaatatagcatgtggagtgggaaatcaggggactcacagccttcagagctgagatccccaaacagagtttgactcacatatttattgacagcaagccagtgataagcattatttctgtagattatagattaactaaaagcactccttacaggaaacaaaggaatgggccaaacaaagggattgcctctggctagttacctgcagcaggaacatgtccttaaggcacagatggctcatgctattgtttgtggcttaggaatgcctttaagcggttttctgccttgggtgggccaggtgttccttgccctcattctgataaacccacaaccttcagcgtgggtgtcatggccatcaggaacatgtcagtgcagcagagattttgtttatggccagttttggggccagtttttggccagatttgggagcctgttccaaacaggactggaaagggcaaattcttttaggttattatttatgttttatctttttgagtcattgtggaaaaaatatatatatattaaggtctcatcttatatgtcattacaatccctatttatttttcactattgatgttgatgtttttatttgtgtattgattttgtcgactgcacagcttattattttaaagtggctttcttagcatcatttaatcctttttgtctgacttctactttttctgatttaaacacctctcttcattttgttccatttccaggcatgactgccattgctcatctttgtattttaaactttcctgagtcactttgttttctgtgattttttgtaggtattacaaagttgagttttgtttaatgactaaaactcaagtttatattttaacagataaatttacttttattctgaatcatagattatcatagataataaaaaaccatcatgaatggattaaagctgctataaacaaggcttgcaggagtgggtcctctcttgctcatctgtcatgtgaggacagagtgttccttttctatggaggacccagctttcacaacagcattttggaagcagacaaagtgggcccagctttccagagccttgatgataaactttccagcctttagaactgtgagggataaatttttgttctttataaattccccagtgttaggcattctgttatggcaacacaaaacagacacaacatcaattgtacttctagtcaactggctataaaccagggttcccatgaccccaccttcaggtttgattaatttgctagagcagctcccagaatgcaggaaacattttacttctaattatcagtttattataaagaatgttacaaagtccgcagatgaatagcagatggaagaaatacatggagcaaggcatgagagaagaatggagcttccatgtctccttcaggaacatggggtgctaccctccaggaacacgttcagctatctggaagcctttatgaagcctgttcttttgagttcttatggagactgcattacataggcatgattgattacattattggccattaatgatcaacccaaccttcagcccctctctcctccccaggattaaagcatgggctgaaagtcctaaccttctaatcaagccttgttctttctggtaaccagccccatcctgaagctgcctaggggctaccagccaccagtcatctcatggaaacaaagatcaaatatgtatttcacagtatcactgtattaaaaaagttcatattttctttcttccagaacattactatcttatcatgttacattttgctctttggattaatgaagctacttttttttttcttttatgagatttttgtattgacctggctgactaaaagagtctgtccttttttgaaatttaataacttgattgatttaagcctcggaattgatttttccaatttcactattcttgaaacaagatgtgttcatttaattggtagatgcaaatcatcttatagtttgtgcatttttttctgtaattgtttgtttatatttgtttcctgttaattgttctgatcttatttagggtcactaatgatgtacatggagggtctcctttgcttctcttccagaactgtcatgttctagtcaatctttttacatttatcttttacttccattttttttctcattttctcagtcctgttgttcgttctttgagtgttcatcagaatctattcttgttgtacctttcaatttcaccttcctttatgtgaatttataaacttttgtttctgcttctcttctaaaactgaataagctatatttcttttcctttttgctttactctcttacttgtggtctttaataataacaagtaaatcaaaatatatgtttatttttgcttgtttactttattttgaagtaaaacttagaatgacatgaacaaatattgaggtatctttgttgtgttttcacaaattcaggtgcttgtgtaacacagttacctatcaacatgtagaatattaccagaatattcctgcataccctctttctagtgaattcgtctcttgctcccagtggtaatccatggtctgatttttttccccacagaaagacaagtactacatgatctcatttatatgtggaagctaaaaaccttgaaatcatagaagcagagagtagaatagtagttgccagagcctgaggggaaggcagaaatggtgagatgttgatcaaagggtataagctttcagttgtaagataatttctggggatctaatgcacagcatgaggactatacttaacaataccgtgttgctcacttgtggtatatcttctttgtttcattattctacagcagagatttttttcaaatttctttaatgtatacaattttttatcactattagattttttattgcaatattttctgttgaatatttttttgttttgaaataatattttctgttcgtcatctcctttatgttgtagtaagtttacatagagactatgcttgttccttcaaatgagatgatttttttccactcaaatctatagagaaagagataactcaatttagatattaggataattctctgaaacagtatatcacactatgtaatctaacaaatccttactgtccatactcagttaattgatacagaattctgttaagatacatggtgtttgctaatcttgtatgcttctcatgtctggaggttatttaagtgtgtcctcaatgatattgactaattttagaacctgagtggtcaaatccttaaaattaaaactggagcttctgttcataaaagattcttttgctctcctcttgttacacctctgtaagatttacatatagcatttattttagtgacttcagagtcatattggttgtgtcattacctctgttcatgtaaactataaattccttattttctctactttttaaaatgctgtatggtagttgatacatcttataacccaaaactatagggacgaccaattgtctgatgaatttagctactgtgtcaaaagaaatgcataacagtgctgcttcgatattataaatacatgtggcattagtacctaggccagggcctatgcaatgatagccatttgatgtttttgttcaataggtaaatcagtggattatttttaacatctggatagtttttcaattactttcaagattaaatttctattttgcatgttgttggtaaaaaattacaggtgataaaaggtaagtaggaatttatggaaaacctaaattatttatataatcttcatatttacccaagatcataaaatgaggcttgaaatattaatttgtgtctatatctgtatttttctattattgagtgataaagaaagaatatcatgcatttactctgctttcaaagagagaaagagaaagaaagagagaaaaaggtaggcttaccttagtttaaggtttttaagaaaatagaatgcagcaatcatatgccttgagctcttaaatcctaataaatgccatgtgtgataaaggcagcctaataattaatgccaagggttttggggttatgccaaccaaatcttttctccacagttcttcagttcttactggccaaatgtcctcagtagttgagctatactttgtcttttaattgcttcatctataagatgagttgttttaaaacataatgtgacttaacaggtgtgaatagcacagaatttattttatatataaatactacagaaacacaaagcacctcctctttatttatacaaccatatctacagccaaagtaatctcaatgtcagtcacctgcacctagacctgcaggtaatgtgatgagaactgatggaatttttttacttgagagttataccccaagaagacagatgaagaacagtgaattttctttatttatgtgcaagtgaaggacaactgtcaaacagcactctactcctgaaaggagagagataacttgtcctttggagactggatggaaaggatcctaggctctctgcctaaccttttggaatgccaaagactctccaaaagtcagatacatccgaaacgtctctgggttttatgaactagagatacctccaagatttctcctttgtgagatgtacatatccagggagaaagcttcctagttttccaggagacctcagggataaacctaggaatttagtctgggctgtaacctcttggccctcttacggggataggagaagtgttgttatcttttctgctcagatgagagcaattcactagaaaaatatctccagatgtaattcttatggtatgtaaaaagaaaaagcaatgtttccagtagaagtgaaggcaaatattcttgtctttttctgtatacatttcctgtctcaggaagctggggctttgtataagcacacacagaaatctagagaagtttcatttcctcacagcaccataaatgggaacaaatatttataatgtaaatgcaacaatttttggaacaccatttcttcataggcaccaattgttatcctgattatattacattatattatagagacatgaatctagtttaaccagaacccattttgtgtgcttgcctgagcaacattctttttatttttttggaatagtttttaacacttgattgacctcatcaaattaacagtgaatgactctgaatcgcaaaaccaaaggacttattcaagggggtgatcacatgttatataggcaaattcgagaaggataagtaaagagaagccccatgggtgagaacttttatatttttaaataatccattgataggacaactgttgtattctgcttcctttattacttctttaagtgtgatttaattgaccatattgtgtaattcatcctccttgatacataaagagaaatgtgatttgttctacagaaaagcacagtgtgaatctatggtttaagagacctattcatcccatttgcagtttaatggactgactctacgctctgtagtgcagacactgcagaaactttctatactgctggaatacccttcttacccatttttgatgattagacactaaatcaatgctcacgtctgctatattttactagtctagtttttagagttatttgaagcattaaagtaactcagagtatatgactatgttaagcgatttgtcattaggaaatacttcaaaatgaggtcacttgaaataactactgtgctgtttaggaaacacatttttaagcactagttaactttcacaaacataggatatggcagtcactaaagggcaaaacaggtcaaaatacagaagtgtcaagtacattatatttatatttatagttacattctagccttaaaggatgggtaaaagcttaggaattggggtaatatatgataaaatgataaatatcatggcatgtattttattttaatagtctttttaattttatttatttatttatttatttatttatttatttatttatttgagagagggtctcactctgttgtccaggttggagtgcagtgttgcaatctcggctcactgcaacctctgcctcctgggtttaaatgaaccgtatgtctcagaatcctgagtagttgggaccacaggcatgcaccaccacacccagctaatttttgtattttagtggagacagggttttgccatgttggccaggctggcctggaactcctggcctcaagtgatccacccaccttggcctcccaaagtgctgagattacaggcatgagccaccacacccagccctatttttataatctcttattaggttaagaaaaatatattttatatgctattactattatgaaataataaataagtaaaacaagtaaatcatgtatagctgtaaatcaaatattttaaaactagtaagatgcatgcctttcccaaaccaaaattctgaagactgttatattcaaaaagaaaatgtgattatgtggcaggggaaggtttaggctatcagtgtctatttgcaggcccaagatgtcagctgtgccataattaataaaggtcctttgtctctgattcaagaataccgtgtcttctaccagtacctataaacctgtgttaagctaacatattcacttgcaaaacctcagacctttcatggcctataacaatttgtcagtgcggctgaaatgctgatggagacatagctttgcagtagaaataaagatgagggcctcattaatcattaattggatttgagagcattcatgggcattagtaataaatatattgatcaaattgttccttcaaccaggctataaagctgtcttccatttcattgcctattaatgtggagtaatttgagaaaagggtataggaagagaattgaaaagtaagttcaaaaacagctttctgaacaatgtcttctgtgtttctaatggttcttcacgtggggccatcttgctccccagtcttgcagtcagtctcaggcctggtactctgaaattgctattaagagatttatctcttttcagacaacaggtacatttatgtttctgccctgggcattaaagcaggaaaattcatagccactctgggtaaaaaccagtggaatagttagaactttacctggctcaccagagagatgagagaacaggtgcataaagcttcctaaagatggataacaagggctgtgctcagaaaggaaaagaaatatgctctgcttactagcatgaagtgtctttcaacttctgggccctcatccctccctgccttactaccttgaccccagcttccttaaggaggaatatgaatgttgaggtgggctgtgcactaaagtctctgtctttaagaggaactgatacataaccatccaaacgagctggggaactttgtgtaggaaatgaaccccaaattctatggcgctgaaacaggtacccatgttatcatcttcctattcctatggggtgaggagtgccagtatttaatcaatgggatttgggaagtgttcacagtgtaggagaggctaatgggacattgctgtttaggcctattgggattccatggaaggttgttttttattcctatatctgtgtatgcagtagaaattgttgcattatatgcctatgattctctcttccataagtgccaaaggggagtctcttaattgagaatagctgcatatattcacaaagttccccatatgctgggcttgggctaccagtggttcagctaagctgaagcctagcagtgtccactgggctgccgcagctgtccagcctcagcacccaccatgcggagtcaaacactgacatggtagtctccacagtggacaaacacaaggctgttctcatggatgttgtcaatatacccctaaataaacctcattatatttttactgacatttaatctgttgccaatagcttagctgtttggtctgccacttggaaagctacaactggcagattaaagcctccttttctgtggggcggctaactgtggcacaaatcacctttgctggtcaaattgtctgggtcatgcatccggatgccctctgctgagacttgggtcctgtcttgtgcagttaaatctttgaactcatttcatctttgagcttttcaaacgtgatttttcaaccaccttgctttatcttattaagtcagttttttaactgaaattttattgaaataattgtacatttacatgcagttctaagaaataatgaagagaaaacctgtgtaccctttacctagtttctcccagtggcatcatttttcaaaactatagtataatatgatacaatatcacaacaaagatattgaaattgataaaaacctcttcatattgtttagcttttttgtctattttaatttttgcttgtgcacattggtggtatgagtatgtgtaattagttttgtacaattatagaacatgtttaggctcatatatccaccacaagtcaaagtagtgaacatttgcagccccaccctaataccttctgttgccttgtataaacatcctcatctctgtccccacactcttttgtaaccaaaaatatgttttccatttctacaatttggtcatttcaaaaatgttatataaacacaattacatattatgtaactttttggtattgacagccgcagtctgtacctttgggattggtctaccacagtagacctgtggtatcctgggccctagtggttcatgctcctcccaaatgtaaaatacattcaacctttcaaagctttccaagagtctcaccccattttaacgtcagctcaaactcccaagtttaatctaaatcttatcatctcaaagtccaaaatgtcatcatcaaaagcatataaatcatgtgcagatgagatttcttggcataatacactaagcactgcccctgggactcaatacctgtccctctatggatctgtaaaactaaagtgacaactttagtttggccaacaaaagccactttctcgctacttcctacattcgctcaaggccctagcactctacaatcagtaggtggtgaggtcagccagccttgtgtctttcccttaggggcagtgagttttttcaggccctaggctggtttagagatgatttccaggagccagggcctggagtcagaaaccttagaaatttacctggtgctctactctacggcagctgagccagcagccaaaatgcaagacaaagtcctttcactcttccttcccttttacacaggcagaagagtctctccccatggtcaccatcaccagaggcccacagggagtgcttccaggcaattgccgatgttcacttaaggccaggccactgacgagtccactcagcttgttgagaatgctgccaggcctgggactcacccttcagggaagtgggctcccctctggcctggggtcagaaatgccatccaagggccaaggcctataatcagagatcccatgagcccacttgatgctctaacccctgtggttgagctggtacaaaagctgtaagacaaagtcccctttacttttatctctgctcttctaaagcaaaaagcatcaaaactaccacagctaggaatgtgcttggtatcacctgaagccagcaaggctctgagtcttagccaaggcccacagtgagctctgcctgggtattgctgctgattgtttagggtccaagggctctttaatgagcaggtgatgaatcctgccagaatttgctatttctctttaatgcagcaggttctcttttggcccagagtgtgtctagaaatgtcctggagctagggcctagaatgggttcctcatgactctgcctgaggtgactactatgactgagctggtatccaagttgcaagacaaagtcctctttactctcccctctcctctcctcaagcagaagaaaggactctttttcagagctgtgagctgtgctgcctggggttcgaggacagatggtgcaggcacttccttagccaccctggctggtgactcactaggtcatatgccctcaaatccactggctttgagcccagcagagcaccaggacttgcctagagttacagctcttgtggtctagaccacctttcaactttatttaagaccccagagcactttggcacacggtagtaaagcttgccaaaactcaattttgtctgctgggatgtgcaattcccctgtggctatggcttatctaaatgcttcctccgtgggcatcagctgagttctactaatgttggcaggactgacttccaatgaaaattcccaaagtcactatgctctccttccccaaagagcacagattctctcctcttgccaagctgtcactgacagagtatggaggagaggtggcacttagtgaaacaattcaagattttctttctaccctctttagtgcctctttcagcagcgtgatgttaaaatcaggtactgtgtttgctcacctgatttttggttcttatgaaggtccttttttaatgtagttattaaatttggtgttcctgtgggagggcaatcaatggaagctgctattcagccatcttgctccattccaagtccccaaatgtataatgtcttaaacactatgtaagtgtttataactttttctcaccaaacagactaaaacaggtgttcttgattggcagtcaacttccctccatagcataattcagaaatttgtcttgtagctttaccatcttccagggtctttttgtcaaaagacaataaattaaaagaataaaatagggaagccttgcctgaaagtgcatgcatcatttcagctcacatcccattggtgaaatctaatcacatggtcatatctacctgcaaagaagcatgagacatgtagtacctttgtttacctaactgtatttgtcattttaatttactaaaattatctctaaatcttagtattttgtccttgcttgcttggggctcaggtgttttacgatgattaaaattttcttgttatacaatcatgtcctttaaactcatgaactctttatatagagtaggctctctcaattcatgagtttacttttcttatttgcagaaaaaatgtcccacgaagttaattcaattaggtaacctttcttgctattatttctgtatgataaaatttgaaggttctagtatgcccaaagtgaataaatcattattacttttaaggagcttaaaatatagtcttggttaaatggcttacccaaggtcataaggcacatgaattttggaaacaggcttaggtttcaggtatcctaaatcttcttccactacagtatttagtacaatttttagtatagtactctagtagatcactcactcctattttacctttgatccaagcaatgcgcaggattggatgcattatcttattgatgaaggaaagataggttacataaaatcccagaaataatttgaattgtttacgaatatatttaaattagtcatatcaatattttatttatttttaaaataatgtatctaaaatacatatctttatctgtataaatattattttattgttcaattaaattactgtaaggtacaagagttaattaaacatcaaatagtgtaattctctgtgagataagtatcttaaaccacaccaaatattaaggttaagttttgcaagaacatttcctcaacatacttattcttataactttgctttcaaaacatgacttatctatgtgataggtagaagaattacccccaaagatgtatccacgtccataccccaggtacttctgaatatgttaccttatgtggaaaaaggaagttgggtagagatgttacactggtggctttccagatggaagaagaagagaccatgctataaggagtgcatgcagtctctagaaactagaaaacaaaaagagatggactcatctctagagcttcttgaatggaatgaagcctactgatatcttgactttagctcagtaggacctgtttcatatttcatgtagaactgtaagataatacatttgtgctgttataaaccaccaaggttttgtggcaatttttacaaccacaataggaaatgaattcagacttaagtgtctgaaagtgaggtgccactataatgtactaagcctgtaattatttataaattatatattcaaagctatcatataataaaattgattttcctggattgctttctgctatggttgagtgaaaaatcaagaagtagagttacaaaaattttttctatagcactgggtgctccagtgaagaaggctgagcaggagaaaattgtgcctctatgtcttaacagaaaataccttacaaaatagtgatatattccgatgaagaatcaaagcagttacttttgaggttttaaggtattcttgagagtcttcttgagattctgtgaatacatccctccaccctagaggaggcggtgtgtctcagtagacattctttccaacagaagaaaaccctctcaagtttgccccataagtcactattttacctcactgaggatttctccaaaaatcaaatcatggagtttagcatagagtataacagtagcagtttttctgcaccaacaaaatatcagatgtctataaagacttaaatatcactatatgagcagattacatccaactagacccaaagctatcactgttttactttacaatggttagcaaataagatcattttatgctaaaagctgaaaaatgcttgttgctattgttttttaaactttcaaattattcaattattgaggtttatataatatcattttaattgtataataacttgttctaactacaacctgatattaagaaggagacattatttacacaaaagtaaaaactaagaataaaatggaaatacaagtttaaagttctgtaagagcagttcattattgtgttataaaataatgatagtgacagaaatgcttttcagttaaaaaaaaaaaagctatttctgtatttcagtggcttctttatttttacagtggttctttactcattggcttttaccagaataggaaattgtgactaatgcctcactatgtttttaataatttgcatcccttcatatgcttcttattctttaatacacatttctgaaatatttatgggtgtaaattattgcctttttgtttttctatgaacttgtttaggagaaaaaatgtaatgccattttagcagtataaattaaaaagaactataagaaatattatttgactttattgcttccatattattttcaaatatatatttgcctaaagtactaacacatatgttattgatatcaacagaattgtgtgcaatcatgcttataatgtcctacctgcagattaatacagattactgacagaaaaaaatattaaattacacctctgctacaataatgtacattttaaaaatacttatatttaaataatatatcaagtaaactctcagcctcagtattataaactgaaatgtgtaacaattaacaagccttaccttttagtatattatgattttgtaatgttcttggtattttcaacaaattattctaatgggtttattttctccataagtaattatcaacaaaaatgtccccatctgtaatcagtatttattaaaataggtgacatgataggttttacttttttcaggaccagttatcatatatatcctcatccttcagccacttctagttcttatttggtcataaaatttcttaagtactatcattgtggatttaaacacattctaattttaccaccaaaaaagaatttgacaaattgcttgagaagttgatttagcattgcaaaagaaaacttaattagatactatggatcaattaatttgcttaatgaaaactttagctgtctgaggaatatggttacacagaaagacggaagtatgacttcctttattgtgtatggtgcatctgcctatgaaaagaaatggcttttcttgatttcctctatttataccccaggctgttttcttccctccccactgtcctattctgaacatagtacaggttgaaagacttataataacaaggtcagtcatctacaaagcctctctttcctctagcttgttaatctacattcttttcaccttactctgctaattgaaagctggctttcctgcggagaattgtttgatcctgcagttctctcaagtggtatctgatttcatttcctgtttataatcttactaaacttggagatggataggtattcttcttgctcctcagtcttttcttcatgccttcatcacacacatatgtacacattcaatccaattccaccatccacgatctcagacatggacacctatctacccatcctggtaatgattctaatctctggatcattatcaaatctctaacgtttttctttcagtactttccatatgacaaaactgtacatgaatgtttcctggcctttctgctcttgatctgctcttctttgatgaccttagtcttcatgtctccttaacacattctcatgttcaaaccccacaccttgtcattaccagtaattacaatgtgaacataatttaaatttcaaacaatcttccctagagtgataccttcaaaccttccactgtagcccctcttgtgccccaagctcataatatcccaacttcaatttcctaatccatcatctttcattttagcgcattcatcttatgtcacttatccagcttaaattccataatcaagtattatcattccccagcatacatgctcagttcaattgcttctttactcttccttattctccctgaattcagactaactccaactttccttctgctatatgcctgaactcatttaactaaacatggctgaagaaaaacaaatagccatagtgactcatcccacattaaattcatgatcactgacctgaagtacacgcctaaagcaacctgcaattattctttcttcccccagtctattctctccatttcttttaaatacatttctgctgtcaccttaagcctccaataccactgtcctcatccccattctcaaaagataattctgcttcctgcttcattgagaaaattgaagcaatcggaggagaactgaacacatctgcccacttccctgcatctgtgttctgctgtggctggaaaggacctgcacgtgctcccagctgttgctgttgctcactcaagcacattgctcagcaggtctctcctctgtccttgcatttctctccctaatccttttaatgaccaacactttctgtgctttcatttagagagagcctatttaaaagacaggctatatctactgtctccaattagcctccttcccttctctcttgaatcaaatccaataacgatttgcccccactactcctgggcaaacttcttttatcaaccccacaaatgaacactgtttcactaaatcaaatagtcaattatcggtcctcgtgataattgagtcatccatgcatttgacacagctagtcgctttcttttcatttgtctttcatgacgtaaaaattgcttgagttttttcttacacctttgtggttctctcctcttctctattaccacacaatgtctgctgtcccaggaccttgccattcactgagtctcctatctttgtacacattcacagtttcaagactttaaatatcagtcttaaactgatgagacagtcttaaactgaatagtctatctgacaagactagaccatgccttagaactccagaatggtttatcaaatttatttcttcgtattttctatttctttctaaaataaccacagtcttgaaatgtctaaaactgagctcctggttttatctccaaagcagattttctcaaaatcctatcttttaatggcctcctccattcttctgattgcaaagatcgaaaactttctatcactcttaacttccatttttatttcacaccagaagtaaaattctactttcaaaatagatcgagttaaactactctctaaagccttccctgctgccaatgtttcaagtctctatcatctctcacctgctttgctacaacagcattctaaacaggccttcttgcttcttttctttctttctcttcaggcaagcaatccagtcaaaacgcacattaaattctgtctctcctctgttcaaaccctccaatggcttgcagggtgactcagactaaagccaaagatctgtcagggacctacaaggatgtgtgcaactgaaggcacattccattttatctcattatcaactactctcttcaaacaatttttcagtaaccataaccataatggactcatcatccccaagatcgtcctggcaagcccttgtatttcagccctatccttgctgtcccctcagccttgatgcttttccttcagatatccatacaggtaactcacttcctttaagcctatactcaaatgtcccattggtgtgatgttagggcaatcgcagctacaatttcagcccttcccagtattttctgtcttcttttccttgatttatttatttatttatggttcccccttaggattcttactatttaacataacatgtattttacttttatttttatattctcatgcttccaaagtagaatctaagttacattttcacaggtatttccatctatttggtttcctgctgtgtccagtgtttatgacagaggcttgaatgaattactgtattttggagagaatgggagatggagaagaaaaaatgttcaggttaccaatcatctgaaaatgtcacccttatatgtggacactgtagatgccattatatttgatattcctcttggcaaaaaaacaaacaaccttgggttttactccttctcatgaatcaagatggcctggaattatttgaattgtcagggaaaagtcaaactcagataaagaatgcattttagataacactgaaacatgtcgacagaaaatagccatcgtatttccttttagcacactgctccaagtctacctgctttcttatgctgacactggtgtctcttttttctttcctgattgccactctccaaaaggccctggcatagtcccaaactgcttaatttcaatgtcttgaaagaagcttttatagccagccctctgtggtgacaaatcagggtaattgccgtggtctccccatttgaggggctttgtgctgctgcagtaattgctggctcagcagtggttttcagggaagcagctggcaagaggggaaggagatggtttctacagctgatataaaatgacaataggctcatttgtaaactcgcaaccaactatgtgcccttcccgaaagtgaagattacttctttctgagtgtaacagagaactcgtggtatgtttagttcattttataacttcttttccacttgaagcactttttgaaatttatttgattaagattcctcttacagaaatattaacacaggaaaaggcttgcagaaaccggacaaaaataaaattatctgataaaatgtatatcagtgagtgactcacagtaacagcagggctggggaggggagcatttcctggaagggatggagggagggtttgcttgctgccctggagagccaagaggaggctgagccctggtttccgagagggtgaacatgggtgtcgcagagtatcaatagctttgatgagacctggtctgacttgttatttgaatggctttaagcactaggaatggtgctcctgaatggggaaccatggaaggagagtaaaggatgcctccatctttgaaagtaaatgagtccatcacagctcaactgcagggctccacagagggaatccaactgtgagacaggtgccctggatgccgagggaagatagcagtggagtaaacagtggttgcagtggccacgcaatgtcatcactatgggtgcatttttgtcagaaatctcctggaaacatcaaaagcagatgtctggatttgttaggtgctgtggacctcactgtctggaagaataagaggccaggtgaaacatgaaaatgattgtacagttgacccttgaacacttgaacaacacaggtttggacatcgagggtccactgataatgtggattttcttccacctctgccacccctgagacagcaagacaaatacctcctcttcctcttcctccttcttcccagcctactcaacatgaagacaatgaagatgaagagctttatgatgatccactccgacttaattaatagtaaatatattttctcttcatgattttcttaatcacattttctctagcttactttattgtaagaatacagtatatattacatataactaataaaatgtgtgtgaatctcctgcttatattttcagttaggcttccagtcgacagtaggctattaatagtaaaatgtgggggagagtcaaaagttatacattaaattttaactgtggtgtggtagtggtaggggatttctgtcccaaactcctgtgttgttgaagggtcaactgtaatttctgagatacatgtaccctcccttgatttagagacttgacattaattcttgagttctgcagggttaggagtgttgtggggtgacagtgctaacaaaccaggcctccttggcaaataattttaacattactctcttgccttttgtaggcattttggactgttgtggcctaaagaaacacttgctatgcccaggtgctttttttttttttttttcctacagatgaggtccgctatgttgccgaggctggtcttaaacgcgtaggctcaagcgatctgcccaccttggccgcccacagtgctataattaaaggcctgagccaccctgccatccctcagctgctttcagttgtaacatttaaacttctgctagcacacacacatcaaagatcagaaaaatgttctttttaatatagaaacatgtttattttatagaaggttctataatgaaccttgaaacatatagaaaatatgtttattttatatatgttaacagttaaattcacttaattctttgctcctctcttcaattgtgtataaacttctggtaaactcatatattgggtttatcgttttagtttttctattttttatttgtaggtatccattttattattttgtaattttttttatataatttcctaactagccacctaatgtttgaacatattaagcatgatagttttaaagtctgtctggtccctccaaaatttaaatatcttatttgtgtgtggatttttttctcttgtccattttatcctctgtttttttaagttgtattcttatctccttgtgtggcttataaattttggttcaagaaaagacattgcatataaatatatagacataatttggggttcatagggatattatcttcctccagagagaatttacttttattcctggcaaaataaaataacaggtacaatttatctcactgtaatgagaggactaaggactgtgtgcttatgaagggctcgtggaacacttaggctgcaacctttatgaggtgttggttattactcatttatttttcctcctgtgttatattttgcctcatgtttttctctaggagggctcagaaatcaaatatatagtacttagtcctttgatactgctgggattctctgttttagcctctcggcaatgattttacaatgaggaaatgctgagggggaaagtgtctcggaggggatgcacatctctgagcttttcttttcccaggcagcttggctggtcaagtctgtgttgccttggtaacattgcagcactttgtaaaatgtttttgtactcgttaaaaaaagaatatttcctgttttaatcatcatccctgaagtagaattgatttgtaataaagtggtccaatatgtcgtatttggaaataccatgtttatcaagagcccatcatttctttttctctttcaagtgctaggacattttcattaatggtttcctctgtcttaagtaataaacacggttctcattaatacacagccttaccggctgttggaattataacataattagatggccttctccactaagcttgaggcagcatctctgtcctttggaaggttcattaaaatattgagaggtaggttccacccctaaagtttcttttgaattcagtaggtctgggttaagacctgagaatttgcatttccaataggttctcaaatgatgctgatgttgctggactggaaaccatggtaatattagattagcatgctgtccttcttcactttagctgaaaaaatttacagataaatttgtgggtttgttttaataaaagtaaaggaagtagtgtgctatcaaaattagactgtgagaatttgccattttttcagttttattatttattatgaacatgttgcaggttatgttgattccttcttataaaacacctgaaatgctccctccttcctattgtcttccaaaaactagggacaaatgtagaaatgtaattattatgatgtagatatatattaaaaactctttctaaagtttatatggaggagcaaaagacccagaaaaaccaacaccatactgaagtagaagagcaaagtcaggaggctcgtattatccaacctcaaatcttactataaagtgacagtaatcaaggtagtgttgtattcagtgagaagacagacaatatctcaatgaaacagaatggaaagccaagaaataaagtcaaacaagtatagttaatctttaaaaaaggaaaaagaatacaacaaaaaaggtgatgttttccacagatggtactggaaaaactggacatccacatgaggaataaaaaaataataatctagacacaaaccttacaccttctacaaacattaactcaaaatggatcatagacttaaatttgaaaggcaaataaaacacctagaggatgacataggagaaaatgtagatgaccttgggtatggtgatgacttctcagatacaacacaaaaaccataatccatgaaagaaataattaatttattggaccccattaaaggtaaaatcatctgctctatgaataatagggtcatgaacatgagaatacaggctacagactggaagaaaatatatgcaaaaggcatctgatgaggaactgttccctgaactacacagagaactcttaaaactcaacaattagaaaggaaacatccaattagaaacaggcaaaatacctgaacaagcacctcatgaaaaaaatacacacacacacatatatatatacatatatatgtatacacacacacacatacacacacaaatggcaaatcagtttcattctgttggggtattttgctagtggggcagctgtgcaagttagggcaagaggtagatgggagctctgtgctttctactcagttttgctgtgaacccaaaaccactttaaaaaagaaattctattgaagaaaaaataacaaactaaaatacattttaaaataataacaaataaattattgctgtgtaatacaagcttcacatatggggcatgttttgtgataatgatacatttaatttaaagtgaacaagcttccaaattatttatcttaaaatgatagatgtttggaagtcctcttgtcatttaatgtatttagggaaattctccttttaattctacttttttctaaaacatcctatttctattatgcctgtaattcccatttttacattttttttttagaaattaagagatacactgtttctttagaattattattttctgtgatactcataggaagaatgtactgaaactgctttatgtctcttcaactgcgtaattattatacccaagtcctggcaatgatggaaaaggaaaggtactttttggcatctgagaccaattgaaaagaactcccttttcctgtttggcatagtaaacgggaaggtgaatgtttgactgagagagcaaacatgtagatatatccctcacagatctgataatcccatttttattaggtatattctcagctcatttccaaagctaaactcagttcaaaatcataaaactgcatacagtgatgatatttctggaagaataatagtacaccacccttaatatttcagcctgcagcaaagtatagaggttggaagagacaacaaactcaaatgtcatagtcttaagagtctcgaacatattcttttttgtgattatgtacaccaccgcattcttttttttctttcttgccaaaacagaggagtcattaatagagaaactgtaagttttatcagactgaattaaaactagaaaccctgacttaattgagaaataatgcttatggggatataatttacaataactaaaatttcatcttattacaatgaccccagaatgacaatctaacaatatttgttagaatacttttttcctatacaacttacaaaactctacattatttgaataagatagtggtagaaaactgttattaatacacattgtatgacattttaaaaacaggatttaataaaatatattgtatatatagaaagttcctaaaacttaggcatacagtttaattatttaaaaaaaatcaaacctccataaacaagctacatgtcaaagagagtctattgttagccattgtgctgcctgctccctacttagtgcacaactgactttctctcctctcacttaactgttatcctgaaaggcttgataataatggtcttgctttgctatactacttttttctttccaaccatgaatgcattccaaatactatagtttatttgaatcaaatcatatatatgtatgactctatattggtttctttcagttaacatgatgttccttgagattcattcatgttgttccatgtaactataatttaataattgtacttactctatactcgtactataacacagcatgttactgtattcatctacataaaatatattggtggcacagtttattgatattttccacatcggcacatagttgggactactaaagagaatgctgctgtgaacactggtacacatacttctctagtgcacttgcatgcactgatgttcagttcacatgagaagtgaggagtccgaggtgggtgaataacttgaggtcaggagtgcaagaccagcctggccaacatggtgaaaccccctctctactaaaaatacaaaaaattagccggacgttatggtgcgtgcctgtaatcccagctactcgggaggctgaagcaggagagtcacttgaactcaggagccggaggttgcagtgagctgagattgtgccactggactccagcctgggtgacagagggagactccttctcaaaaaaagaagtgaggagtcagtctcaccagctgtgttggagcttttccattactacagttactcaccaaaatttatctctttctgtccttttaattgtagcctctttggaagataaacacaggatatacaacagtggttttaaattgcatttctttgatgagcactttggttgaatactttctctaagttgaataagccaaaatctcttttctgaaagcctcattaatgctcttgcccacttttctactggctcgtcttttttagttttagtctattattatcttatttttaaatttctattttttactattaatttaggttactcagtaatataatttattttggataaaattttatatttggcaacattgagaaatttacaaaataattttgtttatttaaaagttttgtgttttctatatataaattcatattatcaatgaaaatcatggacttgtttatcttctaaacctaacatttaatttcttttttttttctcagcacattgagtaaaagtagaaaatcattgattgttagtggtggtagtgtatattcctgtattgttactgatctccaaagaataatttaaataattcaccattaaatacatttttaaaaaatacaaatacccatatttggattataaatttaaaaaattctattttaaagacaatttctatttataatttaaagattctatcatgaatacatgttgaatttcatcattttttcttcgttttttgagtatgtgattttaatccttcatttggttcagattgtgaattatattgatgcttttaaatctcaagttatttatttaattaataaatttagacctcatataaagaatgatttaaatgtaaatttccctttttataaatattcttgtcaggtgctgttcctttagattcattcacattgttcactcattcatgtaaagttatggctggtccataaattaagttgggactgatcacccttttattctattctctggaggaccttacaagaatttagatcatttttaaaaaacaattagtagaaattaaaaagattcactagttcctcaagttttttgttggaatgttttaaattacagattacattactttaataattataggattctatatttaaaacaaatttctttctgcatctattctgacatttgtctaagaattaatatatttcatttcatttatttatttatttattttttgagacagagtctcactctgttgcccagctggattgcagtggtgccatctcagctctctgcaacctccaccttctgggttcaagtgattctcctgcctcagtctcccgagcagctgggattacaagcatctgccaccatgcctggttaatttttgtatttttagaagacacagggtttcaccatgtgggccaggctggtctcgaactcttgacctcaagtgatctacccatcttggctttccaaagttctgggattacaggcatgagccactgcgcctggcctctcatttaaattttaaaagtaacttgcaaaatatcatttataagatttttaaacataattataatatctgtaggatctgatatcatggatattagtaatttatgctgatgcttgccatgagtatttacattattattctctcttaacaattattttttgttttgttgaatacctatttgtattttttttctatttcattagtgcctgcatccaatacttcctttttttttgttttattttggcttttgggtctctccttatctctcatactttctctctttcttcctaaactttttctaaattcttgatctagattcctggattacagatgttgagacttaaaaaaatgcatatatataagatataaaagcccaaggttagcctttgttgaatccctcaagtttgatatttcatatttcattgtattttagttcaaactattttttaacttcattttgttttcttttggggggtggatggattttcgctcttgttgcccagactggagtgcaatggcatgatcttggctcactgcaacctccaccgcccaggttcaagcgattctcctgcctcagcctcccgagtagctgggattacaggcatgtaccaccaagcccaactaattttgtatttttagtagagacgggatttctccatgtaggtcaggctagtctcaaactcctgacctcaggtgatccacccacctcggcctcccaaagtgctgagattacaggtataaaccacctcacctgggcttatttatttatttattttcattaaattatttatttttttgagacagagtttcgctcttgttgcccaggctggagtgcaatggcatgatctcagctcactgcaacctccacctcccaggttcaagtgattctctgtctcggcctcccgagtagctgggattacaggcatttttagtagagatggggtttctccatgttggtcagggtggtctcgaacccccgacctcaggtgatcctcccaccttggcctcccaaagtgctgggattacaggcgtgagccaccacaaccggccttaacttcatttttgatttctcctttgatctgtgaactatgttgcttaattttcaaatcttttggagggggatattctaattttttgtgaatattgctctctcatttcattctatttaggacaccacatgtcatttgaatggcaaaacgcatttaatacgtgctttatcacctaaatataatgatataattattataaaggtgtaatcacttcttgtcatttccagtgcacttgaaaataatttatactcaatttttgttgagtcaagtgtcttaaacataataaattaagcagattgtattaattgaattgttcaaaacctctatggcttgatggatttttaactcttattttatagttattcaatgaattgtgctaaacttgttctacaattatcagtttgttcatttcttttgttgtagttccatccgtttttcattttatatattgtaaaggtatgttatcaggccggtgcagtggctcaaacctgtaatcttaccactttgggaagcaaaggaggatggatcatttgaggtcaggcgtttcagaccagcctggccaacatggtgaaaacccgcctctagtaaaaatataaaaattagccggggttggtggtgggcacctttagtcccggttactcgggaggctgaggcaggagaatcacttgaacccaggaggtggaggttgcagtgagctgagatcacaccactgtactccagcctggatgacagagtgtgactgtctcaaaaacaataataagtaaataaataaataaataataaataaataaaaggtatgttatcagatataaaaaaatctaaacattattatgtctttttgataggtttgacactatcattattaaaagtcctttttatttctagaaataatgtttgccttagatctacgttttctaataccagtattgctaaatcaattgatttttggtctctgtttggtataatttttttattcttttctttacaaattttctgtacttttatgtcttagataaaccttacagagacagaatatagggtttttcttttgcttttgtttttattttatttatttatttatttatttagtgtagtgtaaaaaacttcataagaagcgaggcatgatgggtcattcttgcaatcccagcactttaaaagtcctagacgatcagctcgcttgaggccaggagttcaagaccagcctgggcaacatagcaaaactccgtctctacaaaaattagccagaagtggtggtgtgtgtgcctgtagtcttatcaggaggctggggcaagaggatcacttgagctggggaggtcacgttagagctgcagtgaactgtgacccccacacttcagcctggttgatagtgagatactgtctaaaaaaatatattagtaaaaactttataaggttgcgtttattctatttacctgctatataactaataccttgttttgattacattctaccaccttaccttgtgccttacatttttccgccacatttgtttctttttaatctcctttgcttttgcattgtttatgaaacaaactgtttatttttttctatatgtttattttgaagttttatacatttcactaacgtagttacttttcttttatacttctaataagtgattacctgaaagatcacgacatttgctaaagtttttactttacaacagtggcccagagtattttgtacgcccttgaatgttctttggatacttttcaaggatctagaaggtcaaaactattttcataataaaatgtagatggtatttgcctctttcactctcattcattcataggtataaagttaaagttttccagaagctaaacgatgtgtggtattacaggagagtaaatgtggaaacatatattataaatcgtctgccttctattaaaccaatcattaatgtacacgtttttttttcctgtcttcttgccagttttactatgctctttgctgtctttggttctctgaagacacatgccaaagtgccttggtgtgcttatatttatctagcttttgttttgtttgtcttctgaatctgtgtattgacttctttttatctatttgtgaaaattcttagccatcatctctttcaatatatcttctgttcattccctttcttagctgtgcttgggttgggactcaagtttgaagttttgtatttctcagtgtaacacctttttctcttattctcatatatgttttttccaaacttttgtctctccaatcatcattctagaccttttttactgagccatctttctattcactaattctttctttagctgctttttaatgtgttgttaaacccaactttacgtttcataaatatttatttgtctaatttctaaatggaacattttataatctattatctcagatataccctgatgaaagtttcaattttgtatcttatattcatatacatagcaaacttaattaatgtctgtattagaaaattccaatatctgaaatgcctaaatattcagttctgctgtctattgtttttattcttcatgttattctcctgatgtacttcatgaagttttatttccttatattcttggttatttttattctcttccaagaaacaagtcttatgaaaatatattgacataagtaatgttattgtcatccagaaagaatttccattttctttagtcaggagcctgacagaattccaggatcatcataaaccatttaaagcttggcattttctggatcatctcaatggcttaaatctgagctccagtcctggcaagggcttgatgacttctgccttaactttgtaattaggatgcagacatttctgatcctaagtaaaagcagagcatgtttactaaggcctccacatgtggaagattctggactttaacattttgatccaaacctgtgagactggccaatgtagctgattctctcatgtgacatttccgtgtagaaagcacacctatggcaaaagttgacccgcatttgtattaatgattaacctctctcaattttcatattcctataaatttttcctggttgtcttttaatagcttgtaaaacatctagtgctttaagcatattcttttccagtttcctaaggtaacattagatggtgggttgtctacattctctaatatgcaactactggaagtgtaagctataatatccttttcattttaactcctgtaattattctgacacagtaaatatatattaaactaagtcatagttttctttatgggatggttatctattaagcttcatttaccttttcaaaactgtgttgttatctgatcaactatacctggccatataagcaatacaaaataatcagttattatagctggttcttattatgttattattaaccagtgaagtctctatgtaatgcatatgttagtaacctaaaagattacagaatacattatataattaaaagagcaaggcatcttggttcaaattccaattctaacttatatcaagtttgattcatttgttaagctaatttatttaaatcacaatcccttaatttgttaattcagggactttatagctcataggcttattgtaagacaaactgagataatgagatggtgaataatccaattattttagagagtaaacataattaatggaaagaagatgagatctatgagtagacgacagtaatatttcaaatcttgcatttcaaattcttgcattgttattagtcaactgtcaccacattaatgctgcaaaacaaaccatccccttactagctggaatacaacaataagtatttctttctttctgaaagtaaactgattgtcattagccaccagtttggagctagctgggcttggtccaggtgttaagctgagctctggtctgctggcatgtgttcctatcctgggtatgagtttttcatgataatggcaaaagcacaagatactaagctaactctacttgcgacacattcattaatatcctattgatgatagaaggtctcatgagccaaaaaaagaaaaaaatatctaggaggaggacttaactctgccaaccataaagccaacgtaaattatatgaagtgggaggtatatcctcccgcacagagttgtgatgagaaagaaattgaatgccacatgaatatgttgttagaaatgtcatacttatttgttaagtgtttgtgtatatgtttgactctcaagaaaatcagatcataaaaagaggagtggctcatctcacaaaatctttgtttggaaatcgatctgcctttattaagcactagaggctaaagagttgatttcaatgccatttgatatatgaatacactagcataaattgtattcatctaagatcaatgattaaaaggagggcatttatcattctcccctatcaggcacagaggagaagtggtgtgccgccctagtggtattgccataagatgtctatctgatttgctttctttactcacttcaacattctgtattaaagcacattcccaattaataaaatgtcagtaattggtaaacaagtgcgatgcatcaatgaattctattataaataagtatttttttctgtaagaattgatagagtgggaaatataatccatggcaggttggatggcataaacacttgataaatgctggtagaaacgtataagaaattcttatgagaggtttacattcatttactgaagccaaatctggtttaatgtacttttttgcatcaatcaatttgataattttatgtgagtttttaatactacatgaaaaatacctaaaatatttttaatatttgcatctaaatatttttagatataagatatctaaaataagaagttttgacagttgattgtattccattttcttgcagattgtctacatgggctggtgtgaagcccgggagcaagaccccctccaggacagagtgtactccccgaccttcctggccctgaggggctcatgtctctacaagtttctggcacctccagtacgtgttttattgaaatgtattggtcgtttccatattatcacaagagattgacaccaacttaacagcaccaaatagtataccatcaatatttttaaaaaataatatagagaaaaagtagaaatcagtttatctgatttaacttactaaaatatatattctgacattaaacatttgctttaacacccttgaaaagtctggaacttacttctttataaatagtgaacctataaaataatggatcaaattataatgccattacaaatctcatgacgacatgggaaaggagattttaagaaacattttcaagcatatgtcagtgtattttgtttatggaataaaaattaaagaaatgaatatatcaaaagtgaaataaaaaagaataaactgttttagggctatacatgaatgaacatgtttactaaactcttattttccaaggatcttttgaaagttcttttaaatttattcagcacttttaattactagtaatttattattagcaaagaataataaggaaatttcaaaatgatagcatcttatctagctactattaagtctatctcaccctatggtaatcccataggatgatgttaactctcatggtgttcaacatttaaattagaggattctatccttggcaaacaacacaaatacattctggtaagctatcatttatgacaagtcgaacttgcttatttatgttgtacaggtctctctatataaaatcaataacattttcatcttctattatattctatatcctagttattgagatttgtactagatatgtatagatacctattgcacctcaagtcttgcttttggaaacatgtaccttgcagctcagaagacacttaataaatatttattgaatataaataccaaatgccagaccagtcacttgcaggtctaataatacataagatttagaaatcatcaggtctaacttgctgctgttttaaatgtctgtctctacacaaagtttaaagcactaggaagacagaggaaaaattgatatttatatattttactctattcctactctgaataatttatttgacaagacagttaaatatagtttccaacctaagtaagtgaaataactgcattatgctttgggtatgtttgcaatgtcacagtcatcttggaatttcttaatataaatgatgtatatttaaaaaatatagctgtgttgaggtctggtattctctgtatttaactagtggtaaattaaaaaaaaaatatgagtgtggaatgtaaatacttagtatttataggtagagaatgcgtatattatttaagatatataaggacactgggcaaatgagaactgttgcacataatataaatcatttgctgaaagcataagacaaatggtaacaaagcttggaaaagaggaaacaaaagcattatgtagggtcctttatgagcatggcttcacagatgagagactagatacatctgtgaaagttttttcttatttttcactatattatgcaaatcaaatacagtggtaaataactttctaaaacaaattaaacattattttcttatcttttaaaggtgaccacctgggactggacgagagcagagaaaacattctcagtttatgagattatgtgcaagatcctcaaggtatgatcaatatgtagtcagtatttgaatggcttttcctcagcaaatagtgcctctgggctcataagcagctcatgaaaacaaatcattcatggaatgaaagaagagacacgataaagacaaatgaaagagaaagaaaataaactggacaaaaaagagaaaatatagaatgcacagaagtgcactggcactcagctatctgcttaaataacttgcaagcagactctgcagtcccaccgtgggtgagggaacagggagaagctcctcaggagttcactggggaagaagaaaattcagttgaaagtagtctgaatttaaacgttggttgttaccatgtttttttttttaattctttttttctgaataaaatgcaaaagagaaagatttgggtgagacctggaattagaaaatatagaaaatatcaggaaaaatgcaaagaaaagttttgctgttttgttcttaatctcatggcttgaccatctttttgcatatgtaaaagaacattcgattgtcatatatcagttgaatttcatgccatatgcaggattattacaatatcaagccatcacaaattctataaaatgtcacatggtttctatagcgttttttaaagaattaaaattggaataacctataaaacatgaagactaatatatattcactttctactttagggtttgtaggcttggactcaccacagattgataattaaattcctgcataaggttgaccttgtttctgtatccaaggggagctaatttccctttgctttatgttagctatttctcttcccgttaaagacttagcagagtagaaaaatgctgaaacatttaaaatataataaaatgcatcaaaagtgtctgaaggcagagagacaaaaattataattacctcaaaattgtttatagtttctgttccttatagagaactttggattaaagctgaagttctctgaagtgcaaaatccagccaaaagtatagttcattgattgctcatcactgtgcatgctttgagttcttctgtaggcgtaatggtggaaggacaacctgaaatacttgagtgtattgttagtaaagaagggtctgacaatttcttaaacagaggctagtatctgaggaaaaggagatcatacacgactccagttttctgaaataattgccaaaatggctaatgagatagctttcttttttttggagatggagtcttgctctgttgcttaggctggagtgcagtggtgtgatctcggctcactgcaacctccacctcccaggttcaagcaactctcctgcctcagcctcctgagtagctgggactacaggcacatgccaccatgcccagctaactttttgcattttagtagagacagggtttccccatgttgcccaagctggtcttgaactcctgagctcaggcaatctgcctacctccgcctcccaaagtgttaggattacaggcatgagccaccgcgccagggcgaactgtgtatttttaggaaagctactcatgtaattaggggaagaaaagaaagaaagaaaagaaaagaaggaaaagaaaagaagaaaagaaaaggaaagaaggaaggaaagaaggagggaaggagagagagagagaaagaaggaaagaagaaagaaagagaaagaaagagagacagtaagaaggaaagaagaaagaaagaaagagaaagaaagaaagaaagagagagagagaaagaaggaaggaaggaaggaagaaaaagagaaagaaagaaaagaaagaaagaaagaagaaagaaagaaagagaaaaaagaaagggaggaagggcagggagtgcacagaggggagaaaggaaagaaggaaggagaaggaagggagggagggagggagaaggaaggaaggaaagaaaactgcctcaacaaatcaactttgtctattctctatctgtacactaatacaacttttatcatagtaataacgcaacacatatttatatattcttacttagacttaaattattttctaaccactctccaagtagctgcatgatcttttaaatcctctcttttaaaaaaagctatttaaacattagaacataatgcagtttactatagtagttaaaaaggataattttaaaggaaataataaacattatgtttagctctatcaagatatacaaacaatatgttctatctctttgttacaatttttgacaaagattatgcaattcatgatctgctattttgtgtaaaaatatgtcttgagatttttttctatgacagttaatgttccttaaaaacactgataactttttgatagatttcatctatcccatcatttgcttgtattcattgagtccactttaaaattttacatttagttttttcccccacttgttattgctatcaggcatatcacaacaatcattatttgaatggtttaatagaaaattaaatgtttgctatataccaggtaacctcagcacttgttatgtggctgagaaaaatgcagaaaaagccactgctttcattgagcttgcattttattaggtgatatgatgttaagtaaatcaataaagaagacaaaaatagtaagtaaataaatgagacaaaataataatatgtaggaaggactgatatttgctcagacttttatgcaaattcttatttcctttagtctaaattctgagctttggaaaccccatgtggaaaaatattttaatgtattcaagatattaaatccatgtgtacaaattgcctcctacaagtcatcttaacttatgcggccatcagaagtgtctatgagagtgcctgtatatttacattctgaccaaattaaaatcaaagactacttctcattttaactttctatatacaattttctataagccttagtttacttgaatttttttaatacttcaagttctgggatacatgtgcagaacgtacagttttgttacgtaggtatacatgtaccatggtggtttgctgcacctatccacccatcatctaggttttaggccctgcatgtattaggtatttgtcctaatgatgtctctccccttgcccccaacctcccaacaggccctggtgtgtgatgttctacttgggaaaatgtttacataggttagtgaggcctggcgataagtattctcatacatcaaatacaatgtaaatctaccttcaattgttgtatgtaatcaaggaagtccccctccccttagtaagtacaatgctggtgctttatgctttgtggcttgacattagacatataaagccatccttcaagcattccttttcccaaaggaaaatttcatgtagcatgagaacagaggagtggcttctagattcgatgctaatggattattttcctgcatgcagattaccttctggccttctcctgtgtcaggatcactggttgataaggaagccagtcagataggtggggcaggtgagcaaataagaaggggcatcttctacagcctaaatcagagggggagtcttctacagcccagccctctcctgccatgaggtatcacttctgatgcaagctgtgcaagttgtagacttctgcctccagaaaatggatccctcaggtgaggctaattaaaagtcagatttgaatgtctggatcacagaagaacttgcctgtgaccattaatcaggaaaatcctgtcccttctgatgtgttcataatgaagctacaccagtaataacaaaaatgaagcaataaggtttatctggtacatatagtttatatgtatgtgccaggtgttgtcctaagtgcttagtatatgaattcagtttgtatttacagcaccactatctgtcagttattgttattcccattttagagatttggaaactgaggcaaaaagcagtttaagtaaatagcctaaggtcacacagctagtaaatatcagagctaaagatatgaatcttgcaatgtgtcaaaattctgtgctcttgcacatgatactacactgtctctgtctctcagcgtaaatattgataatttgggaaaaaagatgggaaccagagagccagcctggtactgatgagagagcaaaggtttcagaaaaaggaatttggcaacaaatgccacttctgttactaaaacattaccctttatgagtgtattgggcactatgaacttcagttcttcatctgtgaaatgcagctatggatgcagagggtgctgtgaagattaggaattggttaactgatttgtgaatgcatttttgtctgttaattcatatcagttacttcgagtaccttctatgtgccaagcactccactaggtattaaggataaatacaacagtataagagagttgaactcacaaaaattccagctgatgaaggagtttaggaagggcattttggaggaggcttttaatgaactgaaacctaagtgactgtgaaagggctccacagaggaagatgtgtcatggcaggggttggagtccagccagtaggaggggaggagcaacctggtccaaggaataatgtataaacttgcccagagctacaaagaagtatgtgtcccttcaacaaggcaaacaagtttgttacagctgtagtcatcttgggtatgaggttggtgttggtgtttggatggaacagatcataggaaaaggccttaataaagcacatgaactttatctgaggaacaaaggacagccactaaagcatgtcaagcatagggagggactgaggttgcccatttaaaaatcctcttcgaatgcaacgtgagatggagatgaaggggccagaggggagtgctcctgggacatcttctggtcaaccagggcatggacagcgggctaggaggagagaggcagaggagtcgggcctgaatagatagtgccctcacagtagctactcacctgcatagaccagccttcttgcaccgctctggtttgactcgttttgctctgattctagcctgagctgtaactccctaacacggcactgtagtggtgcatggctggaaaaaagacaacctgcattttcaattacagactaaaatctcaagaaagcctctaattcttcctattgttatgtcatattttcttagcctattctcttgtctaatctactggaacttatattaaacctttttcattcttttttgaaattaatatacacttcccattctcacttttaggagatgatcctacttcctacatgcaaactctctcagcattgcaaatgcctcctggcagccctatcctgacagataactatccttgctcttatctaatactaagcctcccattgggtaacagatctcaaccacacttacataaacagcaattctatcctgatgactccaaatgcatatgttctgcccagatcttgtccccgaactctaagtattcaacagtttatatttctgcctactgacatacctagtagaaatgtccatgttacacgtctcaaaatttaggatcaacaattggagagaatgtaaagcaacatggaagttagagaaaagagaaaaacaaaagcaaaaactagagtttggctatttttttagaaactcatggcaattagctgagatgatactaagttatagcacggagtacattttagcattacagacctctggtgcctgccaacaggggtgtgttgagctgttagggaaactgtcatttattcaactttgggactttaataattaagaaaatgcaaaactaggaatataaaattaggcatgaaagtgaatatatatcaagaatgagaaaaagctcatgatgcagaataaagttggcaaatgccacaaacattgaaaatctatgaaaaataccctatatttgtaattaattcactaagacacttattgagtactttttctcctatatttttggggggctgtgtattctttgatcacctctttgaataaaaaggattttgtaaaccagtgtctatgggaaaaagaagtagaccccctgcatcttgccctcatctctctgggcaccatgatcacctgcctcccagaggatacccaaggcctttagcccagggacagctaccaatggaacttagatctcatcctacagctgaattcaggagtacagttgcaatgatcaggttcttcctagtgagaggaagatcggacgtaactgcatgacttgaagcccaagtgtagtagttgttatgctaacagagcatacatggggaacatagaggagtagtgaaaggaatgtctgtcttcattcataatagatgagcagtgtatcatttgtataaaaatgtactccctatcatttggccaggaaacccttaaaaactagaggatcattttgtttgtagatattcaacaactgcctgtttcagagctagcaatagatttagcaagaacaagtctttggatgacagagattatttttttaaacagtatttttcatgatactgtttttcagcctggtattacaaataagtttacatttttgataaaatatacatagtgagcaatacagtcacactgatattcatctaaaatcatttttagaaaaaaggagaaaacatgcttggcagggttgaatgaggagggtattcagagtgaatgcaggtgggagatggggaaggagaaagagggattgatcaactaagtagatatgttatgcggaaggtgaaataggagccttatttctcactgttagagatgaaagtcataaatacagaaagaaagaagccaagaataaattctgttgtattggattacaattagaaatattggtatgcagcctcagtttgtagtgtgtgtttgtgtgtgtgtgtgtgtgtgcatgcatgtatatgtatgcagctgtaccttactctgtccccaaaatatctggggtcagagagttctcaatagcaaggagcacactcagcaaagctctccatttctcaatattattctccactgcaaaaagccagaactctgtagagaaatgtttgatggctgggttgtggcgtagaaagtcaaagatgaggctaagtcatattactgtgctaggaaataaggaggtgttcagagaatgatggagatagatgaaaagacataaaagcaactttcaagagcatctattgggcaaattcgggacaaattgagcaattctgggataaaataaatgttagcaatggattataactcagcaaataaaataggaaaccattaagtctatcttcataaaaataaagaagtgaaaaatgtgacaagggacaaagaacttacttagtttcaaagtacctcctcagaaataacttactgtaattataaaagaataaaggagaactttacagagcacaaaagtgacagcattgccttaacaaattgatcaaagtgaacacttcattaaagcaacacatcaaaaattatgcatgtctgatagggagacagactataataattagcaaaatagcaggttcatgacattcccactaaagctgggtacaaatgaaatctaactaggaggaaacatctatctaatgtaatgtaaaggagaaaaccaatgtaatctaaccaaatctaatgtgatttaacctattctagtcctgagaaaatctccaacaaacccaagtgagacacatttcatataaaatgaatgtcctattttcttcaatagtgtcaaagtcattaaagttaggaaaagatcaaggcatttttctcactgaaggcaagtagcatcacagaacaaccacatgcagcagaggattctgaactggtgagtcatgaatgaagcccaaggactagaccacatcagagtccttgctttgatgattgcattgtgtttatgtaggtgaatgccctaatgttcttgtttgtagaaggtacacacacactgaagtatgagggtgggaggtaatgaagtatcacattggtagttaacaaacagttcagaaaataagtatttgtaattcacttgcaaatgttctttaaatctgattgtattaaaaattattccatgtcaggagtttctatataaatagaaatgcaaaacaagcaaacaagaaaaagtgaacctgcctcatatagagacaacacagtaaattattatagaaatccctaaaggctaccaggcttgtacaacattctaagacagtgctaaaactgtgctcaaattaagaatagctaagaagaaatactaacaaaaataagtagaataaacaaaggcataaatagaaaaaataactttttaaaattaaaataatggaataattacatcttcaataaataatgtgtcaatttatttataacccttatattttgatatcaaatatatattttcccataccccatatttacttaaatgtgattgaaaagctaaatctaatattattatttcttttatcgcaactgcttgcattttaatagaaaagagatgctccaaattagagtatgtttcttataatatggtttaaaataaaagcaaaataaatcaatatacaaaatatagaaatatataatatacacataaattaaggtataacggaagataatacatgatataagagtatatcgatatcattattaggcaaatgctaaaggtttgggagagaccaaaatatttccagcagactgtaatttatgtgaagaatcattttacgatagaattttatatcaatggcaggtattagtagaaactattgtaagaacgccaaagtaaccacttttttaaaaagttacattttagggaggccatttgtctttatctgttttctgttgctataactgaataccacagtctgagtagttaataaggaacagaggtttaactattagctcatgggtctggagactgtgaagtccaagagcatgatgctagcatgtcgtgaaggtctaccagttgtgtcataacacagagggaagcatcacaaggagagatagcaagcatagtaactcaggtctttttcttctctttataaagctaataaacccatcacggggccccatcctgatgaccttatctaattctaattggctccccaagtccctacctcttatcaacatataaatttggttattaagtttgcaacacatacaattttggagacatattcaaaccatagtaccatcttagtaaaaagaggtgtctctgcattttctgactataattatatccattttcatttttaaagtaatttttcttaaaaaggttgattgctttacattttattaagtaatttaaaattaatatggttatttttttactgtaacactttataattaaattagtataaaagtttagtctcttcctaagctacaagcttctgaaaatatgtttttagtttttcctctgataatagaactttaattccctggtgatttttaaaaaacgttacaggccgtgcacttaggttttagtgttgctgctctgggtgagaactaaggttcagccattcctcgttctgtctatgaacatgccagagagaacacatcagaaggaagtcactgccatccacaaagctaatcccagcaacttcaaatccagcttcctgtcttaaaaatataataatcgtcattgattaaaaacataattttattttttatttttgttatctaataacattttcttggtttattaatattttatcacatatccttttgtgaaagtgactcccataaattccccatctgttatataaagtacttatttcccttttaccaagacatctttcaagtgccaagtattaattaattaattctcatgtttcaaaatttgtttcattgacctatatttgctcttaaaagttcaaagacatcattgtttcatactcttttcttgttttgtttttttttccaaggagaggtttctgattcttttagctagatcttgtctagagatacctatgttcttcatctttcgcacattattattattattattattattattattattattattattttgctttaagttctgggatacatgtgcaaaatgtgcaggtttcttacctaggtatacgtgtaccatggtgatttcctgcacctatcgacctgtcctctaaggtacctcccctgacccttaaaccctcaacaggccctgatgtgtgttgtttcccaccctgtgtccatgtgttctcatagttcaacttccatttgtgagtgagaacatgtcagtgatagtttgctgaggatgatgacttccagttcatccatgtccctgcaaaggacatgatctcatttctttttatggctatgtagtattccatggtgtatatgtaccacattttctttattcagtctgtcattggtgggcatttgggttggttccacgactttgcaattgtaaatagtgctgcagtaaacatacgtgtgcatgtgtctttatagctgaatgatttataatcctttgggcatatacccagtaataagatttaaaagaatctctgggacacattcaaagcagagtgtagaggaaaatttatagcaataaatgcccacaagagaaagcaggaaagatccaaaattgacaccctaacatcacaattaaaagaactagaaaagcgagagcaaacacattcaaaagctagcagaaggcaagaaataactaaaatcagagcagaactgaaggaaatagagatttaaaaaaaaaacccttcaaagaattagtgaatccaggagatggttttttcaaaggatcaacaaaattgatagaccactagctagactaataaagaaaaaagagagaagaatcaaatagacgcaataaaaaatgataaaggggatatcaccactgatcccacagaaatacaaactaccatcagagaatactacaaacaactctatgcaaataaactagaaaatctagaagaaatggataaattcctcgacacatacaccatcccaagactaaaccaggaagaagttgaatctctgaatagaccaataacaggatctgaaattgtggcaataatcaatagcttaccaacgaaaaagagtccaggaccagatggactcacagccgaattctaccagagatacaaggaggaactggtaccattccttctgaaactattccaatcaatagaaaaagagggaatcctccctaactcattttatgaggccagcatcatcctgatacaaaagcctggcagagacacaaccaaaaaagagaattttagactaatatccttgatgaacattgatgcaaaaatcctcaataaaatactggcaaaccaaatccagcagcacatcaaaaagcttatccaccatgatcaagtgggcttcatccctgggatgcaaggctggttcaatataggcaaatcaataaatgtaatccagcatagaaacagaaccaaagacaaaaaccacatgattatctcaatagatgcagaaaaggcctttgacaaaattcaacaacgtttcatgctaaaaactctcaataaattaggtattgatgggatgtatctcaaaataataagagctgtctatgacaaacccacagccaatatcatactgaatgggcaaaaactggaagcattccctttgaaaactggcacaagacagggatgccctctctcaccactcctattcaacatagtgttggaagttctggccagggcgattaagcaggagaaggaaataaagggtattcaattaggaaaagaagaagtcaaattgtccctgtttgcagatgacatgattgtatatctagaaaaccccattgtctcagcccaaaatctcctgaagctgataagcaacttcagcaaagtctcaggatacaaaatcaatatacaaaaatcacaagcattcttatacaccaataatagacaaacagagagccaaatcttgagggaactcccattcacaattgcttcaaagagaataaaatacctaggaatccaacttacaagggatgtgaaggacctcttcaaggagaactacaaaccacttctcaaggaaatgaaagaggatacaaacaaatggaagaacattccatgctcatgggtaggaagaatcaatatcatgaaaatggccatactgcccaaggtaatttatagattcaatgccatcccaatcaagctaccaatgactttcttcaaagaattggaaaaaactactttaaagttcatatggaaccaaaaaagagcccgcatcaccaagtcaatcctaagccaaaagaacaaagctggaggcatcacgctacctgacttcaaactatactacaaggctacagtaaccaaaacagcatggtactggtaccaaaacagagatatagatcaatggaacagaacagagccctcagaaatgacgccacatatctagaactatctgatctttgacaaacctgagaaaaacaagcaatggggaaaggattccctatttaataaatggtgctgggaaaactggctagccatatgtagaaagctgaaactggatcccttccttacaccttatacaaaaattaattccagatggattaaagacttaaatgttagacctaaaaccataaaaaccctagaagaaaacctaggcattaccattcaggacatagacatgggcaaggacttcatgtctaaaaaaccaaaagcaatggcaacaaaagccaaaattgacaaatgggatctaattaaactaaagagcttctgcacagcaaaagaaactaccatctgagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggcgaaggacatgaacagacacttctcaaaagaagatatttatgcagccaaaagacacataaaaaaatgctcatcatcactggccatcagagaaatgcaaatcaaaaccacagtaagataccatctcacaccagttagaatggcgatcattaaaaagtcaggaaacaacaggtgctggagaggatgtggagaaataggaacacttttacactggtgatgggactgtaaactagttcaaccattgtggaagttagtgtggtgattcctcagagatctagaactagaaatgccatttgacccagcaatcccattcctaggtatatacccaaaggactataaatcatgctgctataaagacacatgcacacgtatgtttattgcggcactattcacaatagcaaagacttggaaccaagccaaatgtgcaacaatcatagactggattaagaaaatgtggcacatatacaccatggaatattatgcagccataaaaaatgatgagttcatgtcctttgtagggacatggatgaaattggaaatcatcattctcagtaaactatcgcaaggacaaaaaactaaacaccacatgttctcactcacagatgggaattgaacaatgagaacacatggacacaggaaggggaacatcacactctggggactgttgtggggtggggggaggggggagggatagcattaggagatatatctaatgctaaatgacaagttaatgggtgcagcacagcagcatggcacatgtatacatatgtaactaacctgcacattgtgcacatgtaccctaaaacttaaagtataataataataaaaaaaaatgtctggatcaaatggtatttctgatgctagatccttgaggaattgccacattgtgttccaaaatggttgaactaatttacattctcaccaacagtgtaaaagtattcctatttctccacagtctctccaccatctattgtttcttaactttttaataatcaccattctaactagcatgagatggtatctcattgtggttagatttgcatttctgtaatgatcagtgatcttgagtattttttttcacatgtttttggccacataaaagtcttctcttgagaagtgcctgttcatatcctctgcacactttttgatggggttgtttgttttttttcttgtaaatttgtttaagttccttgtaaattctagatattagacctttgtcagatgggtaggttgcaaaagttttctccaattctgtaggtggcctgttcactctgatgatagtttattttgctgtgcagaagctctttagtttaattagatctcatttatcaatcttggcttttgttgcaattgctttttgcatttttgacatgaattcttggcttatccctatgtcctgaatgatattgcctaggttttcttctagggtttttatgattttgggttttacatttaagtgtttaatctatattgagttaatttttgtttaaggtgtaaggaagtagtccagtttcacttttctgcaaatggctcaccagttttcccagcatcatttattaaatagggaatccttttcccatgcttgtttttgtcaggtttgtcgaagatcagacagttatagatgtgtagtattatttctgaagtctctgttctgttccattgcctgttttgataccagtaccatgctgttttggttactgtagccttgtagtatagtttgaagtcaggcagcctgatgcctccaacttcattctttttccttaggattgtcttggctatagagggtctcctttgatttcacatgaaatttgaagtagtttttcctaattttgtgaagaatgtcaatgatagttggatgggaatagcattgaatctataaattaatttgggcattgtggccattttcatgatattgattcttcttatccatgaggatggaatatttttccatttgtttgtgtcctctcttatttccttgagcagtggtttgtagttctccttgatgaggtccttcacatccctgttagctgtatttctaggtattttattctctttgtagccattgtgaatgggagttcattcatgatttggctctctgcttgtctattgttggtgtaaaggaatgcctgtgatttttgcaaatggattttgtatgttgagactttgctgaagttgcttatgagtttaaggaattttttggctgggatgattgggttttctaaatatagaaatatgtcatctgcaaaaagagacaatttgactgcctctcttcctatctgaatacgctttatttctttctcttgcctgattgccctggccagaatttccaatactatgttgaataggagtggtgagagagggcatccttgtctcataccggtattcaaagggaatgcttccagcttttgcccattcaatattatatctgttgtgggtttgtcacaaatagctctgattattttgagatatgttccatcaatacctagtttattgagagtttttaacatgaagtgatgttgaattttatcaaaggccttctctgcatctattgagattatcacgtgttttctgtcattggttctgtcaatgtgatgaacacatttattgatttaggtatgttgaaccagctttgcatcccagggatgaagctgacttgatcatggtgggtaagttttttgatgtgctgctggattcggtttgccagtattttattgaagatttcacatcaatattcatcagggatattagcctgaagttttgtttttttattgtgtctctttccagttttggtattaggattacactggcttcataaaatgagttaaggaggagtccctccttttggattgtttggaatagtttcagaaggaatggtaccagctcctttttgtacctctggtagaattcagctgtgaatttccctggtcctgggctttttttggttggtaggctattaattactgcctcaatttcagaacttgttattggtctattcagggattagacttttcctgatttagtcttgggagggtgtatgtgtccaggaatttatttatttttctagattttctagtttatttgtgtagaggtatttatagtattctctgatggtagtttgtatttctctggggtcagtagtgatatcccctttaacctttttttgttgtgtttatttgattctactctcttttcttcttagtttagctagcagtctatctattttgttttttcaaaaaaccagcacctggatttattgatttttggagggattttgtgtctctatctccttcaattctgctctgacctgagttatttcttgtcttctgctaactattgaattagtttgctcttgcctctctagctcttttaattgtgatgttagggtgtagatttgagatctttctagctttctgatgtgggcatttagtgctataagtttccctctaaacactggtttagctatgtcccagagattcttgtacattgcacctttgttctcatttgttttgaagaacttcttgatttctgctttaatttcattatttaaccaggagtcattaagtagcagtttgttcagtttccatgtaattgtgtgtgtttgagtgagtttcttaatcctgagttctaattttattgcagtatggtctaagagactgtttgttatgatttcagttcttttgcattttctcatgagtgtcttacttccacttatgtggttgattttataataaatgccaagtggcattcagaataatgtattttctgctgatttggggtggagagttctgtagatgtctattaggtccacttgatctagagctgagttcaagtcctgaatatccttgttaattttctctcattcatctttctaatattgacaactgggtgttaaagtctcctattattatgtggcagtctaagtttctttgtaggtctctaagaacttgatttatgaatctggatgctcctctattgggtgcatatatatttaggatagttagctcttcttgttgcattgatccctttatcattatgtaatgctcttctttgtctttttaaatctttgttggtttaaagtctgttttttcagagactaggattgcaacccctacttttttttttccatctccttggtaaattttcttccatccctttattctgagcctatgtgtgtctttgcacatgagatggttctcctgaatacagcacactgatgggtcttgactctttatccaatttgccaatctgtgtcttttaattggggcattttgcccagttacatttaaggttggtattattatatgtgaatttgatcctgtcatcatgatgttatctgattattttggccattagttgatgcagtttcttcatagtgtcattggtctttatattttggtgtgtttttgcagtggctggtacccgtttttcctttccatattttgtgcttcttttgggagctcttgtgaggcaggcctggtggtaacgaaatctctcagcatttgcttgtctagaaaggattttatttctcctttgtttatgaagcttagtttgactggatatgtaacaatgttgaatattggttcccaatctcttatggcttgtagaatttctgctgagagatccactgttagtctgatgggcttccttttgtaagtgacctggcctttctctctggctgcccttagcagtttttccttcatttcaaccttggaaaatctaatgattatgtgtcttggggtatatcttctcatagagtatcttagtgttgttctctgcatttcctgaatttgcatggtggcctttcttgctagattggggaagttctcctggatattatcttgaagtgtgtttttcagcttgtttccattctccctgtctccttcaggtactccaggtttggactttttatgaagtcccatatttctcagaggctttgttcattccttttcattcatttttctctggttttttctgtatggcttatttcagcaaggtggtctccaaacaatgatatcctttcttccatttggttgacttggctattgatgcttgtgtatgcttcacaaagttctcgtgctgtgttacgcagcaccatcagttcatttgtgtgtatgttcttctctaaactggttactctagttaacagttcctctaaccttttatcaaggtttttagcttctttgcattgtgttaaaacatgctcctttagctcaacataccgtttctgattcttttagttttttcttatctagtgacacctatttattatctttctcacactattgtttttaaataatgtcatttgcactccattttttttgacaggtgtgagtaaagcatagttttctcaaaatatttttaaataatttcatattattctgtaatttatcttataattctcaaaatgtttgtttattcttttgtttaaaaagttatattctcactattttttaaagatatttctaaaacaatgcaagattattatttaggtcaaataagtatttatcagcaatgtgatttggtaatagaaagattcagtcactttatctcattaagaatttaatatgtacacaaaagctatctaattctgttttccaatatttggagtgaaaaaaattcacacatatacaaaataaaccaacatcttatatttatctctctcaaaatatatttttggggtattatttcctcattaaagtgagtctaaaagcaatatatttatgaatgattatggatttccatgttgcagaaatttgttcccctttaagctgagtcagaagataatccaaatatactgaaaataagcactggaaaagcatagctgttttaaatcctaacattttaatttactgtagtaattttaataaaaatgtgagagtacatctatattaggaaaatctacctatcatatgcaaataaatctttatgaattgtgaataaatcgaatgcttaaaaatattatgtttaataatgacatcttccataataatatctggttagtaaaattttatatggacacccataacataacatatccttaatgtaagaaaaaagctagaaaatgggttttgttgcacaaataatttggtgccaatctcaaggattcatcccttagaatgagaattacttttaatgctctatttagcttaaattccttcaggtctatttcaggtttttccataacctttctagacttaatttgtttagatttctgtttacagaaatgttctgccttgcaaatttacatagtatatgattgtaaaactgtttgaccttccaaaaccttatattactgttttaaaagtaaaaatataattttaatgtcagaagaagcccagatgtcatctccttctgaagccttcatccactaagaaatattatggaaaagttttccagtggccttcaaattgatttagaatatatttttaatgatacagtggcatagatagtttgcagtgccagttttcaatacatcatttcactactaatgaaattaacaatattttaactgtcatgcattattttattaacaataataatattgttcttaatgagaacacatgaacaaagggaggggaacaacatacaccagggcgtgtggggagaggagggcaaggggagggaatttagtggactgatcaataggtgcagcaaaccaccatgtcacatgtatacctatgtaacaaacctgcactttctgcacatgtatcccggaacttaaagtaaaatttagaaaaaaagaaagaaaagaaaagaataataataatagtgttcttgctatttgtgctattttttttttagaataatatcaaaatctattattaacattgtttcttatggaaactcagcagcatatatcaaacattctctacctcctgttacttaacctttgcatattttaaataattgaattgatatgttctattgctcaacattcatttttagtaaaagtagagaaagtgaagattacagatatgctcagcagtaactgctgaaatccataagcacccaacttttctggaccaagttgctctgtgttcttactatatccagacaagtcctatttctggaaaatgtggttggacagggctgtaatgtttacaagtgtgtcaacatatttatattgtttgaaatggatttggagcaagtcaagtttttgaatatttaaggaacatatctacttgatttactaaccgtaagttatacaatttcatttttatttgtttttgcccttccagcttggggactttaaaattttgtccatacatgattgaaggaatgttcagccaaactttatctgaaatatttcctattaactcatatttatgtaaataataaaattagaagcatgcaaaatttacctttgggattatatcccataactggctcttgtcaaaattgacgttgttcataattttttgtaaaactattgagaaaattttttatagtgttccaattcattgtgatgaagagtagttgagagagaaataatgcactcctgtggtatgttttcttttccaaggatatatctaaagatatagataaataaacacatacatacacaactatatgtgtatatgtgtgttttatcattgtgtcttggaggtattggttaaaatggtttttaaataatagctacatttttgatagtttttaaatcaaaacatggaataatattcaattttgctgtagtattattacaatataatctattaactgtttgcactggataacagcctgtgggcttcatagaaactaagacaagttttctgactttattcatggctaccatttatttctggaaataatcttatttttgtttctgtaaatgcatttatacttcagttattcattatgtactaagtattacttagttgttgtatgtctaattaacatggattactgaattagttggtcaagagaaagagtagtgatgtgttaatagaatgaactagcctgatgttacctgaacttgaattctggcccaattaatatcaacaatatctcaatggtatattatcttaagtatcttcagaatccttacctttaaatcaggaattataattatagccacattatggggttactattatcaataagtctgtttaaactagtcactttgtaagcattcaatacatgttagtgatttctgactctaaattgcttgtggaataaatgctacccttgaagtgatatcagtcatgctaacaatggcaattcccttattttttatccagtgtcattctcactttttctgaataatataactttctggcaattctgaagacttagatttattttaccttagtccaaataggcattagaataagttgtcctcccaggcttggaatcagggaactgtcttctgagcaagtgcttgcttgacactaagaggatggatttatttctctggtggtgagatgacatttgatcatatttgtaacttttgaagattgcttttctctgggcatggtatgaactcaattacaactacatacagtatgtaaaggaaattgagagagggtcaagatcagaaataaggctactactcagtggtaggtaatatgcagaaacctgtatttgggcaaggggaccttacctggcctcccttgggccttctgttgcatggaatcaagagcagaaatggacatatagccttggcctgttaacccttagagttctcctctttctccactgccctcagtcaccagaagtcttctgaggatactaattgactccatcatgtacaattcctaaaacttgctgaatcatctgcttatgttgtatgtcagtgggagaaagaggccagtcatgcagtgcagatagcttcttcaaaaaggatagtgtatgtgacaggcaattttattgtaaaaacttgcttaataaaacaattcaaacagaatgaataagatagtattatatagtattatcctttgtccacattctcacactgaatttgcaaatcctgtcaggactgtttgttcagtacactctttatgggcttcagcctcttgacttaggggcatatagctgatgaagctgtagttggtcgataccaattatgtgaatgggatcaaaacaccaagaatgcaattttcaatttttctcattggactttaagtgttgttcttagtaggcatcattttcagattctttttctgcttggagaggttttaagcttgcacacattgaaatgtatgagagcaaagtgctacaaactagagcacagttacaaaatggtagtggctctgtctaccatttctaccaacacccttcggaggcagtctatctctattgttttccattgtttaccagcccctaatctgaccaatggtcctcaagcgcaacatcctagggctctggtgacgtggaagcattgggctgcggccctggaatgagaataaaggtgagaccagatccaggtatgtgctcgcagctccaaccagcttaaagacttgcagacagtaaatgacccgcaggtaagcagccttcccatctgcattgggaatccatcccaatgactctgagaacaggtgtttattcgctacagtaatgtgaaaacacaatgtaaataaaactaaacaaatacttaaatttcgtttggtttatcttctcccttatacttttgttttaggagaaatgctttcaagtaaaaaaaagtcatactcatctcaacaaaagattaaatgccatagaaaatatttactaattgatctgataatttttgaactaatataataaattatagacattaaaattttatcaaatttgagtgcagaaataataacctattttggccagaataccaatttgctttgtatttacataagattggaattatgcaggttacatgcttatgtttttttgatgttgaaatattaactaatacattgaacattatagaggatatagtttttttttaaatgtcatttatggaagagaattacatacaaaaggagagagggatgtgttttattacatatataaataatggctctgagatacaccatgctcaatcattttcataatccatttttccagtaatgttaagtaaataaaaacatatttcattagggtatatgtacacatcgcataattttatatagtttaaaactattcattgttatttgtagttcttatacataatacataacctgtttactatttaactgaaatgtgtaaaactgacaacaatgctatttttggattgtgagaagaaatttatttttgaagtattttttgagtgttgtactattttgtaaaacaacgagagaggaggaccgaaagcctcagaatgagccagcaatgctaagaattctttgtcaaaactcactttttaggaattcccaacctatttccaactgccttgcattaaatgccatttatatgccaatgattctaaatttattcagagctctcccttgcatttcaaacaaatacttttagtgccttctggatgattccatgtggatgcctaatgaatacctcaaatacaaccaacacaacatgtcctctgactctgcagacacacacctcagtcaagagatgttctgacttttcagttgctcttgcccaagaccttggagtcactcctgaaatgttttatcatgacccatatctgacacatcagcaaaacatatctggaaccactgttgtgacactggtgttagaaacaaatgcttgttccttggtaccaaaaagaagaaatagcacttgaacataaatttaattttctcggcaagacaatctttacttctatagaagggtgtgacttgcagatggagtaaaggtgagggcacacatggacagggagggtaaggggttcttattcctgatgtaggtagtccctactgctgtgtcattcccctattggctagggttggaccccacagtgtaagctaattcttattggctattttaaagagagcagggatacaagctggagtggcggggtgggtagtttggtgggaagggcagttacagaacaggtgactcaggatgattcaggtcagagcaggtgaccagaggtgactcaggtcaaagcaggtgaccaggggaacagatgtgaactactgattagagctggtgggaaagttgtgaaactagaagcaaggggtcaaagaggacaaggaagttaaactttaaaatagagaatcaaagaataagagagctgaacatactgacacactgattccttgaagagaaacttggagttcactatatctaacactggttatcctcagccctcaactgtgtcagtctcacatttcccacctggttcccactttgacctttgcctcctatcagtttccagtttgactccaagtaaaatacaaagttctcagggccctctgtaagatctgtcccccaacaccctcaggcatgccctatctgctctagtcttttgctacccacccaataactcagaccaattccactgttctgtttaggcatacacaagcctgaggtcctttgaatttgttgccttcctctccaaatagcttaaatagtttactcttttacttcacgcctattttcaaatgtcacctcctgaagatcatttttcctattatgctttataaatggcaatgccccaaaggatagtactccctactgcatttaaccagttttatcattgcctgacatattatgattaagcattttcttatttgctttatggtttgtcttggtcccactcaaaccaaagctccacgagggagagatgtcatctgttttgcttagtgctatgtccccacactggaacagcgcctggcacacagcaggcttgcaatccattttttggttgaatgcctactatggatatttctgtagcccccaaataaaacactttctgaaatagtagtgagtagtgagaactttgcttgaaaatatttccccgttgaaagttatttgtatttgcttaaaagaaagaaataactataggcatgtatggggtgggggtaaggggaagacagtatctaatgggactgggatggaatgaacattctttagtcctgagtcattctttagaagaggactcagaagccaggccaaagatgatatcatccatattaatgagcactaattgaacagtttggccaaaaacttcccctttatctgacaaaatgtgcaggactaattgaacacattttatgagaggttttgctgccagataccatttcccacaaagatctgcaatttttacatctccctaggcaagatactaatacagtatactagggtatataaataggagagcaatttcaagtgacacaagtattccctttatatcccatggtggccagatccatatgagtccattctgctactttatggcttttactacttgagggatttaggaaaagtggaataagttgcagtggagggacactaagataattaaatagctaaaacgtagcacctgtgaggaaggtccagtcatttgcttcatttgattttataaagagaaagctgaaaggtgatttcataattgtcctcaaggatataaaaggttacttttcaaaaagtggtgaccacctgtttttaatcacaattgaagaaagattaggaaaaaaattggtataagctgctatgtgaggataaagttttcaaaaaggaagactggaacattgaagaacagattctacatacaaattattaaagattaagaactgtaatttcattcttagtagacatttaagtgtgggtttgtttgaattattttttggaggcagggccaaatgaccaaccataattcctactgtttgtgaccctctgatatccccacttacataaacaagtagtatttccccctcactggatagctatttctctggaaaaccacatgctctctgcctgtgtgttttctaaacatgaatttgagaacgttttttattatgatacaattagtctcagagatagaatattagagttcaaatctggaagatgaatcttagaactattaatcctggtttggattaatctcactaagcaattttgaaagtaatctattcaacaatattacaagaaattaattttgttttgtgtgtctcttgtttgtttgcttttctggttctaggaatgctaatttatggtagtaaagcttctttctgtttcaataataatgtcttagggaaaattctgtctgatgtcaatcaaaaaaataatgaaaactgatttaagtatattaaattaaaaattcaagaatgcaaataaaatacaatgataaaaagggttttaatgataattacattctacatatgatctatccatattttaagaaattatcatataaaaaagtattttccctttgaagttgcacaacatttttctttttttttgtttttgtttttgttttttttttctttttttttattatactttatcttttagggtacatgtgctcattgtacaggttagttacatatgtatatatgtgccatgctggtgcgctgcacccactaactcgtcatctaccattaggcgtatctcccaatgctatccctcccccctccccccaccccaccacagtccccagagtgtgatattccccttcctgtgtccatgtgatctcattgttcaattttccatatgtgctacttacctttactcaaattcacctttttcttacttaaaaaaaaaatagagcttcacttctccaagcccagtggaaagctaaatctaagacttattaagttagtgaaggaaattaagccatgacgtgtagatagatttaacaaataaatcagtaaggatgctataaacaaaggggcatgttagaagaacaagagcatggttgtggtcaatgtattctctgcttatgacaaacataggaaaataaccttgcttttcctccaagagattggttaatgtatttgtttctgaatgaggtaaatgctagtgacatgagagacgctgctagaaagaactatgccatttaaactaccagtcctccagggtaataatggtgtccaggagtttatccattatctaccttatataagcccctttgcctccatagatttccaagcctaaaattgctaatctttgaatatgttttctaactctgataatacaaaaaactgtggatggtggttatattttttaaaaaacatattttacctgtaaatttcagaatctctgagttttcaatatttgaacttgtttgtcatttggtcttttcaaaccttaattttttcaaaggcagagtggaaaatgaaataatttccataaaaacatttcataatataaatcatattcttcaaatagaaaatattattattaacaggaacaataaatacatatctatagagatcagtatttgtatttatacagctattttaagctgtcactgaattcagacacttttgtgggcacacacacacacatacagcacatgatctctagagaatggaggaagagtcagatttatctatgtagtacacaattctggtgagcatgttttcatttcagtgttaatactgttagctaattgtgttaaagatgaagtcttcttttctctgccttatatatattgtattctaccatgcaatatcacactgtgttatagagacatgtgtgtgtgtgtgttcttgggtgcacgggtaccaaacatgtacgggattcagtgttagttagatatgctctagttttgtagtagtagtctatttcaattatggtaaatgttacaattattagtcacattatgagatattagaaatattatggactacttaatatgttcaagtcactttttctaagtgatatacatcaatcaattcttttaatattcacaggaacttaaggcaggtactatcaggcagtatcatctcctgttgaaaatgcctacactaattcttaacgagataaaaggagtggtcaaaattgccttcaaacttaagctgaatgtctccaaaactaatgtttataatttttaggccaagtattaatagcttctaaagcgggaaacttatcaatgtgtttgagacctatttccctcattagataaattaaattatagccaactttggtggattactataaagattaaactagagacagtatttgaagaatatgtcaatttatattagggattctttcctaagaagaaggaggaaatttaaacttgtattctcctttctttttctcaggtaaagcaactaaaactcagaaataaagaattaatttgtatatatgaatatttatttggttttaaaaataatttttaaaatatcccaaatgtaatgttttatttacaattatttaaaaatttatttaaaattaataattgtaaaaataagttactttttttcagtggttgaaaatgttttcaggtataaagtagttttatgcaatcaaagttgtcagcttgaaacagacaattataagtaatagaaatagactatgaaatagactattgtaagctttctggtaaccaaatagcaaaaattgcatgacctgcacaaaataaacatgaagggccgggcgcggtggctcacgcctgtaatcccagcactttgggaggccgaggcgggtggatcatgaggtcaggagatcgagaccatcctggctaacaaggtgaaaccccgtctctactaaaaatacaaaaaattagccgggcgcagtggcgggcgcctgtagtcccagctgctcgggaggctgaggcaggagaatggcgtgaacccgggaagcggagcttgcagtgagccgagattgcgccactgcagtccgcagtccggcctgggcgacagagcgagactccgtctcaaaaaaaaaaaataaaataaacatgaaaacaattcaaaacatatgactatagaaaaccatgaaaccacaaagaaagacagcgagagatgaaaaatgaaaaaaaaatgaaataaacaaacaaaaaatcgcagaaaacaactaagtagcagtagtaaatccttaactatcaatactaatcttgagtagaaatgaattaaattctccaataaatgaatgaatggataaaaacaaaacctgactatatgctgattaaaatacatgtacctcccttttaaggacacacatggaagaaatcgaaaaagacatttcatgcaaatagaaattaaacagaatcagaggtagcaatacttgtattaaacaaagcagatgctgaatcaaaaactataaaaggagacaaggagcaacattatgtagtgataaagggatacgttctttttttattattataatttaagttttagggtacatgtgcacaacgtgcacgtttgttacatatgtatacatgtgccatgttggtgtgctgcacccgttaactcgtcattaagcattaggtatatcttgtaatgctatccctcccccctcgccccaccccacaacagtccatggtgtgtgatgttcctcttcctgtgtccatgtgttctcattgttcaattcccacccgggagtgagaacatacagtgtttggttttttgtccttgcgatattttgctgatattttacagtcccaccaatggtgtaaaagtgttcctatttctccacatcctctccagcacctgttgtttcctgactttttaatgatcgccattctcactggtgttagatggtatctcattgtggttttaatttgcatttctctgatggccaatgatgatgagcattttttcatgcgttttttggctgcataaatgtcttcttttgggaagtgtctgtccatatccttcacccactttttgatggggttgtttgtttttttcttgtaaatttgtttgagttcattgaagattctgtatattagccctttgtcagatgagtagattgcaaaaattttctcccattctctaggttgcctgttcactctgatggtagtttcttttgctgtgcagaagctctttagtttaattagatcccatttgtcaattttggcttttgttgccattgcttttggtattttagacatgaagtcctcgcccatgcctatgtcctgaatggtattgcctaggttttcttctagggtttttatggttttaggtctaacatttaagtctttaatccatcttgaattaattcttgtataaggtgtaaggaagggatccagattcagctttccacatatggctagccagttttcccagcaccatttattaaatagggaatcctttccccattgcttgtttttgtcaggtttgtcaaagatcagataattgtagatatgcggcattatttctgagggctctgttctgttccattggtctctatctctgttttggtaccagtaccatgctgttttggttactgtagccttgtagtatagtatgaagtcaggtagcgtgatgcctccagctttgttcttttggcttaggattgacttggcaatgcgggctattttttggttccatatgaactttaaagtagttttttccaattctgtgaagaaagtcattggtagcttgatggggatggcattgaatctataaattaccttggacagtatggccattttcacgatattgattcttcctacccatgagcatggaatgttctcccatttgtttgtatcctcttgtatttcattgagcagtggtttgtagttctccttgactaggtccttcacatcccttgtaaattggattcctaggtattttattctctttgaagcaattgtgaatgggaattcacttatgatttggctctctgtttgtctgttattggtgtataagaatgtttgtgaacattgattttgtatcctgagactttgctgaagttgcttatcagcttaaggagattttgggctgagacaatggggttttctagatatacaatcctgtagtctgcaaacagggacaacttgacttcctcttttcctaattgaatagcctttattttcttctcctgcctgattgccctggccagaacttccaacactatgttgaataggagtggtgagagagtgcatccctctcttgtccccattttcaaagggaatgcttgaagtttttgcccattcagtatattggctgtgggtttgtcatagatagctcttatttttttgagatacatcccatcaatacctagtttattgagagtttttagcatgaagcgttgttgaattttgtcaaaggccttttctgcatctattgagataatcatgtggtttttgtctttggttctgtttatatgctggattaaatttattgatttgcatatgttgaaccagccttgcatcccggggatgaagcccacttgatcatggtagataagctgtttgatgtgctgctggattcgttttgccagtattttactgaggatttttgcattgatgttcatcaaggatattggtctaaaattctcttttttcgttgtgtctctgccaggctttggtatcaggatgatgctggcctcataaaatgagttagggaggattccctctttttctattgattcggatagtttcagaaggaatggtaccagctcctctttgtacctctggtagaatacggctgtgaatccatttggtcctggacattttttggttggtaagctattgattattgcgtcaatttcagagcctgttattggtctattcagagattcaacttcttcctggtttagtcttgggaggatgtatgtgtcgaggaatttatccatttcttctagattttctgatttatttgcatagagatgtttgtagtattctctgatggtagtttgtatttctgtgggatcggtggtgatatcccctttatcattttttattgcgtctatttgattcttctcttttttcttctttattagtcttgctagcagtctatcaattttgttgatcttttcaaaaaaccggctcctggattcattaatttttgaaggtttttttgtgtctctatttccttcagttctgctctgatcttagttatttattgccttctgctagcttttgaatgtgtttgctcttgcttctctagttcttttaattgtgatgttagggtgtcaattttggatctttcctgctttctcttgtgggcatttagtgctataaaattccctctacacactggtttgaatgtgtcccagagtttctggtatgttgtgtctttgttctcgttgctttcaaagaacatctttatttctcccttcctttcattatttacccagtagtcattcaggagcaggttgttcattttccatgtagttgtgtggttttgagtgagtttcttaatcctgagttctagtttgattgcactgtggtctgagagacagtttgttatcatttctggtcttttgcatttgctaaggagtgttttacttccaactatgtggtcaattttggagtaggtgtggtgtggtgctgaaaagaatgtatattctgttgatttggtgtggcaagttctgcagatgtctattaggtctgcttggtgcagatctgagttcaattcctgggtatccttgttaactttctgtctcgttgatctgcctaatgttgacagtggggtgttaaagtctcccgttattattgtgtgggagtctaagtctctttgtaggtcactcaggacttgctttatgaatctgggtgctcctgtattgggtgcatatatatttaggatagttagctcttcttgttgaattgaaccttttaccattatgtaacggccttctttgtctcttttgatctttgttggtttaaagtttgttttatcagagactaggattgcaacccctgcctttttttgttttccatttgcttggtagatctccctccatccctttattttgagcctatgtgtgtctctgcacgtgagatgggtttcctgaatacagcacattggtgggtcttgactctttatccaatttgccagtctgtgtctttcaattggagcatttagcccatttacatttaaggttaatattgttatgtgtgtatttgatcctgtcattatgatgttagctggttattttgctcgttagttgatgcagtttcttcctagccttgatggtctttacaatttggcatatttttgcagtggctggtaccggttgttcctttccttgtttagtgcttccttcaagagctcttttagtgcaggcctggtggtgacaaagtctctcagcatttgtttgtctgtaaagtattttatttatccttcagttatgaagcttagtttggctggatatgaaattctgggttgaaaattcttttctttaagaatgttgaatattggtccccactctcttctggcttgtagagtttctgccgagagatcagctgttagtctgatgggcttccctttgtgggtaacccaacctttctctctggctgcccttaacattttttccttcatttcaactttggtgaatctgaaaattgtgtgtcttggagttgctcttcttaaggagtatctttgttacattctctgtatttcctgaatttgaatgttggcctgccttgctagattggggaagttctcctggataatatcctggagagtgttttccaacttggttccattctccctgtcactttcaggaacaccaatcagatgtagatttggtcttttcacatagtcccatgtttcttggaggctttgttcatttctttttattcttttttctctaaacttctcttctcacttcatttcattcatttcatcttccatcactgataccctttcttccagttgatctcatcagctactgaggcttctgcatttgtcacgtagctctcatgccttggttttcagctccatcaggttctttaaggacttctctgcattggttcttctagttatccatttgtctaattttttttcaaagcttttaacttctttgcctttgttttgaatttcctcctgtagctcggagtagtttgatcatttgaagccttcttctctcaactcgtcaaagtcattctccatccaactttgttccactgctggtgaggagctgcattcctttggaggaggagaggcgctctgatttttagggtttccagtttttctgctctattttttttcccatctttgtggttttatctacctttggtctttgatgatggtgacatacagatgggtttttggtgtggatgtcctttctatttgttagttttccttccagcagacaggacccttagctgcaggtctgttggagtttgctggaggtccactccagaccctgtttgcctgggtttcagcagcggtggctgcagaacagcggacattagtgaaccgcaaatgctgctgcctgatcgttcctctggaagttttgtctcagaggagtacctggccatgtgaggtatcggtccaaccctactggggggtgcctcccagttaggctacttgggggtcagggacccacttgaggaggcagtctgcccgttctcagatctcaagctgcattctgggagaacaactactctcttcaaagctgtcagagagggacatttaagtctgcagaggttactgctgtctttttgtttgtttgtgccctgcccccagaggcggagcctacagaggcaggcaggcctccttgagctgtggtaggctccacccagttccagcttcctggccacttcatttacctaatcaaactaacccggcaatggtggtgcccctccccaagccttgctgccaccttgcagattgatctcggactgctgtgttagcaatgagcaagactccgtgggcataggaccctctgagccaggtgcaggatataatctcctgatgtgccctttttttaagcccattggaaaagcgcagtattagggtgggagtgacccaattttccaggtgccgtctgtcacccctttctttgactaggaaagggaattccctgaccccttgcacttcccgggtgaggtgatgcctcgccctgcttcggcttgtgcacagtgcagggcacccactgtcctgcacctactatctggcactccccagtgagatgaacctggtacctcagttggaaatgcagaaatcacccgtcttctgcatcactcactctgggagctgtagaccggagctgttcctattcggcaatcttggctcctcccccgggataagttctttaagagtgtgtaacaattgtaaatatataaatgcacccaacagtaggacacctaaatatataaagccaatattaaaggacctgaaaagagaaatgaattgcaatataacaattatagaggcttcaatattggacagatcacccagacagaaaattaataaggaaatactggatttgaacaatgcgttagaccaaatgaacctcataacatttgtagaaccttccacttaacagcaacagaatacacattctgctcaagcacatatgggacattctctaggataaatcatttaagccacaagacaagtctcagcaaatttatgaagattaaaatcacatcaagtactttttcaacctcaataatatgaaactagaaatcaataacagtaaggattttataaattcacaaatatatgaatattaaacaacatgctcctgaacaaccaatgggtcaatgataaaattgaaagatacatttaaaaatttcttaagacaaatgaaaatgaaaacataacataccaaaacctatgggatacagaaaagcaaatcttatagggaagtttatatcaacaaccacctacattagaaaaggagaaagatttcatataagcaacctaatgttacacctcaagaaattagaaaagcaagaggaaacagtccaaaattattagaaggaagaaaataataaagaacataaataaacaaattagagactagaaaagaaagaccaaggaaatgaagtttttttttttgaaaaaatgtatcatattcacaacctttagctaaactaagaaaaaagataagagactcaaataaataaaaccagggattaaaaatgaaatattacatctgataccacagaaatacaaaggatcataaacaaatttatgaaaaagtatatgccaaaaaattggataacctagaagaaatgaatacattctgggacacatacaacctactaagagtaaatgctgaaaaaataaaaatgtgaagagaacaataatgagtgaggagactgaattagtaataagaagtctcccatcagagaaaatcccaaggcctgatggcctcactgttgaattctatcaaacattttaaaaagaactgatgccaattttctaccaattactccaaataattcatgagggaacacttccaaactctttttatgaggataacattaccctgataccaaaggcaaagacatcataagaaaagaaaattataggccaacacactttataaacataactgtgaaaatcctcaacataatactagccaaccaaattcaacaacacattaaaataatcatttaccatgatcaagtgggatttatccctggaatgcaaagatggttcaacatttgcaaattaataaatgggatacgccacattaatgaaatgaaggacaaatatcatataattattttataaaacacaaagcatttgacaaaattcaacattcttttataattaaaaaaaaaaaactcccaacagattagttataaaagaaatgtacttcaacacaataaaggccatatatgacaagccaaaagtcaacattattctcaacaaggaaaagttaaaagcatttcctgtaagacctgaaacaagacaagaatgcccactatcaccactcgtattcattatagtgttgaaggtccaagccagagaaattaggcaagaggaagaaataaatggcataaagactgaaaaagaaaatgctaaattgtccctgtttgcaggtgatatgatcttatatgtaaaaaaaaacccaagatccccccactcacacacacacacaaaaaaaaccgttaaaaatagaaacaaatttaggaaagttacaggatacaatatcaacacaaaaattagtagtgtttctttacattaacaaccaatgttttaaaaaaatcaaacaataccgtttataatagatacacaaaatgcttagcaatagactgtttctgacagtcaagtatagtttatttactgagtagataagccaaaatattaataattattcctaaatgaaggaattatgagtgacttttaatttttgtctgttttttatttcttatttatttatttatttatacttaggaagtaccagtgtatatttcttacatgcatatattgtgtagtggtgaagtgtgagcttctagtgcgcctattacccaaataggtaaatttttaatctttacccatattccaccctcttactctttgaagtcttcaatgtctattattccattctatatgtccaggcttacccattgtttacttcccattataagtaaggatctacagtatttgactttctatttctgagttatttcatttaggataacggcctccagttccatcaatattgctgcaaaagacataattgtattctttttaatggatgagtagtattgaattatatatacatatatgtatatatataatttttattattcatcacataggttgattccatatgtttgctattttgaatagtgctgtgataaacatatgagtgcaggtcatgttttgataaaatgatttcttttcctttggatatatacccagtagtggaattgctagattgaatagtagttctatttttatttctttgaggaatctccatattgttttccataaagtttgtaccaatttacatttccaccaacagtgtataagcatttccttttctctatatcttcaccaaatctgttattttatgacattttagtaatagccattctgactgggataagatggtatctcactgtggcttaaatttgaatttatcttatgattggtgatgttgagcattttttcaaatgtctgatggtcacttgtatgttttcttttgacaaaatgtctgttcatgtcctttgcccactttttaatggggttatttgttttcttcttgttgagttgtctgagttcctcatagattctggatattagccctctcttagttgcatggcttgaaaatatttttttctcattcttaggttgtatatttactttgtcagttatttcttttgctttgcagaagtttttaatttaattaagtcctatgtttgctttgaggacttggtcataaaatctttgcctaggccaatgtccagaagacatccctaggttttcttctaggatattaatagtttcgaatcttatggtctttaattcatcttgagttaattttttatatggtgattgataggagtctggtttcattttctgcatatggccatccaattttcctagcaccatttatgaaataagatgtcctttacccagtgtatattcttgttgactttgacaaagttcacttggctgtggcatcacttgactgatggctttatttctgggatctctcttctgttccattgatctatttgtctgtttttatgccagtaccatgctattttgcttactatagacatctagtattatttgaagtcaggtaatgtgatgcctccagctttgttatttttgtttatgattgctttggctaatttggggtcttttggggttccatatcaattttagaatttattttctaatctgtgaaatatgacattggtactttgatagacattgcattgaaattgtaaattgttttgggaaatatggccattttaacaatattaattctattgatccataagtatgagctgttttgtcatatgtttgtgtcaactataatttcttttatcagtgttttgcagtttttctggtagagctcttttacctccttgcttaaatgtatttccgggtttttttggaagttattataaataagattgccctcctttcaactgcattattgttgctgtgtagaaaagctactgatttttgtatgttaattttgtattgtgaaactttattgaatttattcatcgaaaataaaagttttttggtgtagtcttcagattttttgagatacatgattatatcatcagcaaacaaggacaattgactttctgttttccaatgtggatgactttggtttatttctcttgcctaattgttctggctagtactttattactatgttaaataggagtggtaagagtggacaaccttctcaaagtccagttcttatggggaatactttcaacttttccattttcagtatgatgttgactgtgggtttgtcatatatgacctttattattttgaggtatgttccttctatgcttcatttgttgagggttttgagcttgtgctcttatgaagcgatgttgaattttaaaaaattctttttctgtgtctattgagatgatcatatgatttttggccttaattctgtttaggtaatgtatgacatttatttgtgtgcatatgttgaatcattcttgcatctctggtgtaaaatcaagttggtcatgatgtaatatctttttgatgtgttggatttagtttgttgagaatttattgataatttttatatctgtgttaattagggatataggtctgtagttttattttttgttattgtgtttctggctgactttggtgtcagggtgatacaggatttgtataataagttagggagaaattccttttcagttttttgaaaagtttcaggagtattggcaccagttcttccttgtacatttgctagaatttggttgtggatccatctgttcctgggattttctttgttgggagacttttcgtagttgggagatttttttattggattttaaatccaatgttgttatttctctattcatggtttttatttcttcctgattcaatcttaggaagtagtaagttttcaggaatttgtccatttcctctaggttttctagtttgtgagcatataagcataagggtgtggactcagtactgctaccttggccaagaggagtgagatgtgattctctctcatgcccccatttttggtggggctcaccaccttctcaactttgtcagtaggtttggctgttcacttagttagtgcagtttacttctagttgtcaacacaagctgccccaggccttaggagtcactgcacagcccaacactatgcctcccaaacaaatcccctcctgtactggtgggggaagggggtgaagtgaaagatggggtgagcctggttccagcatgccaatggctggagcccatgccatacttgattctcggttctggctgtgggaacctcttccctgcttgagcaccagatccccaggatactgttagagcctctttaatgacaaaggctgccactgctgctagttttcaggactgtgcacagcttgcaaagagctaggatcaagaatggtgttctgttgtaggttccaaggtctcgggaagtgcatgggacacttcccagagcaggtacttcttacagtctcccagccacatcccaaggtagatctagggcttagaaaagtcatggtgctctaccgtggcctgaattatatgattctatagtgggaaattggaccacagaaagatactcactcaccctctcccatattgggaatttactctcttctcattttcagccagtcccacagccacacaggctgactgttcttctttttctggtcagattttggagtttcttcgtgtgttactgttgaactcctgtgttctctcttggataatatgtttgtaaacaaaaaagttactgaggtggatcttaatcaattagagatttattttgccaaggttgagaacatgcctgggaaaaagaaacacaaatcacaaggagatctgtaccctgtgcttttttttaaaaagggttctgggaacttcaatatttaacagggaaaaagcaagcaggaagaggaagaaagaaaaaaagtctgggtaggcaatgagataagtggtcacattcttgtgaggatcttactaatgagcagaaaagctacattttacataaagtaaacatgaaattacagctttttgggaatgaaaggaaggcagttttttcatgactaactacctaaacttagccctttggtatagtgagtttggggtcccaatatttgattttgctttcatatgtgcaaagtgtgattgtctacacaccattgtcattcttctaagtggatgaagtaccctggaaaagcatctagtcagccatcttgaaaaaaaaacctgttgtttctttgtaatattgctttataaatctgagagaacttggaacaaatctaacaaaatagaagatacttctggagaagtgagaaaattgagaaaaatgcaactgatgagttcttgatatgtttagctattattattatcattactattattaaatgatactttccagttggcaaaaaagtattctggaggctattctttctactggggcataagtcaaactatgacaaaagagaaatgcatgcagagagcaagccatagaaggcaagttaggaaatgatacgaatatttatctgtatttattttattgaatcaatactgacaacaaaaatttccaacattaagtacttccaagtattagatactaagcaaagaattaaatatagtatcttatttaatcatcagatcaattaattatttccactttagtgatgagtgaaggaagctatatatatggtaatcaacttgacaaggattacctattaataaataaaagagaggagattcaaatcaagacagaattctgaagctagaacttttgttcttatcaccttataacagctcctgcatgtgtgttagagagagaatgagggtgagaaagaggaatatatacattcttatttaaacctatgtggataatcgtgtaaatactccttattatactaatacttctagtcaatgccagtctctaagagtatcttatttagtttttcagttagttatatatatattattacttgcatataacttgataatgactgcaaccgtaaaggaacacaatcttttgaaatgttataggcagcaaaggtagaaactctagtaaaagaaatctagtgtcaatgattttagatgattatgttgaaagtagatctttaaaatgattgagctatagtcacttttcactaaatttctgataaaggaacccctgctttttccaaagtttctcctcctcccacccatccactcttagccatctaaagcttagagtctatgctgcccccttctcacttaactctccaatatcttttcctggcaggtgcattctatgaatttcttagcaggatcacctggtctttttcaggcttgcaccaggttgctcttgcatttgtctttaagtccttgatggtactacagtctctccctacaatacaactttccccctcctactttccctcaagatgatttatcgttccttattctgcttccttagcatgttacctctatagcactgtcatatgctcgttattttaacatatttctctccctcactaaaatgagacctgggtgctcagatgccatttgcagtgtgagtcagttcatgagaagtatattataaataacaacaggaaatggcaagaagttttcagagatgctgaaactatatttgcagagttgattagaggatgctttgtctgagagagagtcacgacttgggtaatataacagaagatcttaaattgagttttaaaagagcaaaggagtaaagttttgctaagagaatagaaaatcttacatgaagtccattttaagatcctattgctacatgtgatttatgaaaaggaaaaaataacaaaattttctgactaataatgacattagataatattttttattataaggaaaatgaagggcaatttaataaaccataaaattggcaaggtttctggaaactgcaacgtttagttatagatttttgccaatttatcaatttaaaaagctaaggtagatgttgaaatatctgcagtataaagagagggcatactaaaatttttgctatagtagcttgtcattatactgtgttcaagtccaaaatttataaccagatcaatcatcccatgtccttccctagcttcagctctcaatgtttctgcctccttttctttgaatttctgaaatgcctgacttggccccagccagtcccatccactctctggaaagaacaccctttttctatactttatctttgatattctactcgttttcagccactgtttaaaatttacttcctagagaacatttctctagcttttcaatctattgtgatataatacctttttcttcctcttcttcttcttcttcttcttcttcttcttcgtgttcctcttcctcttcttcttcctcctctttttcttcctcttcttcttcttccttcttcttcttcttctttgccttcctcttcctcttcatcttcctctttttcttcttctttttctttttcttctccttcttctccttcttcttcttcttctttctcttcctcttcctcctcctcctcctcttcttcttcttcttcttctcctcctcctcctcctcctccttctccctcttcttcttcctctttttgagatggagtttccctctggttgcccacgctggaatgcagtggcacagtcttggctcactgcaacctcctcatcctaggttcaagtgattctcctgcctcagactcccacgtagctggaattacagggatgcaccaccatgtccggctaatttttgtatttttattagaaatggggtttcaccatgtgggacagtctggtctggaactccccaacctcaagtgatctgcccacctcggcctcccaaattgctgggattactgacatgagccactgcgcccagcctcttattttttttataatggcatttacaataatttgtactaatatatttacttgtgtagttattatctctcattgttccctccatagatattataaccccaaaactactaaaaagtatttataatttatcattagattgtactctcaaacatattatgttttcatttttttctcccttcagacagagtaggaaaatcaataagcacagcatttatcatccttttagctttctgagcatctactggcagcaagggtcagagctaaattctacaaccctggaagtaaatgccttccattagctctcttccagcaattataagaatgcaagcaggaaacaatgaaaatagttattattttttaaacatttgccaaagcagagaattccatctaacattttgggtgtttaataatgatacacttacatccctccttatgagaaatgattacagataccagtgattaaccctttgacaattttcagtacactgcatagatatagcatatatacagtcatttaataactgagatatatttcaggaaatgcctctcagttagatggttccactgttgtacaaacaccacagaatttgcttgcacaacctgagacagcataacgtactgcacagcgaggttatacagtacagcctatttctcctaggttacacacctgtatagcatatgactgtattgaatactgtaggcaaaagtaacataatggtaagtagttgtttaaacacatctacacatagaaaaagtaaagtaaaagtacagtctaaaagatttaaaaaaaaaatgatacacagatacagggcacttaccatgaatggagtttgcagaatggtagttgctctgggtgagtcaatgaatgagtgatgagtaaatgtgaaggcctaggatgttactatacagcactatagactttataaatactgagcacttagactacactacatttataagaagtatttttttctgcaataataaactaagcttagcttactgtaacattttttactttacaaagttaattttttcaactttggccttttttgtagaagtgcttagcttaaaacacaaacacattatgtagctgtacaaaattattctatatccttattctctacattttttttctacttttaaatttacaaattacttttttatttttggctttttaaaatttttataaaaaataagacagaaacacacacattaaccttggcctgcatatagtcaggatgagttccatcatcacatcttgtcccactggaaggtcttcaggggcaataacacgcatggagctgtcatctcttatgataatgatgccgtcttctggataccttctgaaggaactgcttgagcctgttttatagttaactatatttttaataaatagaaggagtacactaaaaaaataggagtacagtaaatacagtaatatttactgtattactataatacagtaaatacataaaccagtaacatattctttcttatcatcattattattatgtagcatacatcataatcgtatgtgctagacttacacagctgtcagcacagcaggtttgtttacaccagcatgaccacaaacacaagagtaatgcattgctctatgacattacaacggctatgacattgctaggggataggaatttttcagctcccttataaccttataggatcaccgtcgcatatgcagttcatcattaacccaaacatccttatgcggcacatgactgtatttaaaatgctatatctgacatgttgcattgggttactctgtttcataaattatttgcttcacttttttttctcatgttaatgtctcttaaattggaatatatgtaaatttgtgaacacttcagttgaaaacttctggtaagaccaagaaattgccagcatcaaagtcgtttttttgatacaatgaaatacagttacacaagtaaggtaaataatgcgtttttttttaagcaatattattgctgtagacaaattagactcattttctttttcatttctcatggagaagaatattttggtttgcttataaagttccttaaaatttacaaacatgttcacaagcattatttaatttcaacatcataacagttatgtaaggaagggaagagatagtgtgtcacccctttgtagagtaataaaccaagtcttgtatgttaaatgctttggtggttatattgttagtaagagatgaagccagaaaccctaacttctattttatggacatgcttcagtgtaaagacagagaagtcatgtgttggggctttgaagcccggagttctggtataatgtctaatgaagacttggtgaattcgcagagtgttgtctttttacctgtggcttctgcaccttggtccagtcaggaatggccaggttagcaatgtgaagtgatgtgtgccagcctgtgtaactccaggttttcaccaggacagtgacctgctggaccgacggaaacagtgcttcaccgtgcagtctgagtctggggaggacctgtacttctcagtggagctggaaagtgacctcgcccagtgggaaagagccttccagacagcaacctttctagaagtagaacggatacaggtgagagtctgtgggactgcaggatgtgtggctccctcagatgcatgaccacttccctagagttctaatatcattccaaagtagtgtaaaaatacagttctgggaatcttgacctcatatacattctataattagccatttttgtttagtgactagtaatacagctctgaataaaattttaatttttccacgacttgatctttccaggctatttcctactactaattaaaaatatatttctaattttaattagacattactctgacttaaatctaatatagaaaatactctgatttaatgaattgttgacaaggtcacttcctgttctccaaatatgacctcctaatttccagcctgttggcgtcatttactcacaatgctctttccctttgcctccatccttcaaagccacacagagtttttgagactttttatcaaaggtcatatcatccaggaacatgtccctgatttccagtccaccctgcctaatgcttgccaatactccttctacaactatcctgttcaaacaactcttcttctcacttttgaacacaatataatgtacttttctggtttttttacagataagaaaacacaaactaatcaattgtattcatactactcatgaaaagcaattacatttttacatgaagtcattaacacatacaacaataaaaatcataaaagtaatacatctgattagaaatacaatataggaaatagattttaaaatagtgtagtttagtgataaaatttatactgtgttttctacttatttatagcagcatctataagattcttctatttatttgtcttttttttttaaggattgcacacactcagtctgttttgtattgcagtgacatgtgcttgttattccctgcactaaattataggttgtttggaattatcttatcatgtgccaaccaaagtccagtgcattttgcacatcatgagtattcaacagatatttattgaactttgtttcttaagtgtgaagttatacactagatcaaactttatagagccctcagcttctgtcttcacaagaccattgaacaaaacagcctcccaaagttggtcctgtggctgacctcaaacagacctgtggacaaattaaaaggttttcatgcgcttgccacatgcaaatagatccatagagcaaggacctaaatacacacatggacacttaattttgaaaacaaatgtggtgaataatctagcattgactatactggaatgtttgcgtaaaacaggattgttggatacatatattttgaacatgttgaactgatttctattttctgactacaaacctctgtaatcaacacatcaagttgtaccagtatgacattacaatcaggggaagaggacagaaagaaaactccaattatagtttttttaattgttcagttgactcttttcaataactctgcttttatcttcatgcacctaaaaagtcttaaatagccaaaaaatagtttccacaattagaacctcaattcaaaaaaatagatattatatcaaaaatggaaacaaaactatattaaatatgattttattctgagtcaagatccaagaccatttaaagcattaaaatataatttaatggaatgtaagttgacagttttgttattgaaatttatatttttaggtttctaaaattattatttctctacaatagtccacttcgcttggaaacagctacatggtaattttaacattttggttccaatttagtattttattttaagtctcctgatatttataaattagatagagataaaatctttgaatctgggctttgtattctgtaaactgatattcagtgaaatacattggcctatttccttacccattcacaatgccagtgtaagataaacatcagaagtgaaaggtaaaacatttaatgtctttttagcttttagttgttctacagattttataactcttatttatttaccacataagaaatcaatgaacacctttgtagtattactttcaaatttaaagtatgtgaatatatttacatgaagaaccttaacacgtttttcttctatattcttaatttatcacttccagtaaagttgatagggaattaaataaagaaggaatataagttctatcgtaaaacaagcagaaagaaaaaaattaatgaattgactttcaaagtgttcctcatttaaacttccttaaaaaggataatttatgtattgatttttctctgtataatttgtttttaaggaaacaaattaaacaacaaattaaatatttcaatattaaacatattaactatacgcatgatatgctattaatattataaatgatagaacttgagtctgtatataaattgagacttcaatgagtctcaatttatagcacatctatttgtttcaatttcatgattattgagaaaatctaatttaatttgtaatgctgaacataataaaaaaattttaatacactgcaccgaatttattttcacctgacattttcttgtttaaatgacagtgcttgaaataagcaaaccattatgtctaaattaggagaaaattttatggccttaaacattccttaatgttgataatagttttaataaagtgctaataggtggatgtaagcatgcacaatgcttatgtattaaacaaatataattactcctgaaaatggacttttgaggcccattaagtatgttctttagtctgctttttttaaaaaaatgtaactctaaaagaataattttgcattattataatttttctatgctaataaggcttaaacacatgaatgtaatttttggtgaaggcaactcgatgtatttagtcatgattacattcagaatgggattcaattaatgtagttttatacacagtactataaaaacaaatacaatgcaaggataggtgttaaaaatttgcttcagataaacttctcttcctttttttcttctctctctttgtctctatttctctctcatcttgtacatggatcacaaatatttttcatgattggaatatcccactacgatttaaaattaaatgcaaataaaactggcttatagatgtaacaatacatcatgtcgtatataaaccttaagtttttatttcatatttgatttatatcctgttttctttatatttcagtatccgtatttactatgaaaaattaggctgggcacagtggctcacgcctgtaatcccagcactttgggaggccgaggcgggtggatcacgaggtcaggcgttcgagaccagcccagccaagatggtgaaaccccgtctctactaaaaatacaaaaattagccaggcacggtggcgggcgactgtaatgccagttactcaggagaccgagggaagagcatttattgaacccaacagacagaggttgcagtgagccgacaccgcaccactacgctctagcctgggcaacagagcaagactctgtttcaaaaaaaaaaaccccaaacaagaaaaattataatattatctgatctcattgtgaaaagtaattacttgttgatttttaaagaattatctgtagttataaacaaataaattggaaagtggtaaatatctgtaggaatatctcgtgcaatatcgaagaacagagtaagactgttaagatcaagatctattcttttggcttggttactgaatctgtatttgtgtgcatgagaatgtggtttaataatatccatgaaattgatatcctgagaattcaagacagtgctatttaacaatagttctcttttagtttaatgaaaatggttggctacagtaaataacaacttaacataaacttgcctacacctaaaactttttatattatataccacctttattgtcaacacagcaaagacagacagtgtagcacaatgtacagacaaaactagagggagcaggattggaaactcggcggggcatacaccttggcaagttaaataaaacccaacactctcagcttctgtttcattaacattaaaatgttgataatactcccttctttatacaattattgttaatattaaattagatattgtatgaagtacttattgcagaagctgtaacatagttcataatattgatattgcatcaataacatgaaaagtaacaatactttctgttctacctagtgcaagacctatgcatgtgtgctagaaagtcatctaatgggactcacaattgatttcagcacaggatttatctgctttgatgctgcaacaaaggtaatgtgttcaggtcagctctgagaaatatgctgcaaacattctaattgaagaatgatttaaatgcctcataactcctttcagcattttaattgtaatcgtgtcaaatttaagatcttcgtttttgttaatggaagataaattatgcttcgatctgaaaaaaagtttgaatttttaataaaacatatgtagtaccacaaaactataactatgtgaaagtatttatttataagtctatctatgtatgtatctatctatcaatcatttccctgttttttaaagatatgactttataattgaagggacattttcttccccaaaaagcagtttttaaaaaacatgtttctttatactttacctgcatcaacttctgcaatacaaaaagaaagaaaacatgttgtttttttaaaaaaaattatagctgacatgttagaattattgaatggtgaaaatttaaagtttagtttctagccagggagtaggacttttataaacacttgacttaataaggattatgcactatgaggtgctcttttcccaaagtgtacatctctgggagtgatgcacattgaatgacagagggtgcctactcagccagtcatacctaaaaaaatccaattttgattattatggaatgacaaatgacaaagccaaagcattgcacattattatcattatttttaattggaagcgatcttaaagctcaactgatccccattcaactgctaatctccttctagtcactgctacagtttgtgacttggaactgttgtccccatggaagacatcctcttccctctcattgaggatctcagttccttagatccattccatttcctccttcatcaaagtatggcttgggtataaattgatttgttccttctcactaattttaaggattcatgagtaatcctttaccagaacacacatattttatctagaaattaagttttgtgtaggattttctaaagcaaatggcaacaaaataaaacagtgatacgaatgtgtaagaaagatggagtgtaggaggcagtgggggttcttgagttgggaaagatgaatgtctaatggtgggatccaggtaggatgccgccctgtgttcattcaccttgtgaatcttcatgactcagcagttggcattgtcctgcaaaatctcacattacttaaacatatagttatttttattttaacatggtaaaattagacagcacacatttgctggtcagatttggccatctaatgtgttgccttcacatcatgacaaaggaatactttgtgaataaggaattttaaatgccaatgactcttgaaaactttcaaatgaggctgccataaactattcctattactaaagttttttttattaaaatgttcatcaaatcaagataggctcctgagtattaaattaatttgataaattaattgaattattaaattatcgattaaatgagtaataagttaattttataaataaatttagaaacaaatttcactaactagaaaagtcaaagtctgattttaaaaagaaaacgctattgccagaattgtcaccaaactctagtacacgaatgtataagaatcttacattagcgaatgagaaaaataaaattcacatgaatatatttctgagtatgcgaatctattctgagtttattttaaagctagcataatacagacctatgtcagtgtcctgttggctctgtataataagggagaaaatcatgacaccaatgtcctatctgacattcctgtctacttctgctgggtgttctgggaacgagtgcgtagtcaggagtgtctaagtgaatgattatgatgccatccagagaaaacagtttagtaggaaatgagaatttaatcagtccaagcttgatactcaaggaaagcaccagaggccttcaggaatagtagtcactgttctattttctgattctttcattggaagcatctaacttcaaggtaatctcagaattgggaaaggctaaaaggaatctacacattaatcaagaaggttatattatccatcactgattatacttggagaatgaaagtaggagctattaatagttatgtcagacataaggaggaggacaagcataaatggagattcctgggcaacccactgagctgggctgactgcaagaaacttgcaccccttcatcagatgaggctggaagttatttttaaatatgataaaaaggtaattgttacatacaaatcaaaacatgctttgtctaatgttttattaaaataaataatatctagttattttctatctattttttctaagtaatatgaatgtgaaaaatatctttaagactatatgtccaagagtttttgaatgtttggattcaggagagtttaccctttagctgaacatgctttgtccttctgcacttcatcttgatcaagtcctccaactttgaagttactacagaagcaaaccaaaggtcttgaaataaagaagagattccaggaaaggggtggactctattctgggtcattatttgagctccatataaagcaaatagtgtattcttaatacatcagtgaaggaaagaattgctgcatctctcttattgcagggaatgagagtcggcatgattttagattacactggtatgctaaacgtttggatatagagggatgtctgggaatgtcgagctaattctcattacttaccacctgtgcttggaagttcccagagtaaacgattacccttgacttgccagagcataagacgtattaaatagcattctgttccctatacttacatttacattagtagcatatcaagaggtgatacattcttcagttcccttactgttgctgagtgattccctccctaattcattactgtacagctcagcttgttctttgtaattctcttccttattaaaatgtagcattttcactgttagagaagggtattattattattatgtcaaagtataatgttaaccatacttaaataatttacatagctaaaagcataatcttgttgccattatattcttttaaaaatgtatatgtgcattaattaattttatatagtgatagagttcctagttaaacagaaacctcatcagtggcatctacaaaacactcatttaatttgtgaataaatcttcactgaatgcctgctgtctcttgagagacatgggagggcatacacatcagtcttcacagacgtttccttgaagtggagacaaggaggatgaaactatccagacagatatctgtaagtgaggatggacatggaatttgagggaagaggagatgagaaatcatgtctgtgggtatctaagagccagatttgaaaaaaggtccagttaagaaattggaagtgattctaagaacagaggaatacctttagggtttgagacaaaggaaagaaatgatcagatgtgtgtttgagaatcgaaaactagtggaataatgtacgactgaaattaagacaatctgggcaaaacccagattccaaatgtgtttttagattctttttcttattttttattttttattacactttaagttcttggatacatgtgcaaaacatgcatgtttgttacataggtatatatgtgccatggtggtttgctgtatccatcaacccgtcatctaggttttaacccccacctgcattaggtatttgacctaatgttatccctccccatatccccacccctcaacaggccccagtgtgtgatgtttccctccttgtgtctacctgttctcattgttcaactcccacttatgagcaagaacatgtgttgtttggttttctgttcctgtcttagtttgctgggaatgatggttttcagcttcatccatgtccccgcaaaggacatgaactcatccttttttatggctgcatatactccatggtgtatatgtgccacattttcttgatccagtctatcattgatgggcgtctagtttggttccaagtctttgctattgtaaatagtgctgcaataaacatacgtgtgcatgtgtctttataggagaatttataatcctttgggtatatacccagtaatgggattgctgggtcagatggtatttctggttctaggtccttgaggaatcaccacactgtcttccacaatggttgaactaatttacactccccaccaacagtataaaagtattcctatttctccacatcctcgccagcatctgttgtttcctgacttttcaatgatccccattctaactggtgtgacatggtatcacgttgtggttttgatttgtatttctctgatgaccagtgatgatgagctttttttcatatgtttgttgcctacataaatgtcttcttttgagaagtgtctgttcatatccttcatccactttttgatggggttgtttgtttttttctctcaaatttgtttaagttccttgtagattctggatattagatctttctcagatggatagattacaaaaattttctcccattctataggttgcctgttcactctgatgatagtttcttttgctgtgcagaagctctttagtttaatgagatcccatttgtcaagcttggcttttgttgtaattgcttttggtgttttagtcatgaagtctttgcccatgtctgcgtcctggatggaattgcctaggttttcttctagagtttttatggttttcagtcttatatttaagtcttacgtttaagtctttaatccatcttgagttaatttttatataaggtataaggaaggggtccagtttcagtttcatgcatatggctagccagttttcccagcaccatatattaaatagggaatcctggctgggtgtggtggctcacatctgtaattccagcactttggaaggccagggcgggcggaacatgaggtcaagagtttaagaccagcatgaccaacataatgaaaccttgcctctactaaaaatacaaaaaattagctggatgtggtggcaggcacctgtaatcccagctactcaggaggctgaggcaggagaattgcttgaacccaggagacagaggttgccatgagtggacatcgcaccactgcactccagcctgggtgacagtgtgagactccatttcaaaaaaaaaaaaaaaaaaaggtggggggagggaatccttttcttattgcttgtttttgtcagatttgtcaaagatcaaatgactgtagatgtgtggtgttatttctgatccctctgttctcttccattggtctataaatctgttttggtaccagtaaccatgctgacttggttactgtagcctagtagtatagtttgaagtcaggtagcacgatgcctccagctttgttctttttggttaggattgtcttggctatatgggctcttttttggttccctatgaaatttgacctcttcaaggagaactacaaactgctgctcaaggaaataagagaggacacaaacaaatgaaaaaaaaaaattccatgttcatggataggaagaatcaatatcatgaaaatggccataaggtccaaagtgatttatagattcattgctattcccatcaagctacccttgactttcttcacagaatcagatttcagatttttgaaatctgtcctccactgggcatttgccactctatcacattcctgagaaaaaaatacatgcatggatgacaaagtcaaagaataacactatgaattgagggaggaaaatgatcagagtgtaacctgagaacaaagagacatcagtacaattgaaagttaacgttccaggaggtgggtgtggagaggaaagctggagaaacagattgggccacatgatcaaggtccagcacaggctcaaccacaatctaatttacacagtggaaagaccattctagctgaggtacagcttgcatcaagcaggtgggggcaatacttaatgggtgcttatgttttccctcaatgactcattatagaataattttgaactttggttttgtaaaaaccaaaaccaaaaacaacaacaaaaacaaaaaccgtaaaaggtagatacttgttatgggcacctccattttatgtttttgttttcgctttacaaaattccatgattctaaaaaagtttgaaagttattctttatataataagtatgggcgtccaacaaataacacctgagtgttagtagttaaaataagaatgaaggcattggaatcccacacctgagacctagcatttactcctcctgctgcaactcgggagtcacagggctgcacgggatgtcactgtagcacaaagaatattcatactatgtaaatatccattgtgattattagaacatcataaatttgactcttaaacatgggtaagagtaaaagacagcattactcatatcattgctggtctctagaatactaggtcccccaaattgttatagtctgattgcttttattattatttaatgttttaatagttgaaattgagaatggctatgatagaatacttataaaggcttctttacttcaatttatttaagagccagtactgacacatagcttgttaaaaacattttttggaaatcaagattggttaacagatctatgaagataataaatatgaagtaaaaggaaacagtcgtaagaatgagctctatcacaggttataagctactgtatactattatataatgattttatggtttattttctctttatctcctttattagccttaattgaatatacattaaaagcattgttatggaggatgtttgttaaaacccactcacatgtatattgaccttcattttgcaaacttacattctgagaattaagaggcaatcaacgtaatcttagctgaaatcacttcattctggtttttcatattttttctacaaaattagaggacttaattattttccaaaataattatgatttacaattaaattcactgttaacacattaacattttaagttcatgaaataccttaatctttctaatccacttaatcctttaaatcgacactgatttctagaatctttcaaggtaaaatttgaattgaagttaatatggcccttttaatttttaaaaatctttgatatggctttgataaactgaaggagctctgagctactgtttctcccaaaggtgtatgaccctcatgtacacacatgtgcacacatacacacactttattacacatctttaggctttttatataaagcatttatatgatcataatatgaattccatagcttaaacttctcaacatagaattaaccttttatttcttaaattttatgttattattccataatctttcaattatttcacatcaaagacagttactaaaaatattaaaaaaattgaaacatcaaaatgaattctttcttgaaatgtctcctgtgtaagtagaaatcttcactatacaagttataatatagttctgacaatattcacataaatcttagcattttaaaattatatatatattttttctttccaattgtgttacagctcaacaatacaaagagctgtttgatgtaatttttatgttcttcttcagataaattatttcttctttgcttttagggaaatgaagaacattgtatttattgcaaaacgaactcagacatttagggaaactctcaggtacttgtttcctaatcttcaagtatttcaaagatagccctaaagtaaatattcaaaaaaatttaaacaaaaaagtattttgaatgacattcaaaaaaacccaacttttcatgcaatatgttattgtgtaatatgaaaaataaaattccctgcctttcttattctttttttttttctttttgaaacggagtctcacactgtcgcccaggctggagtgcagtggcgcgatctcagctcactgcaagctccacctcccgggttcacgccattctcctgcctcagcctcctgagtaactgggactacaggggcccgccaccatgcccggctaattttttttttgcatttttagtggagactaagtttcaccgtgttagctaggatggactcgatctcctgacctcgtgatccgcctgcctcagcctcccaaaatgctgggattacaggcgtgagccaccgcgcccagctcttactcatttcttgatatacaaggacattatagagcattgtgaaaattaacacataattcactgctatgtttataattcaaatatagaaaaaacaaaatcaagaaagattcaaaaggtctttggctaatatatacttttcatacccttaaattttatgtcttgttttccttctccttaaatctttacttttttattctttctttctgtggcttctgatatattttatttttttctggattaatgtttttatgattaagaataactgacttcaaacttttctcatcgtattttagtttacctttgcttaaattatcatttttgatttccataaaagttttgtaactcaaagtattatccttcaaacctgcatgaattgaatgggaatgatataactttgcttttccttacagcgttattctaaaattaaatgagatagcatgttaaaaataataaactgtaaaacataaggtagagattctgaaacatctgagcattatttccagctagcccatatttcaatagatcttgtctcaaccacaacatatcctttcatctataactagaattttatcatgctttttctttctgtttcaaattcctcagaacacatcagggagttgcttctgcaaatcatacagacacagtgagcctcattttcttcatctctaaaatggatatcttaataacacttttctcccaggcttatggtaaagtgtaagcaagaaaatgtgtgtgaagtgttttgcacagtgagacttgcatgatgaacccttagaaagagatgaacatttctgcccctcacacactgtgggatagtcccacccactgcagtacatgagtaccagcgaccctttgctactgtgctaccatcctcaagatgtcgaaggggcactgtgttttctgtaagtcttgatcaaccagtcagcagagttaatgtctgttacatttcagtccttagggtttgtgcttttggaggtctctgtccttttagcccaatgaagattgatgttgaacaagtagtcgtgagtttaaatggttcttagcaaagagagttcaggataacctggaagctgcaaactagattaatgggccattagcaatagttggaaaaaaatacatttcacttgagaatttgtaggtcctgggtgtctaagtaggcacacggtgaaggaagattgaaaggcaagtgtgaaatccctgagacttgacagaacactgacagaggaggaggaaaattaggggttgggaagggcacacaaaagtaaaatagtcaggcaccaaatctgaggaactttggacttcatgttgaagagttggcacttacatcagcagtggcccaagtttgccatgtaacgcataatgactatgcatcactgccttacgaaagtaaacatttgtttctcgtgcttctgtgggattcagaagattgatctggacaggctaatttatacggctgcagttcggatggttctctcgaacatcctctgattgttccttattcttctctaagaatgaggaggttagcccaggcatgtccttttcttgtaaagggcaaagggagaagagagaaagccctaatgcgcaattctattttagtctctgtattgggaacaactgcaaaatcccactgtcagtcaaagcatgtcatgtggttgaggccactatcaagtgggagggcagatcagcccggtccatagaatttgcatcaataaagttcataattaaattccagaagtcatattagtaaatgtgaagaatagtgtggcctcaaaaataaaactatacagatatttattaatttgtcagttattttattttataaagtgcttaatctctgtcagtgggccagcctgcagacaaccttgaggagaacagagacagtggttgtttcttagattgcagaatgcatttacttagatgtacatctctgaggatactcatttgtttttctctttagaatgtttactatccattgaactggcaactgtgtgttcatatgttaaaaagaaataaatagaagagtttattcctacagaaaattgataatacaaattattagtgtgattgaattttatcatgtttgcagaaaaaagcaacaataacaagttaaacaaaaacaaaaataacctttgccatgatttgaatgaatgtgttccttcaaaattcatacattagaacctaatacctcatgtgatagcattaggaggagagcctttcgggaggtgattaagtcatgtggctctgtcctcatgagtggaattagtgcccttataaaagaagttgaagtggtgccctagtcctttttgcccttcctccttctgccacgggagaaggcagcaacaaggcactattttcgaagcagagaatgacctttcaccagacaccaaatctgccagcaccttgatcttggacttccagtctccagaactgtaagaaatacatttctattgtttctatgttattcagtcctggatattttgttatagcaggaggaacagcctaacatgctcttagaatccaagaaatctgtaccaacaaaacaaagttttttgctattttcatcacacagatggcatgtaaactttctgaaaataaaatctgtaggttaagaataacaaacagcataccatgaccagtagtatgtggaaatgtgctggtgctttctttaccacatgaatttggggcattcttttgaaaaattttacatggctatgattaaaataaatattgtaatacatcaacttaccagattgatatcattaaggtattataaaattaatctataatgtttgagttttagaaaaattttaatagaaaaagattaacttttctccttaatagatttcaaataaattctcaaagtgaagacctgtatactcctctgaattttttaatatagttgatgaaatatattttttttatgtgaagttaatttgaagggaataaatttagatgaaatacatttgagggagaagttctgagcttgattagacaatttagttcaatctttaatttaggcaactggcccaatgataatgcattcctgttctattatgtccagttcaaacatgcatgatctctaagactccataataacgacatttcaaaagtgtgttcaacattgagcttgctgtccattttagtctcacacctttgtattcccatctcaactatctaaataaatccagatttaattctatcctcttgccttatccttacccttgccatttagccttttaataactttctctaaacaaatctaaaaggtgttccctcttttccattttcaatattactaacttagctaacctcttctcatttgtattaccacaatatcttccaaataggacttgtcaatttatttattgaagacattcttattatgcatcaattatgctacatgactattgctacatactaggagtataacaacagatgcagtccctcccctcaagaagtctacagtctaatgaaaaggacagatctagaattgggtaggtactttcatgcagtatggagaaaagtctaagcattatgagggcctagttacagactcaagagggataatgccaaatagaaataggatttggtgggacagtttgatcaattgcttaaacagaagattcatcaagacaatttgcaaaggataaaaggtatgtttacggttattgctggacactcatgagtcaaatatcaaataccaggtgatttgtgatgtgagaagagtataaatagatactgccttcaaagcattattgttgtaatttttaacatgttctatagaataagttataagctacataaatcgttctttcaaatgttgttgtttttgttttttacctatgtggtaaaaagctacttttattgcacataaaatagttaacatagggtttagtttacctttatatgtgaaagttgcttcagtttctttaaacagaaatttttctctaggtcatgaataattggacctgaaaacagtgagctggtaaggaaatgaataaagaatgtgctgggggatttttaaccttttttgttcaacatgtaagcctttcattagcattaatacaacttcaccttccatttgtacattattaatgcattacagttttgaatggtctgcatccaaggaacacttgatgtcatttgaaagtgaatttattcattaacctgtgtcccttagttgcagccagctttgtatccctgttttctgatggagctagcagccagctttgtacctgtattgtaagtgtcaaaaataaaaagttagggcaagctttgtttcctcttcccttcccactgacattctctaggttactggcattttcaagctttgagccaattttacaatgggccttactcaaatgaatagcttatgggaaacttttcacatatggtggagacaaattcttaaaatagcagcattattataagaagaagtgatgactcagagcatgctatgaataaattgctttcctgggtttagtgtcttattctaaatgggactctaagtctttcctctattttaagaaagaagtcaggcattagcaataagagtttatttataatcatgttcaataaatgagtctgatgtttggttagggaaatcactaaaaaggtaggtcagaataaaagaagaaatatatgtggaaaatgacagacttagttgtgatttctacttcttagctatgaaatgtggtgaacgtgtatggtgcttcctttattgtatactgggaaattgcaataactctagctattgcatagctcttgcagggatcagagataacataggaaagggcccagcacagtgaatgcccattttaataaataacaaagatgttgcttcactgaaagaacagcagactctcagaatgcatcacacacactaaatgaagtattttcaaattacttataatctgtgcttgtgttcagccatcaaatgattcagtgtcaggaacaaatgatggattacatattatatgcctcattctcttaatatgaaaaattctgcttgataaaatttcaacatttcatcttcaattgcacatggattaatcattacttatgatcacattgtatgtatgtatatatatacatatatatgtatacatatgtgtatatatatatacgtatatgtgtgtgtgtacatatatatattgaggtgcagtcttgctctgtcacccaggctggagtgcagtggtgcgatctcagctcactgcaacatccacctcccaggttcaagcaattctcctgcctcagcctcccgagtagctgggactacaggtgtgtgccaccactcccagctaatttttgtatttttaatagagacggggtttttaccatgttggccaggctgattctgaactcctgacctcaactgatcctcccacctcagcctcccagtgtgctgggattacaggcgtgaaccaccacacctggcccacattgtataattcaatgtgattgcattgaatccaaggttctgtaatgcttacctgtttgcatgcattccttcaaataagatttatctcttatagatagtagctcataggcaaattattcttctgcagaacgtatttttcttttatattctttaattaattatttaatcagcccttagattgaaacagttttaccacatacatggcttttgccattgacagtcttcaatgattctgttatagtgaactccagtagtaaaagtgctgggatttgttgtgttgttctttcttcatctttactttcaggttttgcgtatgggaaatatttaattgtattttaaaattcaagaaaaattatatgcttatcatttcatataaatgtccaaggaatatttttaatgaaacactgtttttgactgtcaaaaacaaacaagttttaataaatcaataggtatcttaaatccattaacactatatgtaaatgtattacatattctattctatagtgcatattttatcacttctcaacttgcatttcatgggaaaaagaaagtgcttgcataaacaatgttaaatgattttcttttatgaaaatatcctcagactatcgtgctaatgaagctcaccaaacgtacgtgaccacatttgacttccttgttctggaggagcaagcaggagcttcacaggtccatggaaagacatgggaaagtaaaaatctggtctgtaattacttaatataaaggttttgggtcaaattccaggctttaaaatattcaaaaatttcatcatacattgctattagttttgttcatttatttatttcttttgctctctcctttcgacttgatctctaccaagttcagcaaattaagactattactaatggcaggaattattcaatccaaattcaaggtcctttgaccaaagttctcgagagaagacagagaccattgggcttgcacagtccagaaaatattactggctgttttcaccatgccttctctaaagttgggcatttcataggcttttataagctctcgttttagtatatgtttcccccacttcccgattacaggcctccaataacatgacaaccacataactacagggaaatgaagtgatttttcttcattaaaattgattctgttttaatatgtttattttacaaaagttggaattattgcacgtcccctgcatgccagtaactccattaggacccagggcttcaacagtgggtcagttagactgactggaagctctcattacaaggagaggtgcacagcaggagggattcatggcaatgaggcctatggaaaaaaaaaaggagaaaggtattgacagagaggggtttcagaaggtcttttagtagttttgcaggaaaagactccctaaggcagtaatatttgtagtgagaccatagcaagaatggaatagctatgaaatgagtaggagtaaaaaggtttcaaagagaggaaatgagaagtgttaaatcagaggcatgaaagggctttgctatttgcttttttccaagaacataaggagggcagggtgaggaagagggagcgagagaataaaaaagataattctgattgtagtgtagaaaataaattcatgtttactttatcaaaagcttttattccatggtgttatttgtatttaacatttgctttgtattttaaacaatcttagttacattttttatatttgatatcagaaacaggaagggtcactggctgtggaagatatcacagatataatatagataatcacaaacaaagcaacagaggtgccaaatgattttaagtaaggaatctctgtttgggaaaggggtgggtgtcggagacatatttaaatgttttcctcttatctgagttccgtatagttttagttgaatatgtggtctcctcgggctaataataagtaatgtggccatgcaatttgctgcccaagatgtgataataaataattattagctaacaaattggtttcctggtattggttcacctgtaagattattttgtcaagcattatttttaaaagactgttatctctaaaatataaacatatactaggcacactaaagagaaactgagagatatttcattctattaattatctaatcattaataagtagactaatcatttttggtagattatttttggtagaggatcacagtttgttgagatgcaattatgaatggcatgttcaccaaaatcaattcaggtgcacttcaggtacatatgttttttaatttagaagaatttgatcttgctacaactctgtgctctattaattgcatatattcatattatcagtgtatagtaaataacataaccaatgttaaaggtttagatgaatttatggtagcattcaaaataatagagatagtttaatttgatagaaataaatttctaaaacttttattctacaaatgggatggaaaaaacagttattagagttaacagatttttttaaatttgaagcattaatagaaagaagacatcatttaattatctgtggatttattctactaatggagacaaataaatatcattcggctcactttgataagaaaacttcatattcaaaatgagtatatttcatttatatggagaatcgttggatcaaaataaaaagttatgcataaagaatgatttgtaaatataccttctccatctaaatatattagatcaacttatttgggcgacgttttgtttttaaaataactactaatcctgtatttcaagcatatgctaatttgttccatttggcttttatgcaatcagttattcccatggtgaatgggtgaacattaaacaacattttgtgcaattgcatacttcttatcaactttatgatatattagaattcactagtcaatttttcatttaatgctcaccttacttttttaacttaactaaagttgagtctaaaacatcaaactgtaagataagtatatatagttctatattataatccaaaataatataaaagtaataaatatagtcttaataatataataaacaacaaaacgtcttttacaagcattcaggttactgcttacaaactctacagaatggccatttatcctctttcctgtccatattttaagtacgtgacacctctaatttcctctgtttttcaccgccccgttgaaagattgcctgatgccagaggacaggttgcagcaagcaggctgttacaccaactggctcatgagcagaggtgttgaatacttcccctgcaatagacctgaagaaacaagctgcctttagcacctcatatccagatgcacttagttttatcagcaagtaccatgtctattgcatttttgctaaccaggagaatattctggtttgatataaattttgaccaccaaaaacaaagccttgtgccgatgctgctgaattacagaggtgcatcttctctacccacgcttcctgagtgtgactgtaggattggcaaggctctttagtattccacacttgaaaaagaaatgaacttctacctactctgtcttccctctcaggttataacacaataatacacatcttcacattttatccttcttcagtgcctagttgtgtacaggtatgtgacatgtggtatgtgtgtgtacaaatataatttccatttggagagctaacttcctaaacccacattaacatgttattaaccaggaactcctcattgcattaaaatagtgcactgaaagagctcataacaaagtcattcataatcttctcatcaatatcactaatttctaaaaattaataaataaaatattttattactgtttattacacaaggtgctatggagcagttagtaaggacacatatttcagccagtagtgtgtttttgaaaaagcttccctaaggagttatgattttcctggagactgaaacataaaacgagacatgaactggccgaagttgggggagcgctcaagtggggcccctcaggcagagtgggcaacaggcaaggtggaaggaatgagcaaaagcatcatgatttgtgaataatcaagagttgcttggctggaacagagtacagttgaaagtcagtggcaaaaatgagattagaaatttgaggctgggcgcactggctcacgcctgtaatcccagctctttgggaggccgaggcaggtggatcacaaggtcaggagatcgagaccagcctggctaacacagtgaaaccccgtctctactaaaaatacaaaaaattagcagggtgtggtggcggacgcctgtagtcccagctactgaggaggctgaagcgggagaaaggcgtgaaaccaggaggtggagcttgcagtgagctaagattgcaacactgcactacagcccaggcgacagagtgagactctgtctcaaaaaacaataaaataaagtaaaataaaataaataaataaataaaattgagcaaggctaaatcttgaaggattttgtgtgtcttaacaaggatttaaatctgatcatgatactaccattgaaagatgttatgtagcagaaatatgatttaagttgaaaaaagggaagggagtgggcttacattatacaatgtggaatgtcaagagtagagaaaataaattaattttgaatttactgtgaatacgcaagagagaaaaggtatctaaactatattagtggtgtataatgataatgatgacatagagattcatgaggtgtgtgggaattagaattaacagaattagaggcagggagtctgatggtaaagttgattttattttcaaatgtaatgcttagaagatggagtaaaagtgctgacaatccctaaaataaattaaagaagagagtggttgaggggaagatgaaaattcacttcaaatatatcaattttaatctctatacaagctgtcttagattgggttccgttaagagttttctttgagagagctttcaacagatgatatttctagatgctgggagtccagcagccctcccaacagatgtgagcagagaaccacaatatccactgcagtgcacatctcccattccacagccccactggctttttatgctaaagtgggcccatccaggtgcattttggattctcactggccctggattctcactggtccttctgtagaaaacaagagaagggttagtgagatgataaatagcccctgctgctatggctgttgtcaaggccataactgacaagcatcatcccctcctccactcctcattcttgattggccctgtcattaccataacatctgctgctctgggaagtttgcctcctgggctaactcacactgtcatcccaagagctgatcctgtggctatggatgctgatttattcccactgaccattaaaagtgacaatggcagcataaacatttagcagagttattgcatgccaaataagttcttcttcaccttcctcctacctcctgattgtgttaagggacaattatccctgcagaaggtgactccttaaactgtttactgatctcttggtacaaagtgtttagaagcaccagaaagcaccgtggcttatggcctccacttgcacagtacagagttgtcagcacaagatgctcacattccccatttgagcagctgggaaaggtgatagctgcaacctgtcctaaatccacctcttcgttctctgacccatgtagtctacctacctgccagggacacagaactgtgtattggtcagtgattccaggtctattccaccacaccttgggggtggtgtccccttctcatagtatatctcctagatgaaacactaactatatacgaagaggccattgaactgtctgtcctcttttgcccaaactctgagggtgatgcagcgccgagggcaccactaggtgtcttgatgatgctccagcacctcttttgttgtacaatggttctgtagggatgaggagttacaaagactcctgcaaaaattctgcaagtcctaaaatgttgaggcctggtgaacaggaaaggcaaactcataccagagtgtgtgtctattcatgtctaaataaattaatgcctctttggggtgaaaagagcccaatattatcaatctgccaccaaatagttgattgatttagccacattggtggcaccttgagcactcatttttggcttctattggtgacagattgaacattcagctgtggtagaagctggatcctcctgtgtgcatgaggagtcaggttgggctcatgtgtggcccgcatttgttaatgcattctttatgccaatgacagagccaggctgttgtaaaatctctgaagtattaggagtgctcattgtttggggctttttcctcggacccctttttccctaatgtgatattttagtaatcctagatccctgactgggtcaaatctttcacctctgtccatgaatcacccatattcttatctcattccacttgtatttgcagaaaatggatacccagatgcactgtccagagttctgtgcagtggggagcattttctcctcacttatgttttaagaacaactaactgaggggctgttgaagaggaaacctcaatatttagcttgcatgctgagcctgtctatctgtgagcaaatcttcgccttttgttctatcttaggtcaccatagggattgtcccttaggtggcatatttgctagttgttgagtggtgcaggtcctaggctggtgatgagatggacacctgggctgccagcttggatagcttgctggtgccctgtggcttggctcatccctgattccaggtgaatacattacatactacaactttttacattgccctgctgtaccttatagcttattaggcagacagagtccaaatataatgtgtagccctggatacatgggatacatgtaagcatttctctctacaagggcctctgactaagaaatggtaagcagatttgctggagatggaatcacttttctccagagaccaaagaggtctatattgtgattctcctatgagggcttcacataaatttcacacaggttctttctttggaatagacacttctaatgtcatagagtttggcaaattaagttaagcccatgtctacctcccctccagtgatgggggtctcttttgtcagccagctagcaggcaatccatgtccaatatttcatttttgcctttgtattgagaactacacctagcatgagctatgctagtttgaatttcatagagtagtattcacggcagagaaataggtttgtgagttggtacactcaggacacacctgtatgtaaagaggaagggaggataggcaagaaggataagctgacccacaggtaattgtacctaagggctagtcatacttaaggggaattctgaagctttgattgtcctacagagttatcctaacagaaacaacagggtcagacatttatatttctatatcacctaggacttcaactgtgaccaaggaattcattatgatgggtaaaaaggcaaatcggcagcagcaggtaccccgagcagctgggagatgggagtgctaaccctgacctggagggagcaccccgtattcactacacggactgcgatgctaaaaagtagttggataagaaaaaatgagagcgattgggaagagaagatagatcagtttcagaggagactggaagaaaaaaatttcaatccagaatattgtacaaatatactttggaaatgataaggtttaattaattttgaatgaaagaaagtgatttgaatatatgaaagtaaaactatatttggaaaaacaaagagaaccgtggaaagacatgcttagttttctctgctaagtggagggggctatgccacatattgagtgaggccgaggggatgaaggcattaattagtgtgaaaaagaacactgctatttaaaaggctttgaaataatcaaattagtgaaagcacatatctcttcaaaggatttaagcattcacagtaaaaaattatttctgcttttattatttcacactattttggcactactcagcactctgtttgctctgacattaggggcattacatgacaaaagctttatgcattaacgaagatgaacaaaaagattataggagcaaatggaacaagaggatgtgttttgcagacgtgatataacctagaactagcagtcagcatatgtaccattaatggcattgaaaaatcattatagacattcataaggatatgttgtctcaaaatgctatgaattttatgacatgtttaagatgaaataaaaagaatttttaatgaatacagaaagatccatcataaaatatgaaggaggcaatattcatcttcagaaagttcttacttctgcttccatatcctcccagaagcatcaccattagtacttgtattcaggtgacttctgacattcaagtttgccatcagcttactgttctattggaagaacgctactaaactagtttgaaataatagaggaaaaaactttgcaatctacaaagcgattttatgagcattattatttcacccctttttacactcacctttaaagtagaatagtcagacattattacttctaatttacagtaaaatatgatcaggctctaataaattaagaatcttgcccaaagtcatgtggcttataagtagaatataaaattcagattacattttagggtttgtggctctgagctcagtattcatctttatttcagtacactgccaacaacaaaatacatgatcattcctgggatatatgcattgtaataggggaaagcatcttaatttcctgatgatggagttcaggccagtgcctggagaagagggcacaaaaggagataaacaggagagagtggtttctggtctttagaatccccttgatctcattcgatgtaggcaactactgattatcctagagtgcatgaactttaccagtatgagaaaaagggagacaaattggcatatttttttgagagttttagtatcattatgcaaattagtaaattctacacatattttatacagatctcattactatatcttgatttactttctacctgattgaaaagcttttgacgccaaaaattcttgctcctgtgtttcttactagcacctggtttctaaccaaatcaaagtgaattaaataagccatcccactctacacgtacttctaacagcttactcaacactctcctgtctgggtctacctcagagccagctataaggcatttacaatggcactcacaatttgcattacagagcaatgtaaactacatgctatcaaaaatggtgatgtctgctcatccttttcatcattaatattcttaacacaattgccatagtgtttatcagaatcttaggaacaaaatattggtaaaagaaataagactgccaataagtccttgagtttagccatttttcagaactttataactttcattgacaataattttgacttaggttattccaaattggccttagtaaatttctttgagttttacaagtttacacaatttgcctacgttcttgtctcttttcctagtttactgcattatcttttagctgacaagtccttcagttaagtatattcattaacttctttatatccatctttggggtatcctactgatagccaaggattcatgcttcatattcaaaaatgtatcaaacctctttcatatgactctaatacacattcttatagccagaggaactttattatgagtttttaaagtctgttcactcttaaaagtacatctagttgaaatagcaaatacctgtttaatagtgtaattactatatataaaatatcatttcaaatttataattataatttgagaatttcaaaaccttgcatttatagttaagccaagctaaaaataaagtatcttgtccaacactacacagtaggttaatgtcaaggcgtgctacaaacagtgaggtactttggcagacattttttctctatttgttacaggtgtctttgtttgttttaacataaaataaatttcacgtccttatgtttcccctaacattatattacttgcatttttccgtatatctacataatactcatcagcattattttaacacaaaatgtttagaattttcattttttgatattcattaataataaggtgtttaacatattcctttacattttatatattgtatttccatacaattaatttttataaatggaatttctggatcaaataatattaacattttaagggcttaaaatatatatttaaaattgctgtactaaaattttacaacgtcatcaacaatgttatgtaaatattttttccacataaccttactagctttagttaatataattttcagtgatctttactaatataatgatgaaaaaaacagtctctgtaatattaatgcagtcttcttgatttctaatgaggttgaacaggttctcctatggttgttaacaaaaataattgtttttccttttttaaaaaataacatctttctgcaatattttttgtattttgtgtatttttttcaacttttattttagatacaggaggcaaatgtgcaggtttgttacatgggaattttcatgatgctgagattcaaggtatggatcctgccactcagactgtgagcatagtacctgatagacagtttttcaacagacaaccccctccctacccctctagtgttcttcagtgtttattgttctcatatttatgttattttatgctcaatgtttagctctccttacaaatgagaacatgtggaatttggttttctgttttgcatttaatttgcttaggattatggcctccatctctatccatgctgttgcaaagggaaagattttattcttttttatgaccatgtagtattccatgatgtataggtaccacatttttttttccaatctaccattgatagggacttgggttgattccatgtctttgcaattgtgaatagtgcagcaatgaacacatgaatgaatgtatctttttgatagaatgatttatagtcctttggatatatacccagtaatgggatatctgggctaaatggtatctctgttttaacttctttgattaatcatgagactgctttccacagtggtggtgcaaatttacattcccaccaacagtgtataacactctcttttctcttcagccttaccaggatctgttgtttttgacattttaataatagccattttgacaagtgtgaaatggtatctcattgtggttttgatttgcatttctctgatgattagtgatgctgagcattttttcatgtgtttgttggctgcttgtatgtcttcttttaagaaatgtgtgttcgtgtccttcgtctattttttaatggagttttttcttttctttatcaggtgcttagagtttttcttacattttatcgtattttatactatatagcattatgactattatttttcttttaatattggttaatatgcattaattttactaaatgaatttgtaatttcttattactgtcatgtctaggacttcatatatttccaaaattactaaaaattcacttatataattctatgtaatttttctataacttagattgcttaaattactttactttttgaaatatgagagatttgctttaaaggaagttatgtgatgaaaaacttaactttaaaatattttttccaaagacttaattgccccaaatagttttattgtgaaagggatactatataaaatatatataaaggaaacattgaagatgaattgaaatgactggatattgcttttcaataacttgcataggttaatgtagtaagaaacaaactatagacatttatttatacagagactattgcttctcggccttttggctaagatcaagtgtagtatttatatagagactgacatcttcaggatagtgacagtatctttttcattctaattatctagcaaaatactcagtatatactagccacttcataaatatctgttgaataaataaattttttaaatgaaattctatattaatttattctgcctcaatatcattacatattacttgaaaattctcccatcattattgacatatctatgattttaatgtttcactatgtatttttaaaatataaaaattttaattagtatttgctttgaatggattttgaactatgttgtttccagaatcttttctttctaaatggtggcactttctctctctctttcgctctctcatctctttctctgtctctctctctctggagatatatatagatatgtatatatggacatatatatatctctctatatatggacattatatatctatatatatggacatgtatatagatatctatatatatggacatatatatagatatctatatatatggacatatatatagatatctatatatatggacatatatatatctatatatatggacatatatatatctatatatatggacatatatatatctatatatatggacatatatatatctatatatatgtccatatacatatatagatatatatggacatatatatctatatatccatatatatctatccatatatatgtccatatatatatatctcaaccatgcaacttgtaatgttaaacaattttacaattcagtggctttaattaatttacaccactgtataatcattactactatctgttcatcatccgaaacagaaactctgtaactattaagcaataattactcattcttcctgcccgacatattggatttaaaaaatgatctaactgtatgctgtacacaagaggctaacattggatctaaagacacaggtggtttaaaagagaattgttgagaaaatatattccatgcaaatgatagccaaagaaaagctaattttctaaactaatattagacaaaaactcctccaatctaaaggagcatgttctaaaccaatgaaaggaagctaagaaacttgaaaacaggttagaggaattgcaaactagaatagccagtttagggaagaacacaaatgacctgatggagctgagaaacatagcacaagaacttcgtgaagcatacacaagtatcaatagtcaaatcgatcaatcagaagaaagggtatcagagattgaagatcaacttaatgaaataaagtgtgaagacaagattagagaaaaaagaatgaaaaggaatgatcgaagcctccaagaaatatggaactgtgtgaaaagaccaaacctatgattgattggtgtaccagaaagtgatggagagaatggaatcaagttggaaacactctttaggataatatccaggagaacttccccaacctagcaagataggccaacattcaaattcaggaaatacagagaacaccacaaagatactcctcaagaagagcaccacaagacacataatcatcagattaaccaaggttgaaatgaaggaaaaaatgttaagggcagccagagagaaaggtcgggttacccacaaagggaaacccatcagactaacagtggatctctctgcagaaaccctacaagctagaagagattgggggccaatatttaacattcttaaagaaaaggattttcaacccagaatttcatatccagccaaactaagcttcatacccaaaggagaaataaaatcttttacaaacaagcaaatgctgagagattttgtcaccaccaggcctgccttaccagagctcctgaaggaagtactaaatatggaaaggaaaaaacagtaccagccactgcaagaacataccaaattgtaaaggccatcgagactatgaagaaactgcatcaactaatgggcaaaataaccagctagcatcataatgacaggctcaaattcacacctaacaatataaaccttaattgcaaatgggctaaatgccccaattaaaagatcaaaaaacacaaagaagggcattacataacggtaaagggatcaatgcaacaagaagagctaactatcctaaatatatgcacccaatacaggagcactcagattcataaagcaagttcttagagatgtacaaagaaacttagactcccacacagtaagagtggaatattttcacaccccactgtcaatataagaccgatcaacaagagagaaaattaacaaggatattcagaacttggatcagctctggaccaagtggacctaatagacatcaacagaactctccaccccaaatcaacagaagatacattcttttcagcaccacatcgcacttattctaaaattgaccacaagattggaagaaaaaacactccccagcaaatgcaaaagaatggaaatcataacagtctctcagaccacagtgcaatcaaattcgaactcaggactaagaaactcagtcaaaactgtacaactacatggaaactgaacaacctgctcctgaatgactactgggtaaataaatgaaataaataagttatttgaatccactgagaataaagacacaacgtaccggaatctctgggaggcagctaaagcagtgtttagagggaaatttatagcactaaattcccactggagaaagtgggaaagatctaaaatcaataccctatcagcacaattaaaagaactagagaagtaaaagcaaacaaattcaaaagctagcagaacacaagaaaaaactcaaatcagagcagaaatgaaggaaatagagacatgaaaaacccttcaaaaaatcaatgaatccaggagctggttttttgaaaagagtaacaaaatagaccactagccggactaataaagaagaaaagagaaaagagtgaaatagaaacaataaaaaacaataaagggcatattaccactgatcccacagaaatacaaactaccaccagagaatactataaacagctctattcaaataaaccagaaaatgtagaataaatggataaattcctggacacatacaccctcctaagactaaaccaggaagaagtcaaatccctgaatagaccaataacaagttctgaaattgaggtagtaattaataacctaccaaccaaaaaaagcacaggactagatggattcacagcagaattcaaccagagttacaaagaggatctggtaccactccttctgaaagtattccaaaaaatagcaagagagggactcctccctaactcattttatgaggccagcatcatcctgatagcaaaacctagtagagacacaacaaaaaaagaaaatttcaggccaatatttctgatgaatatcagtgagaaaatcctcaataaaatatgggcaaacgaaatccagcagcacatcaaaaagcttgtccaccatgatcacgtcggcttcatccctgggacataaggctgtttcaacgtatgcaaatcaataaacgtaatccatcatataaacagaaccaattacaaaaatcacatgattatctcagtagatgcagaaaaggccttcaataaaattcaacacccttcatgctaaaacccctcaataaaataagtattgatggaaagtatctcaaaataataagagctatttatgacaaacccacagccaatatcatactgaatgggcaaaagtgggaagcattccctttgaaaaccagcacaagactaggatgccatctctcaccactccaattcaagatagtattggaagttctggccagggcaatcaggcaagagaaagaaagaaaggatattcacataagaaaagaggaagtcaaattgtctctctttgcagatgacatgattatatgtttagaaaaccccatcgtctcagaccaatatctccttaagctgagaagcaacttcagcaaagcctcaagatacaaaatcaatgtacaaatatcacaagctttcctatacaccaataacagacaaacagagagccaaatcatgagtgaaattttattcacaattgctacaaacagaataaaatacctagggatacaacttactaagaatgtgaaggacctcttcaaagagaactagaaaccactgcttgaagaagtaagagaggacacaaacaaatggaaaaacatccatgctcatgaataggaagaatcaatattgtgaaaatggccatactgcccaaagtaatttatagattcaatgctatcctcatccagctaccattgactttcttcacagaattagaaaaaactacttcaaatttcatatgaaactgaaaaagagcccacacagccaggacaatcctaaacaaaaagaacaaagctggaggcatcatgatacctgacttcaaactatactacaaagctacagtaaccaaaacagcatggtacttgtaccaaaacagagatatagaccaatggaacagaatagaggcctcagaaataacaccacacatctatgaccatctgatcttccacaaacctgacaaaaaaaaaaaagcaatggggaaaggattccctatttaataaatggtgctaggaaaactggctagccatacgcagaaaactgaaactggaccccctttttacaccttatacaaaaattaactcaagatggattaaagacttaaacataagacgtaaaaccataaaaaccctagaagaaaacctaggcaataccattcaggacataggcatgagcaaagacttcatgactaagacacaaaaagcaatggcaacaaaagccaaaattgacaaatgggatcttgttaaactaaagagcttctgcacagcgaaagagactatcatcaggatgaacaggccatctacacaatgggagaaaagttttacaatctatcaatctcaaaaagggctaatatccagaatctacaaggaacttaaacaaatttacaagaaaaaaacaaacaaccccatcaaaaagtgggccaagtatatgaacagacactctcaaaaaaagacatttatatagccaacaagcatatgaaaaaaagctcatcatcactggtctttagaaaaatgcagatcaaaaccacaatgagacaccatctcacaccaattagaatggtgatcattaaaaagtctggaaataatagatgctgaagaggatgtggagaaataggaacacttttacactgttggtgggagtgtaaattagttcagccattgtggaagacactatggcaattcctcaaagatctagaaccagaaataccatttgacccagcaatccattactgggtatatactggatgtggggctgggggagggatagcattacgagaaaacaacatagataatggattgttgggtgcagcaaaccaccatggcatgtgtatcccagaacttaaagtataataaaaaaataaaataaatacaacgtggcggcatcactccatttgattttaaacagggctatagtaaccaaaacagcatggcactagttcaaaaccagacacatataccagtggaacagaatggggaacccagaaataagaccatacacctacaactatttcatctttgacaaacctgacaaaaacaatcagtggggtaaggattccctattcaattaatgatgctgagataactggctggccagttgcagaagaaattggacccctttttttgcaccatataccaaaattaacacaagatatattaaagacttaaatataaaacccaaactataaaaactctggaatacagcctaggcaataccattctagacataggactgggcaaagatttcatgatgaagatgccaaaagcaattacaacaaaagcaaagattggaaaatgggatctaattaaactaaaaagctctgcgcagcaaaagaaactatcaacagagtgaacagacaaccaacagaatgggagaaaatttttgcaaactgtgcatctgacaaaggtctaatatccagcatctacaaggaacttaaacaaatttacaagaaaaaaaaaacagccttattaaaaagtgggcaaaggatatgaaccacacttttcaaaagaagacatacatgtggccaaaaaacatatgaaaaaaaaaaaaacctcaacatcactgattattagagaaatgcaaatcaaaaccacagtgagataccatctcacacctgccagaatggctaccattagaaacaaaacaaaacaaaacaaaacaaaaacaatgctgacaaggttgtagagaaaaaggaaagcttttacctggttggtgggagtataaattagtttaaccattgtggaagacagtatggtaattcctcaaagacctaaaaatagaaatattatttaacccatcaatcccattactgagtatatactcaaaggaatatagattgttctatcataaagagagatgcacaagtatgttcactgcagcactgttcacaataacaaagacatggagtcaatctaaatgcccatcagtggtaaactagataaagaaatagtggtgtatatacaccatggaatactaagcagccataaaaaagaatgagatcatttacattgcaggcacatggatggagctggaggccattatctttagcaaaccaatacaagaacagaaaaccaaacaccacatgttctcacttataaaaaggagctaaatgatgagaacacatggtcacatagagaagaacaacatacactgaggcctatcagaggacggaggtttggagaagggagaagagcaggaaaaataactactgggtactaggcttaatacctgggtgacaaaataatctgtacaaaactcctccatgatgtaagtttacccacataacaaaccttcacaagaacttttcttttttttctgaggcagagtcttgctctgtcacctaagctggagtacagtggtgcaatctcagttcatcgcaacactcacctcctgggttcaagcaattcttcttcctcagcctcctgaggctggcattacaggtgtgtgccaccagtcctggctagtttttgtatttttagtagagatggggtttcgccatgttggccaggctggtcttaaattcctgacctcaggtgatcttcccgcatccacttcccaagtgttgggattacaggcacgagccactgcacctgaccaagtacccctgaacttaaaataaaagttaaatgtaagaaaaagataatttaacagtttctcacataacaaaacatactgttaccatccaaatcttattccatggtatttactcaaagtatctaaaaagctatgtcctcacaaaagtctgcacatggatatttagagcagttttattcataattgcccaaacatggaaacaaccagcattcactttagtatgtgaatggataactaaactatggtatacctggaaaatggaatattattgagcatcagaaaagaaaagccatgaaatggcatgatggaaacaaatgcacattactaagtgaaagaagtcaattggaaaggattatatactgtatgattccaactatatgagattctggaaaaggcaaaactgtgaagatggtaaaagaccagtggttaccagtgattgtgggaaagagagggatgagtaggtggaccacagaggatttccagggcaatgaaactactctgcaagacactgtaatggtagataaatgttattacacatttgttaaaatccatagtatttataacaccaaaagtgaacccaaatgtaaacttaggactttgaaggataataatatcaatgtaggttcgtagattataacaaatgcaccactctgtttcttttgcttattatttctgtgaacatgaaactgctctcaaaaataaaatctattattaattttaaaaaaatcatacacacacaaaattaaccaactggatctaacagacatatgcatgccatatattcaaccacagttgaatacacatttttctgaagggcacatgggacattcttcagattagaccatgtgttaagacacaaaatacgtcatgatagattttaaatgattgaaattatacaaaatatcttttctgctcacaatggaatgaaactaaaaatcaataacagaagaaacactggacaatccagaaagaaatggaaatcaacacactcctaactgtcaactggataaagaagaaaacaaatatttagaggaaaatgaaagtgaaacacaaacataccaaaatatatgagacaaagcgaaagcagtactaaaagggaaacttgtaggagtataagtatatatatattaaaaaagaggatgaaaacaaaaactcatctaaaaataagaaacatcacaaatcagtgacctgacattacatcttaaagaagtagaaaaagacgagtagactgaaagctagctagaaaggtgaaaacaataaagattatagttgaaaaaaataaaatagatactagaaagtaatgaagaaaaatcaacaaaattaaaggttggttccttgaaaaaataacaaaatttataagtctttagcctgattgtctcaacaagaagacccaaattactaaaatcagaaaaaaagagaagagacattttgataatattgtaaaaataaatggattaagagacaattttatgagcaattgcatttcagaaatttgataacctagatgaaatagataaattcctggaaatatacacactgccaaaagtgaatgaatctgtagctattaaggggattgaatccataatcataaatctgtcaacagagaagaggcctggaccacatagctttattggtgaattttaccaaacattaaaaaaatcaaagttattctcaaattcttaccaaaaaaaaaaaaaattgaaggagtgggaatgctttgtaagtcattctgtgaggccaacattaccttgacaccaaagccagaagaagatgctacaagaaaagaaaatagtagctcaatattcctaatgaatattaatttaaaaaactctcaaaaaatactagcaaacagaactcagcaacatattaaaaggattatacaccatggccaagtagtatttattaatgaaattcaaggaagattcaatatatgtaaatcaatcaatgtaatacaacaccttaatagaatgaagtttaaataaaaatacaagaatcttctcaattaatacagaaaaatacacttgtcagaacgcatcaacctttaacaaaaaaacttaataaactaggaatagaaagatatttgaaatatgaaaaacgacccacagataatattatatccaatgctgaaagactgaaagttttctcctaaatcaggaacaagaatacttgctttgacttcttctgtttgacatggtattattgacagttttagccagagctattaggcaagaaaaaaaaaaagccaaagaaaattgaaaattagtaaaattatctctgctcacagatgacataatcttgtatgtagacaactacacacacaaacacacacacatcagatgtattaggccattcttggatcagtataaagaaatacctgagactgggtaattcataaaggaaagaggtttagttggcttactgttcttcagcctatacaggaagcacggtgctggcatctgatggcttctggggaagtctcagggagtttttagtcatggtggaagatgaagtggaagcaagcttgtcacatggcaaaaataggagcagagagagagagagaggaggtgacacacatttttcagacaggatttcctatgaacccagactgagagctcacttattgccaaggggatggcccaagccattcgtgggtgcagatctttcagatatctgcccccgtgatccacacacctcctataaggcccctttccaaacactggggattagatttcaacatgagatttaagcggggacaaatatccaaactaaataaccacacaaaacctgttttggctaatacataataatagcaaagtcacagtatacaaaatcaacacacatacaaaaagagttgtgtatctatacactaacaatgaataatctggaaaagcatttgagaagacaattttatttacaataacataaagagaataaaataattggggatatacttaaccaagtaggtgaaagtcttgtatactaaaatctacagaaaattgatgaaagcaatataaaagaaacaacatcctgtgtttatgaattgaaagacatattattattaagatgacaatatgatacaacgcagtcctcatcaaaatgtcactgatattttttgaagaaatagaaaagtccgtcttataactaacataaaattttaaggatccccaaatacccaaaacaatcttgaaaaagaacaaaagttgtaggtctttgacttctgattacaaaacttattacaaagctatagtaattaaaatagtgttgtcctgtcatagagacagacataaaaacatggaatagaatagagatcacagaatgaacctcatatgtatggtaaaatgattttcaacaagggtgccaagaccatccaatgaggaaagagcagtgttttcaactaatggtgtttgttagtaaaacaaaatactcacctgcaaaaggataaagttagaccctggccttataccatactcaaaaattaactcaaaatgagtcaaagacctaactgtaagagttaaaatgataaaacttgtagaagaaagcataggggaaaagcttcattactttaaatttggcaataatttctttgctatgacgccgaaagctcaggcaacaaaataaaagatagataaattggacaacattaaagcgaatgacttttgtacatcaaagggtactacaacagagtgcaaaggtcacccacagaatggaagaatgtatttgcaaatcatatatgtgataatgggttaatatccaaaatgtataaaatgcttatacaactcagtaacaacaaaacaagcaactcaattcaaaatagaacatgagtagatattgcaacaaagaatatatacaaatggccagcaagcacacaaaaagatgaccaacatcactagccattagtgaaatgcaagtcagaaccacaggagttaccactttacattcattgggatggcaaaaatcagaaagaaaacaaacaaagttgttgatgaggatgtggagaacctcataaatggaagagtaaccctttctttcacattgctggtataattataaaatgatgtagcctctgaaaaacatttggtggttccacaaaaagttgaacataagttaccatatgatttaacagtgcagcttctcagtatatacaccaaagaattgaaagcagggacttaaacagatacttgtacaccaatgttcatagaagtatgactcacagttgacaaatggtgaatgcaactcaagtgtcggtcgataaatgaatggataaacaaaattgggattttcagacaatggaatattatttagccatggatgggcctcgaaaaccttacgttaagtgaaataagccacacacaaaaggagagatgttttatgattccccttaaatgaaatacctagaataggcaaattcttagagacaggaagtagaataaagggtgcctggggcagtggggaaagataagtgaagacatatgattaatgggtacagagttcctgtttaggatgaaaaaaatattctgtaaatggctagtggtaatgattacacaacattgtgaatgtatttaacattcttcaatcatacatgtaaaaatcattacgatgctaaattttatattatgtatattttaccacaccaaaagaaaatgtgaatgttctttttatttttataattgttaatgttaaataataatttgaaattagaaaataaggaattatagataatgtaaaaatacatgagtatattctacttaattttgactgttcttatacaaatgttttagtaataaagtaatcaagatatggagttttagtactctaaaagtcatgcttttcttcacatagatctatgttgaaataaactataaaactgtgttaagaccagctaccccagctgaacgaacacacacaacacatcacactcaaatcacatgccttaaatgaaagcctctcagggatatccactggcatcattaacaaaaaactgtgagtcctttttgattcaaagaaaatctttggcctatctattcatgagaaaaacatcgaaaacattacaataggtgctagtctacaaaatacctgacaggactcctcaaagttttcaagtacagtctgatgaggaactgagaacctgtcacagccaagtggagcctaagaagtcacaatgaataaatgtaacatgacaccataacagaaaaagacattaggttaaaactaaagatatctaaataaatgatagaccttacttaataatctgctgatattagtttattaactgtgacaagacaccatactaatgtgagatatcattaattgggcaaactgggtgtggagtggatatgaactttctgattgtcttaacatttttgtaagtcatatatatgtataatatatatttgcatatacatattgtaaatatatataatatataatatattatattgtaaatatatataatatatattatatatatacacatatgctttttattttccctgcaaaacatctttagacttgtaggatgggttcaatgtcattatgtagtcaaacaataaatgcaagtttacttttttttagtgcttttgctcttctgcagattgtatgctatctaaatatgctattgtgatattggatgatgaggtatagtcaaaaaaccttatagacttctggaaggaattctgatctagtaagaaatgaatttcattataaaactattagctccagattaacaccccctcaggtattcttggagctacaaatctggaaaagtagtataatgcactgtaggcctatataaattgaaaaattgtctcctgaaagggggtagcagaaaatattgacttcaatcatgaagggttatgcttcagtaattccttgttgcatctttctgaaatgatgcactgaactagtagaattgttcagaccatggacttaaactttttcttgagcgtgctactcatattcctccacatttgtcaaactaagggtgcctcagaaatctagcttaagtactacaagtttttttgtgcatgtgtgttttactcttaaaaaattggcgtataaaaattaatatttaagaacacatataaagtaaactgggtactaggattctaccttatcatatgcttaccttatgtattagttatacaattaaggtaacattctattattttatataatctccatgtcgaattttccttttacctctgttactttaattcttaaattttgatcttgttttagtattaatctgttgaagaaaaatgccaaaattttaatttcaaaaacaaaaattttcacacttcgttccttccttctttctttccttcctctctttttctctttctctctttctgacagggctcactctgtagtgcagtggcacgatcacggctcactgtagcgtcaaccactgggctcaggtgattctcccatctcaatctcccaggtagctaggcctacaggctcatgccatcaagtccagctaactttttgtcttttttgtagacagggtttcatcatgttgcccaagctgtgtaagacacaatttttttttaaatgtaaggtacattttttccccatgtaccaagataggaaaaaagcaaaaacacacactttattgagttgaaggtgaaagttgcagtttttttgtctggcattgttaccactcaccattaaaatacatatgtacaaatggagaccatgggtaatgtctcctaattataaacctgtaatatctaagctgaaaatattaccacgaggaaaagttatgcatatgaatatttactgtggaattgctggttggagataaacattttctcactccatttacccttaaatgtatttattggaacctttaccaatctcattttctcagtgtcagtgtgagataatcttggagaacaggcattttaccaggaattattttacattttgctaggtgaaggggtactactttctcattagaaactctgcttaaagaggctaagaccttaagaaatctgggttttaaggatcactggtgatatgttaaaattggtattcaggatatgtttaactataacttgctcttcatatgacagtgtgaatgtattgacataagtgctaatttacaggcatacctcattttatcatactttgctttattgtccttcacatatactgtgtcttttacaaattgcaggtttgtggcaaccctgcattgagccactctatcagctgtttttccaacagcgtgcgcttactttgtatctctgtgtcacattttggtaatgcttaaaatgtttcaaagctttttaaattacatttgttatggtggcctgcaattagtaatatttcatgttattattgtaattattttggagcaccatgaactgtgcccatataagatggtgaataattttaaccaaaaagatgtgtgttctgactgctccactgaccgtttcccacctctctccctgtacttaggcctccctattcccacagacacaataatttgaaaatcaagctaattaataatcctgcaatggactttctaagcattcaaatgaaagactcacatgcctctcactttaaatcaaaatctagaaatgattacgcttggtgagaaaggcgtgttgaaaacagagataggctaaaagctgggcctcctgtgacaaacagttaagcaagttgtgaatgcaaaggaagagtttttgaagaaatgtaatactgctactccagggaacacatacatgataagaaagtgaaacaggctttttgctgatatggagaaagtgttcatggtatggatagatcaaaccagccacaacattcccttaagccaaagcctaatccaggggaaggctctcttttcagatctatgaaagctgataaagatgaagaagctgaagaagaaaaggttgaagctagcataagtttgttcatgaggtttaaggagagaagccatctctacaccataaaagtacaacgtgaagcagcaagtgctgatggagaagctacagcaagttatccgaagatctagctaagatcattgataaaggtggctacactaaacaacagatttttagtgtagataaaacagccttatattggaagaagatgccatctgaaactttcataggtagagaggagaagtcaatgtctggcttcaaaacttcaaaggataggctgcctctcttgttgggaccaatgcagctcgtgactaaagtatagccaattctcatttaccattctaaacatcctaggacccttaagaattgtgctaaatctaccctacctgtactctaaatggaatattaaatcctgaggaacatctgtttacagcatggtttactgaatatgttaagtccactattgacacccactgcttcgaaaaaacaattcctttcaaaataatacggctcactaaaaatgtaccaaattatccaagaactctgagggagatgtgcaaggaggctaatgtcttcttgtctgctaacacaatatccattctgcagtccatgaatcaaggagtattttcgactttcaagtcttattatttaagaaatgcactttgtaaggctatagataacatagataaagtgattcctctgatggatcttggcagtcaattaaaaactttctagaaaggattcataattttagatgccattacattatatatgattcatgggaggaggtcaaaatatcaatataaatagggatttggaagaagttgaatcaattctaaaccctcttcggagacttggagaggttcaggacttcagtgaaggaagtaaatgcaaatgccatggaaataacaagaaaactaaaattataactggagccttgaagatgcaactgaattattgcaatctcatgataaaactttggtgagtgaggagtttcttcttatggaggagcaaagaaagtggtttcttcagatggaacctacttcttatgaaaatgctgtgaatattgttgaaatgataacaaaatatttagaatattacattaatttagttgataaacagcagcaggatttgagtgaattgactgcagttcagaaattctgtgggtaaaatgctattcggctatattgcaggctacagaaaaatctttcatgaaacagtcaatcaatgcagcagacttcattgctgtcttattttaagaaattgtcacagccaccccaaccaccagcaatcaccatcctgatgagccagcagctgtcagcatcaaggcagcaccctccaccagcaaaaggactacggctcactgaagacttgaatgacccctggcattttttagtaataaattatattttaattaaggtatatacatttttttaggcttaatgtcattgtacacttaatagactacagtatagaaacaaacatcacttttatatgcattggggaaccaaacaatttctgtgactcacttcattgcaatacttgctgtttcgtggtggtctggaacaaaatccacaaaagccctgaggtatgcctgtatataccccgaggtatgcccgtatatgcttttatctatcacattttattctgaaaaagatgtgagacatatactctgttctttctttactattttatcagcaacaatagcttaaataggactgcactcagaaaatatttgactatatcagctatgttttgttgatctatttagaaaccataagaaatcatttaaaaaatatttgaaacaataatttgttaaaagtattttctatcacatatttaatgagataaaggtatgctaagataaggtaaaacaaactacatggtgtgtgatcatgtttgaacacacatacacaattttcttctttaatgatttatatctttggtgttttactttggacatgcatgtttttagtttcaggacataccaaagagtgaactgctgcacctgctcccaggaaatatgatttatgatacaggatagacaaaaacttgttatagacaattcccacttattgccaatttcaccttttatatctccatttttgttatttggaaaggcaacagatttctgttactttctgcttcagagaattacatttgtagaatatgtttctgaaagaggctctactttccaagatattacagactgatgcagatgatggctctataaaatgcttattctgcatctcatgaaagcaccatgtcagtttttgtcataagggtttattcaagctaatatgtcatcttaataaagcgaaggttattagttgagcttcaagatgaagttccagaatgatcaattcaaaatcactttgtcacttctattgaaaaggactcaatgaaacatacagtgcttattgactgtgcacataagacaagatactaagagcaatttatttttatgcatttttgcaataattatttcatggataaaatatttctgaaaattaaatgataatattgaatcacaaatgttaacatttgataaatatttttaaatttcattttaaaatattgggacatagtactaactttgtatgattaacttttaccatttaaaaaagaactatttcttgatttgaaagcagatattaattccaccgacttacattgttttttttcccccctttaggctgtcctttggaggtataaattctctcagcttaaaggttcttcagatgatggcaagagcaaaatcaaatttttgtttcagaatccagatactaaacagattgaagcaaaggtaaacccaagaaattcatcacataacacctctaactacattaatgccattaaggaacaaagaggggaaactttcggggaatcacaagaccaaaaacacacattctctgctcatcttgaaatatccgtcatggccagaagaataaacttactttaagattttattggcaacttttcacttaaaggcagcacttaaaataaattacacaaaactaattgcatttcttagttttaattccttatgaactgcatttttgtcacactaaaataacatcctgggaactaaagcagtcctttggtagtttcattctaaataataatttaaaatactttgtaaaaatctgactatatttacataaatttatatatttacattttatttacatatattttttcacatattcaaaatctgcattattttcattactataatataaaattgacaataacaatatttgcattagaataaattataaatgcattatcccagtatagagaaaagggtaaataacaaagtgaaaaaattgtatctatggacatgaaagctcaatataatttttcaactatgaattaacattaccatatttctattatacccctttacttattaaattcagggctaagaagccttagcctgacattcagaaccttcccaggaatgtcccttgatgatatttttggcaaagtatcctgtaacactgctctatgtttagattagacactctccttcttttaacaaggtgactccttgtagcctgatgtatcttctgcttttctctcaactgttttccttagctttttgtctgagtatctctcgagatgtcccattcttgtctcttacttgtctttggactcatcttttctgcctcttcctagttcacaggttgtgtaatgtgggaactgtgtcgttcctacagcgggctcctttgccactgcatgtgtttccagggggttgcctcactttgtctcccatcagtttagacaaatgccttgctaacttcttccactccctttattttacatgcctcacaagtttttagcttacatttctaacacagcctcttccctaaatatagacccatctctgcaccggccctttctctacctctcgctactgctcctcttctcccacctcagctaccactgatcaatcatttactttgtgccaaccacttattttgataatatcaaagaatgcattactcttgtcaaattttttttacctttagctcttggtatatttcttaatctttcaaagcacagcacaaattttaatactggtgaaagatgttaatattgtcagttctgtattattctggcatttattctgatggggaacctcaaccaccagttgctgacagcggtacagtattcagttgcttaccccaacactttttaatgagctaacaaaccctttgcaaaggaacaagagtgataaatgcaatctaatggctactaactatggtatttagatattaatttagtgtagcgtgtattatacatgcaattaattatactgacaagtatactagaaattacctgtcagctactaagcattattcattcttgtaatttttgtgtttttaagctttctctcatatgtaattcattaagagatagtgtaagaatagatatttggttgagtgtaattctcgaattgataggaagtaattatggaatagaaaaaaaaagtagtcttaaaaataatgagactgtgacatttggtgagttgttgaaattctttaaagtcagcatctccctttataaaataaaagaaaataatacctccataggtaatactgaaaatacccaataaaatatgatgactatttaaacaacaataatgctagacaatcagaatgttggccagccctacagaattgtttaaccatacttgtgtgtatcacctgaacattacctctgctgacataaaaattgtgtaagaactggaagcaggacatttgctaactattgtataacctctataaccatgacttgtgagcagtaagctaacataccatcacaggagcaaaacaatcgtagtgtagatgttcttgtgtggacataagcttttatttatctgggataaatgcctagaagtgcaaattgcaccatagaatagaaaatgtttgtttagttttaaataaaatgccaaattatattctatagtggctacagaatatagataacattttatatcctaccaataatgtataaaagatccagtttctctacatccctgcaaggtttgggtattgtcacttaaaattttggttctgctcatcatagtcttcatttacatatccctcaagtctgataatgatgaacaacttgttatatgtatgttatatcctctttgttatatgccatgtatgttatatcctctttgttgagaagatttctcttcctgtttcttgcccatgttctgacaatattgttagattataattttttggtgccttgtctctgtttttctgttaattgtgctagaggtttttcaaagaactacattaatttttactgatttttatattgtggtctgtaatccattcaatgaattctgcccttttaatatttgcctattttttagttgctttggcttttattttgctctcatttttaatttttttgagataatattttagatttctgatttgaagtgtcctttctaatataggatttagttctataatttccttgttagcactgcatttgctgcatccccaaaattctgacatcttgtgtttctattttcatcggttcaatatgtttttatttcccttaagtctttctctttgacaaatggatttttttcctttccttttttaaatagactttagtttttcagagcagttttcagttcacagcaaagttgagtgtaaggtacaaaaatttcctgtataccacctgtccctacacaagcacagccccctctgtagtcaacatcccccaccagagggggggatgaagttatagctgatgaacttacagtgacacatcattaccatccagagtccatagttcacattacagttgactcttggtgttgcatatgttatgggttttgatatatatagtggcagttatctgccattatagtatcatagtcgtttcactaccctaaacatcttttgagctcttcctattcacccctatcttccccccaccccaagaaaccactcatttttaaaacttgtctccgtactttttcctttttcaaaatgtcatatagttggatcatacaatagttacccttttcatattggcttattttacttagtggtatgactttaagtttcttccatgtcttttcatgacttaataactcatttctttttagtactgaataatatccaattttctgaatgtacaacagtttatttatccattcacctacagacagacttctttgttacttccatgttttagaaattataaacaaaactgttctaaacatccatattcaggttttgagtggacataagttttcaacttctttgggtaatatcatggagtgtgattgctagatcatatggtaaaacagtgtttagtttttttaaaattgccaaactgtcttccaaagtaattgtagaactttccatctccatcaccaataaatgaaagttgcttttgctccacaatctcaccagtaactgttgttgtccatgttctggatttggaccattctaataggtgtgtagtggtatattattgttgttttaatttgtatttatctgatgatatacaacgtggtgcatattttcatatgctaattttcatctgtatatattctttggtaaggtatctgttaaggtttctggcccatttttaatattttcatacgctaattttcatctgtatatattctttggtaagatatctgttaaggtttctggcccatttttaatattttcatacgctaattttcatctgtatatattctttggtaaggtatctgttaatgtttctggcccattcttaattggaatttttgttttgatatcattgagttttaacagttctttgcatattttccttagcatcttttatctgctatgttgtctgcaaatatttttgtccaatctgcagtgtgtctttttgctctcttgagaatgtctttcatagagcagaaaattttaattttaatgaggtccagtttatcagtcgtttcttttgtgcatcatgcctttggcatagaatctaaaaagtcatcgcaaaagtgaaggtcatctagactttgtactatgttatcttctaggagtttttaaattattgtcttttataattggagctgtgttccatttggaattaatttttgtgaagggtgtaatatttctgtctaagttctttcttttttatttttctgcattgcctgtggatgtccattttttccaggatcatttgttgaacaggctatatttactccattgtatttttttgctccttagtcaaagattagttgactgtatttatgtcggcctatttctaggctttctcttctgttccattgatctatttgtctgtttctttcctaacatcatgctgtcttgatgactgtagctttagagtatgtcttgaagttttatagtgttaatccttcaactttgatcttgtttttcaatagtgtgatggctattctgtgtcttttgcctctctctatatattttagaatcaatttgtcaatatccaaaattacttgctggaattttgattggaattttattaaatctgtagttcaagtttggaagaactgacatccagacaatattgagtctccccgtccatgaatataaaatatattccatttatttagtacttctttgatttatcagagtttgatagttttcctcttatagaatttttatgtatttaattagctttatattaacttacctgacatgtgaccgagaatatctttcccttttttataattttagtagaaaatctttggatttcccaccgttaagtatggtatcagctcttggtttggtaggtaatttttatcaagttgaggatgtcccccatctattcctagtttactgagagtttttatcacgcatgagtgtcggatgagttttctggatctattgatacagacatgtgatttttcttctttagcctgttgatttgatgtaatacattaattgaatttcaaattttgaataagctttgtatatcaactatgatagtggattcttccatttcttcttgaagttctgtcagtttagccttacatatttgtatgctctattatcaggtgtatacatgctaaggattgttacgtcttttttggataatttatttaccgttgcttaatgtccctctttttccctaaacctttccttgttgaagtctgtgccacctggaatcaataaaaactattgctttcttcaggttagtgttagcatggcacatctttctccattcactgacttttaatccatatatgcctttaacattgaaagtggatttcttgcagataacatatcatttggtcttatttcttcatccattttgacaatctttattttttaataagcacatttaagaccactgatgttaaaaataatttttgatacagttggatgaatatccacaatatttcttatccttgtgaatttattgcccttgttctttattcttattttagtcttccatgttttacagcttttgtagttttaacacttaacataattctattctctctccttattagcacaacagttatatattgttttacttttattagtggtagcactaaaccttgtaaaatatgtttacaactaaaccaagtccgccttcaaaacaacactacactgattcacaggtggtgtatcttataataacaaaatcctcctaattcctgcctctccttccttctattattgttgtcactcattttgcttatacacaatcctatacaatctaatacattgttattattttgaataaactgttatatgttagataaataacatttcatttgtttctcttttttagaatttgcattttctgcatacattgcttatttgttcttgcatgtggtctattttatctattaaagcttgtggtatattaatcatagttgtttcaaatgcttgttctaataaatccagtgtccctgccatatctgcacctggtcatgcttgccctatctctgtaaactgtgatgtcttttttccgtgtattatgatttgcaatattttcttttttaattgtttttattataatttaagttcagagataaatgtgcagaatgtgcaggtttgttatataggtatacacgtgccatggtggtttgctgcatccatcaacctgtcatctaagttaggtattcctgctaatgctatcccttccctgccccaccccacctcttgacaagctccagtgtgtgttgtctccttccctgtgtccatgcgttctcattgttcagctcccacttacgagtgagaacatgtggtgtttggttttctgttcttgtgttactttgctgagaatgatggtttccagcttcatccatgtccctgcaaaggacatgaactcatccgtttttatggctgcatagtattccatgatgtatatgtgccacattttctttatccagtctatcattgatgggcatatgggttggttccaagtctttgctattgtgaacagtgcagcaataaacatatgtgggcatgtgtctttatagcagaatggtttataaccctttgggtatatactcaataatgggattgctgggtcaaatgtatttctggttctagagccttgaggaatcgccactctgtcttccaaaatgtttgaactaatttacactcccatcaacattgaaaagcgttctccacattctctccagcatgtgctatttcctgactttaatgatcaccattctaactgacgtgagatggtatctcattgtggttttgatttgcatttctctaatgaccagtgaagatgagcattttttcatgtctgttggctgcataaatgtctttttttgaaaattgtctgttcatatagtttgccaatttttgatggggttgtttgtttttttctcataaatttgtttaagttctttgtagattctggatattagtcccttgtcggatggatagattgcaaaaattttcccccattctgtaggtggcctgttcactctgatgatagtctcttttgctgtgcagaagctctttagtttaacgagatctcgtttgtcaattttggcttttgttgccattgctttttttgtcttagtcatgaagtctttactcctgcctatgtcctgaatggtattgcctaggttttcttctaggggttttatggttttaggtctttgtttaaatctttaatccatcttgagttaatttttgtataaagtgtaaagaaggggtccagtttcagttttctgcatatggctagccagttttcccagcaccatttattaaatagggaatcccttccccattgcttgtttttgtcaggtttgtgaaagatcagatggttgtagatgtgtggtattatttctgaggactcattctgttccattgatatatatatatattggtaccattggtatatatatgtatatatatgtctgttttggtaccagtaccatgctgttttggttactgtagccttgtagtatagtttgaagtaaggtagcatgatgcctccagctttgttctttttgcttaggattgtcctggctatgtgggctcttttttggttccttatgaagtttaaagtagttttttccaattctgtgaagaaagtcagtggtagctggacagggatagcatggaatctataaattactttgggcatgtggccattttcatgatattgattttttctatccatgagcatggaatgttttcccatttgtttgtgtcctctcttattccctcgagcagtggtttgtagttctccttgaagaggtccttcatatcccttgtaagttgtatgcctagttgttttattttctttgtagcaattatgaatgggagttcactcatgatttggctctccatttgtctgtcattgcttataggaatgcttgtaatattttcacatttattttgtatcctgagactttgctgaagttgcttctcagcttaaggagattttgggctgagacaatggggttttctaaatatacaatcatgtcatctgcaaacagaaatattttgacttattctattcctatttgaataccctttatttcttttgactgattgcctggtcagaacttccaatactgtgttgaataagagtggtgagagagggcatccttgtcttgtgccaggttttaaaggaaatgcttctaggtttttgcccatttagtatgatattggttgtgggtttgtcataaatagctcttattattttgagatatgttccatcaataactagtttattgagagcttttagcatgaagggtgttgaattttgttcaaaggccttttctgcatttattgagataatcatgatcaacaaaatggatagacctctagtcagactaataaagaagtaaagagagaagaatcaaatagacacaaaaaaaatgataaaaagaatatcaccactgatcacacagaaatacaagctaccctcagagaatactataaacacctctatgcaaataaaatagaaaatcgagaagagatggatgaattcctggacacgtacaccttcccaagtctaaacgaggaagaagtcaaatccttgaatagaccaataacaagttctgaaattgaggcagcaattaatagcctaccaaccaaaaaaagtccaggaccagacggattcacagccgaatgctaccagaggtacaaagaagagctggtaccatgccttctgaaactattccaaacaatagaaaaagagggaatcctccctaactcattttatgaggccagcatcatcctgataccaaaacctggcagaaacacaacaaaaaagaaaatttcaggccaatatccctcatgaacattgatgcgaaaatcctcagtaagataccggcaaaccgaatccagcagcccatcaaaaagcttatccaccacgatcaagttggctttatccctgggatcaaggctgtttcaacatacacaaatcaataaacgttaattcttcacataaacagaaccaatgcaacgttttcctgattcagtcaggcatgacgtactgaataaaaggtgctgttacaaacttgccttcagtaatgttgtgttaaggtgggggaggggagtgttctacagcttgtgagtaggactcagtcttttagctggcctgtgcctctgaactgtggcttcacatatgctgctcagtcacccccgcttaggttggacaggatggctggaaggggttggagtagggtatttcccttctccaaggtgagttaggctctgataaaacaccagcaagttaggctcaggttacctagtttctcttgagggcaggccttgctaagaagaacatagtgcctgagctatttttttttttcatgatctgtggttttctttttaattatcttgtcttatgatcacacataattttaaaacttgtgtatatctcctctactttaatccttttaagttggcaaaagcaccattccaatcacaaatacacagcagttctacagttttatgtttctgaatggctgtttaaagacaatcctaaattataacttagtttgacttagattgtgaagaattcaagaatgaagtttaacttactactattttaaaagcatgtgaccttacagatcaataaaatgtaagaagtgttaaataatctttgatattacacataaatcacactaaaatgcctttcaataagtaaaaggaaccattttaaatatagggaattctaattacactggcatagttaaggccaaaaatataaagtagacattgctaccttatttatcttcaacccttgcctttaagaggcaaattaacacaaaacacaagtgaatcttgcttggttctgagacagtgaagaaatttcccccgtatttaaatatactcacataaccagttatataaatctaaatataaaaccaatctccagtaagttttaagatggtactcagcgtctttgtgaaaagttgaacattactaatgaagtctaacatatctttagaaggggtgaatagcgatagcatttactgaattggaattactattaaaattcaaaaactgaacatattcatttaaccacaagccagtctttgttttaaatcaggactgcccaacaaaatattctgtcagtcattcatgatctgaattctggtgtatgagatctcttaaagtatggtggacataaaaaactcacgggacattctgttttgtaataaataaggcagtggccaactcattagtagcttttttgagataagctatcaagtctgccctttctaccttcttaatgcaggcaaagatcatttttgttccaaggatgtgcttcttgggagtctccaaatacaccatcagtgtatcctctccccaggtgatgcctttgttcttattagcatctgtgtaagagaatccaacagcctgacctgtcttctacccgaagagaccatggagattaggcccagtcttgtgcttgcctcccttttccatgatgtggcactggacacacttctgaacaaagatcttcttgcctttctcaacatcacccatatttaattctcttttaagtctcttgagcaatgaaggttcctgctccgaagccagacgtcacactctattgccttagctatttttaaatgttttcccctcctaccagcagcattggggatttttctccaaaatccactatgagaatctggtcaagatcctggaagtaaaaattacagaagtgtggagacactgataactatgctcccctagagttcttatctctcagacttgtccacactgagcctccagcaagtcatcaatgatacttcaggcttccccacctcagcaccggtttctgcagaggtttttactcagtgatttctgttccaacaatccgtgattcttggaatatgactgtctgtccttccaattttggggacagtggttttccccaatggagataaggagagttgtcgatttttcagttcgtttggctttttccttgttgccaggatggggtagaaacttctaggttcttacacattgaactggaaacctgaagcccctgatactcagaattttagaaagggggtgtttagtttctaagtatttggggatttatctttctagagttgatttttagtctgattccagagaacatactctatatgatttcatttttttcatcctctgcatcatatatcatataattttgattgaggaagacacaaatatatggaaagaactcagaatggcatagattctcttctggcctctcttttattttattggttgatgtgtctgtttttattagtattatactgttttaattcctagctttgaaatacagtttgaagccaggtagtgtggtgtctccagctacactcttttggctcaagattgcctttattgtgtgtgtgtgtgtgtgtgtgtgtgtgtgtgtgtgtgtgtgtggttttaagagaaaagcatgaaagataattctgtgttcagggattggaaaaattaatgttgttaaaacgtctatattacccccaaaagattaatagattcattaaattttttaccaaaatttcaattttacttttttagagataagctctaaaattaatacagaaacacacacacacacacacacacacacacacacacacacacacacacacacaaaaataaccaaggcaattcctatacataggtataggaattaaaacagcagaatactgataaaaaaaaatagacacactgaccaatgaaacaaaatagagaggccagaaaagaacctgtgtgattatgatcaattgatttttacaatggccccaataatacaaaatgggaaaagaacagtctccaataacagggtgacaagaaaatggaattttcatgttcaggagaatgaaattgggttcttatctaacaccatatataaaaacaactctaaacattatatgactttggtctgggcaatgactttttggatttgcctccataagctcaggcaacaatagcaacaacaacaaaaaataaacaaacaggattatatcaaactctaaagcttcctcacagcaaagaaaatgaacagagtgatgaggcgacctatatcatgggagaaatatttataagctgtacatgtgataaggtgttagtaatcaaaatatataaggaactaaaacaacttcaaagtacaaaacaaataacccattaaaattgggcaaaggactcattttgagacatttctcaaaagaagacataataatggccaacatttatgtacatgtgaacctatgaagcaatgcttaacatcactaatcattaggaaaattagaaactcaatgggctatcacctcatatctatcaaatggctattatcaaaaaggtgaaagataagtgttggcaaaaatgtagaaaaaagggaacccctgtatgctgttggtggcaatgtaaatttatacaagccacgttgtaaactgtgaagagctttctctaaaaactgaaatagaaccaccactctgtgtagagccagcaatcccatttctgagtatatatgcaaatgatttgaaataagtatattgaagagacatctgcaatttcatgttaattgctactccactcacaatagccaacacacagaatcaacctaaatgtccatcaactgataaatggataaataaaatatggtatatgtatacataatggaatagtattcaaccttaaaaaagaaggacattatatcatagaagaatctgggggacattatgctaagtaaagtcagccagacacagaaagacaaatgttcccacttatatgtagaatcaaaaccatggaactctcagaagagaagtagtatttacagagactggagaatagggggaatggagagattttggtcaaaaggtacaatgttttgttagactagagtaagagatgataagtatctgaggggaaaaatgcccaagcttattactgggcctttgcaggcatgagtgggtatggggccatggcttttctgtagcatttggctaaagaatatcaattattgtataacagtttctgtcttgctagactgcccctctcaggtcacgtggctagaaggagtaggcttctcttaggtttactggtctgcatccattggtatttctgggctgccagcctctccactatcttgtttgggggatatgacacagagaggcaaacccagagaacttgtcacgtgttgtgagggtcctggggtctctgggttcttagtctgcctgcctcttctctctctttcagggtgtccttacattcattttatgtatgttgtccagggtttgtgatgatacttaggaagaggaataaggaaaagtacatctattctatctccaacatagtactatgtttatttttaaactgttaatgccattttttaaaagaaaaattatttgacttattttgattactctgattgttagtttctcactcttgataaccccaatgaatagtgacaaaaaatatttttaaagttgacagtggaagtaaaattatcatgtggctcttgttgtaactgctgagtagtctggagagagaacttttaacatgtagagacattgttatgtaggcttattttgtaaaataatgttttctataatgcaatgcctagatttcaccttatttttacacatatatgactcaaataagagtagattttatatgagtaaacaatactgaggaatttacgtggcttaagataatttaacccaatttaatttttacacagttattttaaacctcaaatgttaaatataaaatacctgtaaactgctgctaaattatgagttgcagtggattctattgaaggagagactggaaacccaggacagtttgttctggtggaggccactgtctgcataacaagaagctggttgtctccatacctcccttaccccattagttaccattcaatagaacatttttcatcccgaaaatattgaacaacattcattcatcaaagtcaaattttctatttcttgctctgatctctctttaccagactttagataggtaagctaataggtaactgtgagtgatgtctaaaagtactgttactaagatggtttcttacagtatttcaaaattgtatgtggcttgtgatgcaaattattttttgccttgcttactgctgatttgggaataataattgaaggctatcattttcacttaattttatatagcttaatagctatttgcgtgtaaagctttcatcagaacgtattataaatgaaatgtttgagtatttaagatttcattatgagaccaggcttgttttagagggatttaagattatactttacacatatttctacagaaaacaaaacattattttgggggtagaagcaaataatatttaccactttgttctcctgtgtccccatctcaaatatattgaaggcaagagaatatacctatttattaacaattaatgccaaaaattgttgaacttgtttacagaaacttattggaagattttacttatctgctgcccatatgtcctcccatgcatccaagaattccaacagtatgataagtaatttgcaaatctttgaaaaattctaagatataatatatttaataaagtgctacattttaaaatcaccatcttgatatgatatatttttgaagttatgattgtcaataaaagatcatcacccaaaagaaataaattattaataagtgaagagattttatttcatcaaagttaaaaagaaaaggtgagccagggtgtgaaatatgggtctgaaaatgtggttaaatgtggaggctgttacaacgtttctttccttttctaaggaaaataatctaagcagtggtgaaaatggttcagaatagacttagaacttaccatatgtgataatagggaaatactttcaacaaaacatgcattagtttaacaattcatatacatattcccagggcaaatacatcataaccagagcttatttaacaagaaatatggtttctttggggaatattattgcatgagccaccatatgtattacaacattaaacattccaaatagtgcttaattcattggttgtgagaaagcgtcagaaatactgaagaaaatcgtgtgggtttacataggaattgggagaactttgttttatctttttgctgttgttgttgttgatctatataagactaatgtcataatacaaaaaaccttttatactttcttcctctgatagcaaaaattcataaattcttacttcattactcagaaagcttaataaatttcccatctgttttccaaagcctaattaaacttctcagaacttccctagtggaacaggggagtggttcccaattgaagccttgagcggtattatagttttttttgacaagttacaaaagcttattttattgccactgataacttaaaagttgtttctatatataatattcatttagacactaatacagctaggcttactgatatattctcatagtcatttataactaaacattctgagtcacaatacttttctttactgcctctaatattatatgtttatgtatatgtattttttcttaaattataattggacttaacatggagagaaaatcccctgatttcaaaacgtgctgtattctacacacattggtgtagctttattcattgaatttcatgataattccccttatggaaataatgttaaaatatttcctaaactagtgtacacagcatattcgtctaaactactgagtttgagatctgaaagtcatgctagtgcattttgtacagtacataagagaagggaaagaaatttgcttctctatttagtggaacagtgcagaacttgggaagatttttaaatggagctgatcatcggaggctccttttccccaaacatctccttgccccaagtccccaccatctcaggtactacagcatcataagagaaattttcaaatatattaagtattagtgaaattcaagtcagaaattgaggattgactcccattaatactactttctggctagtctctataaatcttcattttctcattgtaaattgtgccttaaagcacctaccttaaagggtcgctctagagaaaaaaaaatgtttctgatttgaacataaggattgaatacataacaaaattaatggaacactttggatgctcagtttttcaaagctcctgactgaagaattcatgatgtgttgatgtttggatttcagaagaagatggctggtaatctaaatgaatccctgtttggcacttgagtcttataaataaggtcttttaatattcacaaggctgggtaggtatttgggatcaaggctctctttctgtcttgtaaataaaggatcagctttcagtctatctggcttttcacaatttgtgactctatctggtatctgaaaccaaaggttttctaaaattccaagatccctttccctctcatttccagctgtacaaagcactggctgtttagactacagagaagacaaaatgaggatgaggcagagcatctgcttaatagcacaggtcctgcataaattcatgtttggagtgcttcgttctgtaaaatagacttaagtagatagaaataagttaggacaaaaattgaactcacatttgtgcaggtgtgtgtttgtgtataacttccataatagcttattttatgtgaaattttatttcaaactaatgattgaattgagaacaggaatgtgtggtgaagaagatatctggacaagatagtgcctctctctcccttagaagagattttaaactcctgggaatcactgaggattctgaattatttttatttttcattgatatattttttctccttgcatataatttattttcaaatctcctattctccatcagaatagtgaatttctctacccgtttgtgttaagagtactctgtactcttaacactctgtacattttctctctcggtagactataaaatttgcattaacatcttatagataaaacaaatatattaactgcctccaaaatagtagctgtcaaagggaacatgcctatagtatgcagcattttgttttatcctttttgacaaaagtaatcatctacgaagagaagaattgtaaataaatttttagtaagtgacccaagtaagaacattttgaaaatcagaattttaaagttgaagaccttctggaagcaatttcccaggaagtaaagtaacaaaacacagagtgtagtaaccaagtactgtattatgttctcatagtaaggtaattgtaacaaaaaaacaccatcatcatcaaagcatttaagggtagaaataataaactgcatttcaactggaaaaacagaattatcctgaagctatacatatgtctatttataattatttgcacaataaagtaagactaactgtataaatttaggtctcctcatgccccaagtaagtttcttaactgcattcatcatgccaccttaacatttatggccataggtatcaagatattggctgacatattaatattcaccaaataatttaatatgagaagaacagtgtaaacctgatattgagatacaaatctcttattttatttacattaatttaaaagagataaagcaaaattttattaaacattgttctattacatcaaaatcctaaaagaacctaaaagattttgaagcaagcagtttagcagagataggcaatgtaataagtttctatttttatttgccaaactcagtaatgaggatcaggagattaagatacataataaaccaataatccaaatcacaaagagtacaggttatagtccttagaaacccataaaatagatgaagagagtaaaggatcaaaacaataggttggattctgatctatgcctataaacgctggaatgcaaattaattgatacttatggaccataaacattttgcaaattactgtgccttaggcattttaagaaatcaaaagtgaatgtgggctggattttcagaatggcatagtaatgacttttgaaattccactcttctggaaaggcaatgagaaaatattcataattatcagaatcaatgttattcagaattgtggaaataaattaaatgtttggaataaccatacagcatttattaaaaacaaaacaagcttcaagttttggtaagaatggagagctttgcaacattgtagcttattatattcctactaccctgtccagaccaccactgtgacctcgaaaatatgcatcctagaaaacatggtagctagctataagacccagcacctcagaacccactgaagggtgtgggctgggcttgcagattctaaaaaagcataatctcaagaagatcataatcatctgacctatctggaagcttcctagagaagtcaatttgcaggctgctatggttttaatatggcttctcccctctgaaactcatgttaaaatttgattctcaatgtgacagtgtgatgaggtggggcctattgggaggtgtctgggtcatagtggtgaataatgccctcttgtgggagtgggtgagttctcattctaggaggaaaaaatggattaatttccatgagaattggttgttaaaacaagtctggcttcacaggtttgtctctcttacttcctctctcaccatgtggtctctttgcatattcccacttcacttccactttctgccatgaggtcaagcaacctaaggcagtcaccagatgtggctgcccaaccttgaactttccagccaccataatcagagccaaataaactgcttttttaaaagataaattatccagtctcaagtatgctgttatagcaacacaaatggactaagaaaattggcatgcagagtggggtgttgctctacagatatctgaaaatggggaagtggcactggaagtgggtaatgactggtggctggaaaaatttggaggagactagaaaaagcctgtattgctatgaatgggatccttagggtgattctggtgaggactcagaagaagacaaaaagatgagggaaagtttggaacttcttagagattcattatgtggtcaggaccaaaatgccattagaaataaaaacagtggaagatatgcctattacacccttgcaaagaacctgactgcattatgtcgatgccctagtattttgtggaaggtcaaacttaagagtgattaatatttgacagaagaaaacttcaggtagtaaagcattcaggcaactgcatggttgcatttaactgcatgcagtaagatttaagagcaaagacatgacctaaaagcacaatttataattaagaggaaagcagaacgtaaagattttaaaaatttgcagaccaattatataaaaagaaaaggcatgtttggaaagggtgctgagggttgggtccagtgagtagttgctaaagagattagcatggctgaaaggaaacccagtgctaataatcaaaataatggggaaaatccctaaaggcatttcaaagatctttgaggccagtctcatcacaggctgagaggcctaggagtacagaatggttttgggggacaggcctaggctgttgaagtcctgtgctgcctcaggatgctgctctccacatcaagagcagccatggctcaagtggccccaagtaaggctcaagactctgctttgaaaggcacaagcagtaagccttggcatccacatggtgttgattctgcaggcctgcaaaatgtgagagctatggaaacaagcctttattgactgagatttcaaagggtatatagaaaaacctgcaggcccaggcagagacttgtcacaggacaaagccaccacagagaacctctcatagggcaatgctgagtggaaatgtggagttagagctctaccaagtcctcaccagcacaatgcctaggtgagctactggggccaccattgagacctctgaattatagagccaccaacaccatgtaatgcccacctaggaaaactacaggaaccaaacttcaatctatgagggcagacacatgtgtgacactcaacaaagccacgggagttgaactgcccaagaccttagaacacacccttcacaacaatgtacacagggtgtgagatatgaagtaaaataaaattatcctggagccttaagatttactgtctgccctgctgtgttttggacttatgtagggcctgtcatttatttctttttgtctagttttcccttttagaataggaacattgaataaatgtctgttatactattttatcttggaaataaataacttgctcttgatttcacagattcataactacaaggaacttgccctgagtctcaaaagagaatttggactttgggctttcaaggtgatgctggaaaagttaagacctttgggaccaaatggagggaatgattgtatttagcattgtaagaagaacatgagttttatgggggcagaggtgaaatgcttcactttgaatatggtttgttcctctgaaactcatgtcaaaatttgattcccaatatggcagtgttggaatgtgaggcctagagggaactgttcaggtcatgggggtagattcccccataaataaattaattccctgctgcaaaggtgggtgagatcttactcttgtggaaatgcattatttcccacaggagtggtttgttaaaaagagtctggcttcctcagtttctctgtcttgcttcctttctcaccatgtgatctctttggacatgcccactccactttccctttctgccatgaggtgaaacagcctgaaaccttcaccagatgcagctttcccaccttggacctttcagtcaccagagtaatgaaccaaataaacctcttttttctgtaagttacccagcctcagatattctattatagcaacacaaacggactaagacacaggccttgtcattacttgacctcactcagacctttctcattggaaaaattgctaacctaagtatttaacaatcaacagtttaagatcacacctacttgaattggcaataccagttgtggcaagaaagatgctggtgaaaaacttaagatctgaggaatgaggttccaatgagggtcttttagaagctccaatacattcctgagaacctagaagggcacatgaatgtgccgagctatgcacatgatgagaaaagatgccctaaactctcagttctggctagccttaaagatctgtgcaagaagaaagtaaagacttagaaagagttgtaaatttccagaggattaaagaagtgccacaaaacacacacagagccccatggaaaagttgtaagactttgcttctagtaatttacagaaatattggtcaaaacaatagatgaccaagaagctaaatagacagaaatagtctgtttcctatcagtgaaacagataggaaaacatcaacaacaaactgcaacagcatcagactcttgggaagaatgagaatctgatgtccaagaatattctttgaaatgccagttttaaacaaaaattatgggacattgaaaacattctcaaaattgtggcctttctgtaagaaaatagactcaatagaagctttctttgaggaaaaccagctggtgcacttactagtaaaataatttcaattgtgtattacaaatatattaactggtctaaatgaagctatgcccaaagaattaacctgtttgaccaaatagagaatgttaatgaaaggatagaagtaatgaaaagaatcaaataaaattttcagttgaaaagtacaattactgaaattttaaaaattctgagatgaactgaacaaaacatttgagtttatgaagaaagattaagagaatatgaagagttcacaatatctcaatgtcaatagggcaactgagattatccagtctaaggaataacaaaaatataaatgaagaaaaatagcagagtctcagaagtctctataacagcataagttatactgtcatatatataaagggaataccaagaaaacaagaagggacatggatagaaacaatattttaagaaataacagctgaaaacttctcaaatttaatattaatatacatatttgaagagctcagtgaactccatgtagaataaaaacaaaagacataaaattatcatgattcaccagcaaaaggccagagaatcttgaaaacagcaaaataaaaatgactcacaacatgcaaagagtcgttaataagaataacagctcattttttatagtaaactgtggaagttagaaggtaatagaacggcacatttaagtgatgaaacaaaaaggctgtcatataagaggttcttatttagtgaaactctccttccaaagtggaggagaattaagtcattattacatataaaaaaaagaacatttgccactagtaaatatacactacagaaaataatttttagataataacttgaatacacacttagaaataataaaaacaccattaaaggtaaatacataattcaatataagtgacagtataaatgcatttttattggtgttttacttctaattgatttaaaagaaaaattgataaaatgataattatatcactgtgtctttgggcttgtaatatataaagatgtaaagtgtatgacaataataacccaaagaagtggggggaacagagttatatagaaacaaatttttgagcactattgacgttgtcattgttctgaactagaatgttttaaaatattattatatccctccaaataactaataaaataactaatgataaaaatgggagaattaaaattatatgaatgtagtatatacttatatataatttatataaaagtgtatacatatatatacatgtacatatatagtgttataacccccaaaataaaaacagtaatggaaaaataaaggaacaaagataaaaacttatgatataaagtgaacataaattttaccttatgtataattgcattaaaagcaaatatattaaatatttcgaccaaaggcagagattaacataatgcatttccttaaatgatttagctatatgatgttctcatgagaacttgtttaaatttttaaattgaaaggtactctagtgtatatatgactacaatcaagagattgacagtgaaacagtcaaagcagaacacctgcatcctgatcctgttctatttttattgttattcagttcaatgtatttttttatttcttttgagactctcttgtatataaaggattatttataattctgtgccttcattttcaagtgtcagaaattatttttgttttctttctgtttctttcttctctggtcagaaaacacaccttctatgactttaattattttaaatttattgagatttgttttatgcccccagtatggtcaagtttctacagaaacttgcaaataatgtatattctatttgtattgtccaaaagttctaaaaatgttagtttgatcttgtcagttgatggtgttttctaattcttctacattcctgttgatgttctgtttaactcttttaccaattgttaagagagatgttgaagtcttcaatgtaattgtgtatttatccatttcacctttcaattctatcagtttctgcattacatactttgcatctaagttatttgatgcatacatatttagagttgatatgtttttcttgtagatttatgcttgtattattaattaatctgtctcatttcatccaataattttctttactttgaagtttagctcatctaatgctaatatagccactagtcacttttcttcatccaaaaaaatcattcttttactttaaatataactatatcattatatttaaagtgagcttgtagatagcatatatttgggtcatgttttttaatctattctgccaatctctgtgtattgattggtgtatttagacaacttacttttattttaattattgatgtgttgacatatttataattatatatttgaattttgttctctctcttttccatttttctgttttaatttttctgccttcttgtaacttttttgaatatatgcttttagaaatcaattttatccatagcatttttgagcatacttcaacatatactgttcttagtgtctactctcagcattaaattttgtatatatcttcacattctagtgaaatcaacatcttatcagttaggtgtagaaaccttaacatattttaagtctctttacctattttattatattttacattttataatatataatatattatagcttataatatttatatgttatatttaagcatatattaacatatacttatgtactataaatattgtttatatttataatatatagatatattatgtcttatatttcatattttatactattctttatataatattttaaaatatttcatttacatatagtaagaaccaaaccagacaatattacaatttttgtttcaatacccaagtataagttagaaaactcaaaagcagaaataaaatatttaaggatcacttttcttaccatattctttctttcttcctaagttccaagatagcttctataattattttctctttttgtcctttttaagccatgcttttaggataggtcttcttattataactttactttgtttttctttagctgagaatgtcttgattttcccttaatttctgaagcactattttgctggatataggattcaggattgacagttcttttctttcagcagttgaaaaatcttgtgccacttccttctggctgtatgatttctgatgagaaattctctgtcatttgacttgtgttctcctataggtaaggttttatttctctcttgctgctctcaagactttttgctgtcaagttttcagaagctgactatgatgtgtcttggcaaggatttctttgagtttatcctctttgtatttcacttagtctcttaaatctataggatgtattctttcaccaatttcaatgaattttcgctattacgtctttcaatatttttcagttccctaatttttgtcctcattttttggactctgaagacatgaatagcatatatatatatatataataatataatatatataatatatatatttgttttagtctcacagttcactgaatagtctttccttttttcaatctttcttacaacttttattctaactggttaattctcacaattcttttatccagttcactgactcttctgttctcttctttctgctgttgagccatctattcagttttttatttctgttattatatttatcagttctaaaattattattgtattcttttttatgtcttttatttcttcctagggtttctgtttcttttctgagactttctacactttcatttgttctaagcatggtgataattgcttattggaacaattttgttgtgactactttaaaatatttgtcaactgattctaaaatctatgtcatctcactgttggcatcttttgaattttttttccattcagtgtgagttttctttttttctctctctctcttttttttaattttttaaattttattattattatactttaagttgtagggtacatgtgcacaatgtgcaggttagttacatatgtatacatgtgccatgctgctgtgctgcacccattaactcatcatttagcattaggtatatctcctaaagctatccctcccctgtccccccacccgacaacagtccccagagtgtgatgttccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggccgcatagtattccatggtgtatatgtgccacattttcttaatcgagtctatcattgatggacatttgggttgcttccaagtgtttgctattgtgaatagtgccgcaataaacatacgtgtgcatgtatttttatagcagcatgatttatagtcctttgggtatatacccagtaacaggatggctgggtcaaatggtatttccagttctagatccctgaggaatcgccacactgacttccacaatggttgaactagtttacagtcccactgacagtgtaaaagtgttcctattcctccacatcctctccaggacctgttgtttcctgactttttaatgattgccattctaactggtgtgagatggtatctcattgtggttttgatttgcatttctctgatggccagtgatggtgagcattttttcatgtgttttttggctgcataaatgtcttcttttgagaagtgtctgttcatgtccttcacccactttttgatggggttgtttgtttctttcttgtaaatttgtttgagttcatagtagattctggatattagccctctgtcagatgagtaggttgcgaaaattttctcccattttgtaggttgcctgttcactctgatggtagtttcttttgctgtgcagaagctctttagtttaattagatcccatttgtcaattttggcttttgttgccattgcttttggtgttttagacatgaagtccttgcccatgcctatgtcctgaatggtaatgcctaggttttcttctagggtttttatggtttcaggtctaacatttaagtctttaatccatcttgaattaatttttgtataaggtgtaaggaagggatccagtttcagctttccacatatcgctagccagttttcccagtaccatttattaaatggggaatctttccccattgcctgtttttctcaggtttgtcaaagatcagatagttgtagatatgcggcgttatttctgagggctctgttgtgttccattgatctgtatctctgttttggtaccagtaccatgctgttttggttactgtagccttgtagtatagtttgaagtcaggtagtgtgatgcctccagctctgttcttttggcttaggatggacttcgcaatgcgagctcttttttggttccatatgaactttaaagtagttttttccaattctgtgaagaaagtcattggtagcttgatggggatggcattgaatctataaattattttgggcagtatggtcattttcacgatattgattcttcctacccatgagggtggaatgttcttccatttctttgtatcctcttttatttcatcgagcagtggtttgtagttctccttgaagaggtccttcaagtcccttataaggtggattcctaggtattttattctctttgaagcaattgtgaatgggagttcactcattatttggctctctgtttgtcttttattggtgtataagaatgcttgtgatttttgtacattgattttgtatcctgagactttgccgaagttgcttatcagcttaaggagattttgggctgagacaatggggttttctagatatacaatcatgtcatctgcaaacaggggcaatttgacttcctcttttcctaatcgaataccctttatttccttctcctgcctaattgccctggccagaacttccaacactatgttgaataggagtggtgagagagggcatcctgtcttgtgccagttttcaaagggaatgcttccagtttttgccaattcagtataatattggctgtgggtttgtcacagatagctcttattattttgagatatgtcccatcaatacctaatttattgagagtttttagcatgaagggttgttgaattttgtcaaaggccttttctgcatctattgagataatcatgtggtttttgtctttggttctgtttatatgctggattacatttattgatttgtgtatactgaagcagccttgcatcctagggatgaagcccacttgatcatggtggataagctttttgatgtgctgctggatttggtttgccagtattttattgaggatttttgcatcaatgttcatcaaggatattggtctaaaattctcttttttggttatgtctctgcctggctttggtatcaggatgatgctggcctcttaaaatgagttagggaggattccctctttttctattggttggaatagtttcagaaggaatggtaccagttcctccttgtacctcttgtagaattcggctgtgaatccctctggtcctggactctttttggttggtaagctattgattattgccacaatttcagagcctattactggtctattcagagagtcaacttcttcctggtttagtcttggtagcgtgtatgtgtcaaggaatttatccatttcttctagattttctagtttatttgcatagaggtgtttgtagtattctctgatggtagtttgtatttctgtgggattggtggtgatatcccctttatcattttttattgcatctatttgattcttctctcttttcttctttattagccttgctagtggtctatcaactttgttgatcttttcaaaaaaccagctcctggattctttaattttttgaaggcttttttgtgtctctatttccttcagttctgctctgattttagttatttcttgccttctgctatcttttgaatgtgtttgctcttgtttttctagttcttttaattgtgatgttagggtgtcaattttggatctttcctgctttctcttgtgggcatttaatgctataaatttccctctacacactgctttgaatgtggcccagagattctggtatattgtgtctttgttctcgttgctttcaaagaacatctttatttctgcctttatttcattacgtaccgagtagtcattcaggagcaggttgttcagtctccatgtagttgagcggttttgagtgagtttcttaatcctgagttctagtttgattgcactgtggtctgagagacagtttgttatcatttctgatcttttacatttgctgaggagagctttacttccaactatgtggtcaatttaggaataggtgttgtatgttgctgaaaaaaatgtatattctgttgatttggggtggagagttctgtagatgtctattaagtccacttggtgcagagctgagttcaattcctgggtatccttgttaactttctgtctcattgatctgtctaatgttgacagtggggtgttaaagtctcccattattattgtgtgggagtctaagtctctttgtaggtcactcaggacttgctttatgaatctgggtgctcctgtattgggtgcatatatatttaggagagttagctcttcttgttgaattgatccgtttaccattatgtaatggccttctttgtctcttttgatctttgttggtttaaagtctgtttcatcagagactaggattgcaactgctgcctttttttgttttccattttcttggtaggtcttcctccatccttttattttgaatctatgtgtgtctctgcatgtgagatgggtttcctgaatacagcacattggtgggtcttgactgtttatccaatttgccagtctgtgtcttttaattggagcatttagcccatttacatctaaagttaatattgttctgtgtgaatttgatcctgtcattatgatgttagctggttattgtgcgcgttcgttgatgcagtttcttcctagccttgatggtctttacaatttggcatgattttgcagtggctggtaccgttttttcctttccatgtttagtgcttccttcaggaactcttttagggtaggcctggtggtgacaaaatctctcagcatttgcttgtctgtaaaggattttatttcactttcacttatgaagcttagtttggctggatatgaaattctgggttgaacattcttttctttaagaatgttgaatattggcccccactgtcttctggcttttacagtttctgccgagatatccactgttagtcggatgggcttccctttgtggctaacccgacctttctctctggctgcccataacattttttccttcatttcaactttggtgaatctgacaattatgtgtcttggagttgctcttctcgagaagtatctttgtggtgttctctgtatttcctgaatctcaatgttggcctgccttgctagattggggaagttctcctggataatatcctgcagagtgttttccaacttggttccattctccccgtcactttcaggtacaccagtcagacatagatttggtcttttcacatagtcccacacttcttggaagctttgttagtttctttttattcttttttctctaaactttccttctcacttcatttcattcatttcatcttccatcactgatactctttcttccagttgatcgcattggctcctgaggcttctgcattcttcacatagttcttgagccttggctttcagctccatcatctcctttaagcacttctctgtattggttattctagttatacattcgtctaaatttttttcaaaggtttcaacttctttgcctttggtttgaatttcctcctttagctcagagtagtttgatcatctgaagccttcttctctcaacttgtcaaagtcattctccatccagctttgttccgttgctggtgaggagctgcgttcctttggaggaagagaggtgctccggtttttagagtttctagtttttctcctctgtttttccccatctttgtggttttgtctacttttggtctttgatgatggtgatgtaagatgggtttttggggtggatgtcctttctgtttgttagttttccttctaacagacaggatcctctgctgcatgtctgttggagtttgccagaggtccaccccagaccctgtttgcctgggtaccagcagcggtggctgcagaagagccgattttcatgaaccgcaaatgctgctgtctgatcgttcctctgatagttttgtctcagaggagtacccggccgtgtgaggtgtcagtctggggggtgcctcccagttaggctgctcgggggtcaggggtcagggacccacttgaggaggcagtctgcccattctcagatctccagctgcctgcttggagaaccactgctctcttcaaagctgtcagacagggacatttaagactgcagaggttactgctgtctttttgtttgtctgtgccctgcccccagaggtggagcctatagaggcaggcaggcctccttgagctattgtgggctccacccagtttgagcttcctggctgctttgtttacctaagaaagcctgggcaatggcaggcgcccctcccccagcctcactgctgccttgcagtttgatctcagactgctgtgctagcaatcagggagactccatgggcatgggaccctccgagccatgtgcaggatataatctcctggtgtgccattttttaagcccgtgggaaaagcacagtattcgggtgggagtgacccgattttccaggtgccatctgtcacccctttctttgactaggaaagggaactccctgaccccttgcacttcccgagtgaggcaatgccttgccctgcttcggcttgtgcacggtgcgctgcacccagtgtcctgcgcccactgtctggcactccctagtgagatgaacctggtacctcacatggaaatgcagaaatcactggtcttctgcgtcgctcacgctgggagctgtagactggagctgttcctatttggccatcttggctccagaacttcagtttgagttttcactggttcttggtatgatgagtgatcttctattggaattacacatttttgttatttagttatgatattccaaatcttacataaacattatgttttatctaattgccattgatatagctttatcaaagtaagggagaatgccatgttgttcttgccagataggggtagaatttcaggtttactactttacctccactggaagttaaacagtgggctcttcataactactgtaaaagagtaggagatccagttcgccagtaggctttcactgatcccgccctgagtagggtgggtggagttatctcattaacatttacctttaaaatttccttacgtttgttttacatataatatgcaaataattcagtcctacttagtgggagtaaaagggacagatatgtctactccatcttcctagagaagtagaattatccaagctttatagctaaacacacatgtaggttgcaaataaaaggatacaaatatatatatcttgtatataataatgaaaaaagaacccgaataactatagtaattttacaaaaaaggctttaagtcaaaaattgtttcaagatactaaaaagggcattttataatgaaaaatgaatcaatttttcaaggagatataacaattataagcatatttgatgataacagagctccaaaaggtatggaacaaatgaggcgaaatcgaagagaaaatggaaggtaccaccaattagttgtagacatcagtaccccactgtaactaatgggtagagcaattaagcagaagagtaacaatgatattgacttggtcagcatgataggcaaccagacatgttgacctgtttagactctccacccaattacagaagaacatacatttttaactaaaatatgctaatatctaagatctaactacaatacactaatatctaagatcacttgtatgtcaggttataaatcaagcctcactacatttaaaatagttaaaataatacaaattatgttctatgaacacaatggaataaaattagaaatgaataacaaaagaacaattgaaacatatgcaaatatgaggatattaaaagcaaattactaaataaccaatgggtcaaaaaaaatcacggtgaaattataaattattgggagataaataacaatgaaatctcatcatgctaaaacatatgctacgcagctatagtttgtttagagaaaaattttaacttcaaatactatattaagtaataaaaaaatcttaaatacctaatctttctcaataagaaattagagaaagagcaaaataaacacaaagtaagcaggaacaaggacaattataaatttagaccagaaatatataaaaaaagaatacataaacaattgagaaaattagaaaatctcaaatttagttttttaaaaaggttaacaagagtgacaaaactttaactagataaccaaacagcgagagagagaatattcaaattttttaaaatcagaaataaaagaaggtatattttagagattaaaaagaaaaacgtaactataaataattgctaaacatttacataatttaatgaagtgtgtaaactctgagaacaacaccaactaatgaaactgactcaaagataaatcaataattggaatatacctaaaagaaggaaagatattgaaatggtatttttaaaacacttcccacaagaaaaagccccaaatcaagaggtttgtctgatgaactccattaaacaatgaaaaaacaattattaccaatctttcacaatcttttcaaaatatagaaaaaggggaaacactcctctacttatttgagattcgaattagcttcatagcaaaaccaaaaccatcagatgaaaagaaagccatagaccagtatccctaatgggggtagatgaaacaatctttaacagaaagcttgcaaaccaaatccagcaacatgcaaaaattgttatacaccattatcacttggtatatatccctggaatgtatggtagatatatatcttaaaatcaatcagagcaatacaccgtattaattgaataaggacaaaaatacataatcattgtcatagattcaaaaataagaaaaaaataaataccatttcataataagtatactgaagaaaactaagtattgaaggaatgtatgtgttccccctacaattaagaataagaaaaggatgtatgccctccccactttcatcaaccttgtgttggaatttctagccaaggatagatgatacaaacttaaatatagaaaatgttcatgaattcactaagaaaactattggtactaactagtaaatgacttctgcaaggttgcagcatacaatcccaatgcacaaaaatcagctgtatttttatatgttagcaatggattagagtaggtaaaattaagaaaaaatttcatttataacagtatcaaaaaattctaaggaatacatttaacaaaagaagtgcaaatattgtgtactgaaaactacaaaacatggaaagaaattcaagaagatttaaataaggggagctacatcccatgtgcataaattagaaaacttaatacttttaatatgacaatactccaaaattaatatgcagatttaagaaatctccatcaaaatgccaactgcctttttttcagaaatggacaagttgatcctgaatgtatatgaaatccagtatagccaaaataatcttggcaaataagttggagagaacccccagttccatatttcaaaacactacaaagctatggtcaccatggctttgtggtattgtcataagaatggacatatagaacactggaatacaattgagagtctagaaatgaaccttatttattgttaactgtcttttaccgtgcttttcaacacagcagaatgtggaaaggaacaggtttttcaacaaatagtgctgggaaaaccggttattgaatccaaaaaattaagttgagtcctttcctcataccataaaaaattacttaaaaatgaatcatcaaatatatctaagagctaaaactgtaaacctatttgaagaaaacatgggattaaatttttgtaaccttgggtttgacaattgtgcttagactccacaccaaaagcacaagaatcaaaggggaaaaaaatagacaaattggactttttcaaaatttaaagcacttgtgctgagtaatactataaaaaaggtgaaatacaacttgcagattggcagaaacattttcaaatcatttatctgttaaggagactgtatgcaaatatataaagggttttcagagaaaaaaaaagaaaagaaacataaataccccaaataaaaattgacaaaggattcaaattgacatttctccagagaagatattcaaattgtcaataagcacaagaaatgatgctcaaatcattagtcatcaaaatgcaaatcaaaaccacagtaaaatacagcttcccactctataggatggttataatatttttttaaaaaaagaaactagacaataataatgattagtgaggatgtagagaaattggagcactcagattttgctagtgagaatgtaaaatgtggtaactcatttaaacaaaagttcaacattttctgaaaaagtgcaagctgaagttgtcatatgacccagcaattccacttctagatatattcaagagcaattagaagatattcccaaacacacaaaaaagaaactctacacagatgttcactgcagcattattcacaaaaaatcaaaagtaggaacaacccaaatgttcaacaggtgatgaatggggaggaagagatatgtccatatcaggaaatattcatcaataaagagaaaagaagtactatctatgccacaacataggtgcaccttgaaaatagtgtattaagtgaacgtagataatcacaaaatatcttatgtgtatgatactatttatatgaaatgtccacaaaaagcaaacccatagaaagacaaaaaaataatgcttatcaggctctgaagagagaggaaatgaggagtgacttgtactgggtataggatatatttttggagtgataaaaatgttctaaaatttgatgatgatagttgtacatctgtgaatattctaaaatccgtttacttgcatgctttaaacaggtgagtattatagtatgtgaactatatctccctaaggctgctgcagaaaaaaggtgaatgacacataaaggggatgtcaagccagggaacatattcatttacacaataatgacataagtaaatctgaccataatggcattaacaagaaataaacctatgaataatgatggagctatttgtttttctctaatgactgcaaggccattaagaatattagagttaaatctggcctggaagaagagatgacaatcacagtagaaatgaaagagaagcctatcttgaaatcaagagccataatggaaacataataatgctattaagcaagtgatttacagaatgtaattttctccagcagtttcaatatttttttgtcctcacattctaagagactcacttgagttatggtttaatgatctattgaatgttgcatggccatgttactgtgggaaacaggtatgcaaatgtagatgatgacttagttggctctcaattttgttcagaggactcaagagttattgacccacttatgccattattggaacgctaagcgtgtgggagttgtttatattctacttctcaaggtcatcagcaaggtctgattgcaaaaattcaaaaaattgcggtctcaggcataaatgggttgaaagcttttaaggagcaagcagaatgaggaagataaattccagattttatgcctaaaatgatatctataagttagtagtttgtccaaattctcaacacttcctgctttatcctatcaggctatgactttgctttgtatcccacttaaaacacagaatgaagcaaagctacacactaccaaatctacccaccttccttgagttgtacccatatactgtgcctcatctcctgcggcctcagatcaattgtccaggtttccatccatgtccagcctctccatttttgcaccagatctcaccctgctcaagaatacagtttctacaattgtcctcagatttgatatctcaaccatttcatgccagcaattctacaaatatatactaatttcataaaccttggaaaaacattcttgatttcctattgatatattcctatgccccctttaaaaaggaaaagaaggatttcttttccaaagagaagctgcttgtagtagacttgcctgtagtaactctaataccttcacatgcaggctctcatgaagccattcttatgaagtttttgtttccacttctccataaaacgactcttgtaaaggattaaaatggcctctgtgttgctaaattcaatggtcaatttccagctgtcattttacaagactcccgggttttgcactcactttcttggcaactacagctatttcttctttgctggttctaccccatctttcttacatttttatactgtggagtctcagggatgagtgcccagtcattttctctacctatcctgcacaccttgatcttctcatccagaccacagtgctttacctaccatctatgtgctgacagaagctgaacttctattctgaactctaatttttcccttaaatccacactaatatatgcagttctccacttatcacctatatgtctaatatgcgttcagatgtaacatgcccaaaaccaaaatcttgatctttacttccaaacctgcttttcccataatttctccatttgcagagcaacacgttttttccagttattgaaatctactttcaaattcaacccctttccatatagaaaactttgtaacttctccttctttcaatccaattctcataaagctcattctcaatagtctaaccagaatcatcattttctgacttttgtcaatgcctgtcactcctctgctcaaaaatttcccatggtttcccatgtcgctcatagtaaaactcataaaggctcatgcagcatgcaaagtgttttctttgatctcattgtctgccaagtacttcttaattcattccattccacacaaaataacccttgcttttcttctgactctcctggaatgtccctatctctgggcctttaaaattataattcttgtgtctggaatatttccccacaaacatggaaatggctcactccatcttccctttcaagttccatatacaaggcaacatgaattttccttcccacggccctttgagtagtctttgctgtctcctccgctttatttcttgatggtaactgtcatattctgacatattgtccttaatttatttctgcccttagtcacattttgcctcctgtcactggaaagtaactcccatcaggactgttttgttcctttgtttgtttttgtctgttttattcactgctatcttttaacaacaacaaaaaagagtagatgcataggaagcatttggtattttattgaatggctgactctttacatttttgaagatagcttatatttagtgatatctgagggatcatgatgatcataagactttttttacaagggaaacttgtaagtctgtgacttggtggaagctgtcggtggatggatagatagatgttcatcatcagtggatgtttgataggtggtaagaatgcaggtctagtactcacataagaaattagtaaatgagcagtgtgagtttacataaaaggaatcgttgacaccctaggagtggaaatggttgccaaggctgatcactgaggcagaggaaagatgtgtgggcattgtaatgaagagtcaaacttggatccatcttggtctcctgctttctcttctaatcacctgctattatttcccgtctaccattacttcaaaatgggtataaaaagtttaaagtgtcaatctatatcaaattattgataaataattgacaaggtgggagtaattgaaaatttttatttttctaaagatgcctggatacttagatatttaagggttgtttatttttggtaaccaaaatataacctctattttaataaagagatggcagaattacctttgagaaaaagttatttgccatactattttcacccaattgtaacactcaactatattctcctccttaccaagaatgaattgcttatttttgttgttgttgttttattttttaataacatgcaagaacattttacattttcccaaaatttccaaacctttcacattaggtggatttaatttgggaagatagagaaagtatttaaaatgtgtttgggaaataaactggctacaccaagcattatggggtgaatggaggatttccagggtgagttaaggcaaagagaaacttgcttatttacaaataacatgactagtgccactgaagcagattattataaataaagcttctaagatcattatgatggagttactaaaaacttttttggtggaaatatctaagggaattagaatagttaaatgaataacctcttctattctctaggacaagttgctatttcacaaaggaaactatcaaatattgaaggtttcaagggagctactgagaaagcatagctatgtcttctatattatagggacacctgaatatatattatggggtatcgtactcctgttgcatgacctgagaaaatactcctcggatgaattattttatttaaatagctgtctggtacacgacagatattacaatgtgtcataaagtattgaatattttgtaatattttccactgccacatgtaagttgtaaacacagtcatgtacatatcaattataattctaaattctttattacatatatgtagtgaaatatataataaaatagcaatgagtttgtcagaaatttcatatgctttattaccctctagttaccctccttgtgataagttcatcgtattgatttcattaagcacacaaatgtattagtctttcaatcatcttgaaattaagacatgtttatgtgattattgatggtctttaataataatactagcaacatcatctttctaaatgtattctgagcatagctttaagattttatagttattttgacaaaattatggtttgaaataactttttctgttttcactgcaatatatatagtttggttgccactggtaataaatgggttacaaatttcctttggtatttaaatgagaaacctatttctaaaaatccaaaatgaattagtgagctctagtttattttttttttttttagtaaatatgccacataaaccattaaacagccagccacaattaaaattaatgcaggaattattttttgaaagtgaaccatttggctcctctggttataagagttcatatccccttacttctagcatttcttattcagtttcttatggcaaatattaactcattctagagaatactcaagaatagttttaaattgccctaatccatatttatcatctgatgtgtgcacaaagagataaaaatacttttaaaagtacttccaagtttatctttaattgtacattatcaagagtaaaattttggcaaaatatatttatcaatcagtgctaaaagaacattcatagatggtaagagtgattagtcctcctacctcttatccaccatgtattgaaataaattttcactacttacgatgtttacacgttgaccaaaaatgtctacatttgaaattagtttccacatgttacatatcatagattctagataagtgtattgaaattgaaaaaaaatctagctattataaatttttaaagacattaatttttatgttatctgacctgtttctctttccctttcaggagttggaattttctaatttatttgctgttcttcactgcattcattccttctttgctgccaaggtagcttgtttggaccctctatttttaggcaatcaagctactgcttctactgctgccagctctgctaccacgagcaaagcaaagtatacaacttgacatactgaactcttcattgacacaccccatgactgtat

SEQ ID NO: 1254 - DNA, 876 bp, Homo sapiens
ccatagtaaaaatttaatgaaaaaagcaaagtaatatattgactaaatataaagaacatgtattgttatattaaccacaaagtaaaaatacatgatacatgaaaagaagattttaaatagtataaatagttaaataattatttagacaaatagataaacagatccatcagcatgatcatccgtaaggaactagtgcctgtacagctgaacatgatgctgcttaacattcctgaaaacattttaaaattttgattcaactcatgtcatggatatagcaaaaatgagaaatggcagaattcatgaacgtgtgagatgatgtattaatcatggaaatgtttctcatttccatgttgaaccagttttcattccttcctccttaatctttcctgcaagttcgttcataaagagaaggatctcatgatttctgctctgacagcctcccaggaacaagggctatacttcttctttgtcagataaagagtgattctttgaaagtattttctcacagccaggatggagtccacattcctcaggggagtctcttccactccaaccttctacatcacacaggcttccaggtcattcagctgctggtaaagttcagtgtagaatttgtctaaaagggtcgcatcccaagtatcagatgagtcctttgtgctgaagaggttgaaggtctgctgcatcatctcatggaaaaggaagatagcttgaaccttctggaagtggttgccatgaaacacctgatgatggaaaatcaaagtcatgtctgtccttcaagtaagaaaaaggagagattctcctcatttgtgtcaggagtatgaaggccctcctgttacccacgctgtgggcctgaggcagatcacagcccagaggcag

SEQ ID NO: 1255 - DNA, 770776 bp, Homo sapiens
gttttttgcagtggtagaaaatgctgaataattgtccgtgagtgtgagccaaatattcaggttcattactgagatccccagaacgccaatatttgcaacgcaaacacttagtatcccactgtgtgaagggctctgacacatgcctgcctgcctgcctttcgatggagagtctccattggaagtcctcctgcttccatagaccctgcttttgatacaggggcagctgcacatggctgcctcttaatctagtaatttactgtgccatactgtcttactgattacccacattgacaaagagacagtaatgtgaggggtgggccttcaaatcattttcatgttgaacctcctgggtccagctacctccccttccacaacagcaccattgttttttctgggcacatactcaaggtcaatgctgtttttgtgcttgcctttccctcggctccacacaaaaaggagaagaaaacaaaataaaaccactcccaggaatgtgaagcagcccatagctgtagacaccagtattgttttaaggtccagggaaaaagtattggcattggtgccattggaaatggtgtcattggagtcggtcatgtacataggggtcctgttcgcataaagaaaacgatctgaagcgaatcctttcacagttaaggaggctgtgaaggtatcattcccagcagcattgctagcgatgcaaacatacatcccgctgtcttgatcctgggcaaagcggatttccaaggtgccatcacccaacacggtggctcttccattggacttggtggtgatgaaacgccttcggggtgtcacccaggaaatcacaggctgcgggtctccatctgcactgcattctagctggactgtctgcccttcatctactagcagatgctgcaacttcttttcacggattttgggttttttgcaggtaaagtaaaaagaaagggcagtgctatggaaatccttgaaagacctctcacggatggtgtctgggccagcacacataggttgctggccaccaaactgcagggtgggctgtcgctgcaagatccagagaaggcggcagtcacaggccagagggttgttgttaatgctcaagacctccagagccctaggggaggagaagacattctcttccaaagtttccagcaggttctgagacacattgagcacgcgtaggaagcggagcccttggaaggagtgaggctcaatggtgcgaagctgggcccccactatatgaagctcctgaaggcggatcaggtcagagaacatgcctgcttcaatagtgctgatgggattgtaggagaggttaaggtgagtcaggtataccaggtgtttaaaggcaaggaagggtacagtagacagattggtgttggtgactgaaagggatgtgaggttgagaccgtagaggctattggcaggcatcatatccagtaaaggccaatagtcaatctctaggtgtttcaggtggaacaatcttttaaaggcatacacaggcatattgttgatattgagatgcttcagatgcaggctgatgaggctgcggaggtgggagagggcttctgttggtactgctgttaagttgcatttctccagggtgagctgctccaagctaagaagcccactgaatgccctgtgtgatatataaaccaaatcattgtcccccacttctagagacttcaggttatgtagatcttggaacatgtagtctagtaaaatgacaatcttattctcactaatgtcaagcttagtgagattggacagccccgtgaatactcccaaagggaccagctttagacgattgccttttaggcggagggaacgcaggttaaagagattgttgaatgctcctggttccacattggcaatgatgttgtcactcaagtctatctcttccagcagaggatatgatatgaattcttcagggttgacgctttttagcctgtttttactgaggtccaagattttggtttcgatgggaatgccctctgggatggcgatcaatcgccttctgtgacagctaacagatttgttctgggcagagcactcacagcgagcggggcagccaatggtggatcccatgaagattaacaccacagccagacccaggaatggctgccagcatgatatggccgtgtgaagcatgactccacttcttagtctacaccttggtcacgggtctgcatggaagggacacaagaagggaggaagagaaggtgagttaggatataaataggtgaaggggcataaatagggcagcaagtgtaatggaaaggatactggatttggaatcaatcagatttgggcataaacctgatggacgaccctcttagtaacaggttcttggtcaagttatttaatctctctgcattttagttttcctggctgtgaaatggggataatagtgataatagtaatagcttcccagagttgtcatgacaatttcaatgtttgacaagtataaagataatgtgtgacacagactgtgagacaacacagtataaatttcacactcaaaggctcagttttaatttaaatgaaagaaacaggtcaacagctaagaagaaagcagttgagtttgaatcagtgtcggcatcactaatgtttaggatatcatcctctattcaaaacaaagctaacagaagtttcattctatatcaggcctttaggtgcaacatacaaaacaaacttatattcagtgcaaggtgttggaatgtttttcttcatgtatacattttctacttttaacctttgaattttaatgtacgcatctttcatcacttagcaaactttaatttatgaagggattttcttatttgaggcagacaaaagatcctcaaagtatccctgtattgtttttgtttctcataggaatgaggcagaatcaaggtacaagatggctataataaaaatgctcttttaaatgattttgagataaatattgaggaatgggaagataaataattttcagaaaaagtatcatttaatgataaatgaactatccctctttcacattcagacaaactcagtggacccgttaaagtgaaattaaataggtagcaaatgagaagggaaatgagtatgttttaaatgtggatagtttagcagatactgaatccaactgaataaataaaaggtgtattactgagctctgcttttcaacttggggttctcaggggtacactttatccacgaacaccatattttaattaaggttcagtagtttgaaacaatacttttagataaagaagtatttcataaacttcaacattcattcctgagctgcaaaggaaaaattagtaaaaaaataattatccgattacagtatttacatatatatctatgtctacaaccacagtatgtctatatgtaaacaaatttatgaataaaaaataacaagtaggatcaaacttaatggtgaatcactaaatcactagaaaattttcctccaaatgtagaaactaggcaaaaacccagaaagtgctagcaaatcaattagataggaagaggtataatttttggaaaatatgtggcaaaactatcattattcacagatcaaattaatgtctatcatggaaaccaatggaaatcaactaaaatgattagaacagtagaataagtgacttagaatactacaaaataaatgtaatttaaaaaaaattttcttgtctacacaaaccatttagaaaatactattgtaaaaattatctcagtcatggcatctcaaaaacatcaaatccttagtataaacttaacaagaaatacatagaactaatatgacaactattaaaccctatcaagaatcaaaataactaaaagagagatgtactatgtagagagattaaatattataaaaatattgatttctttttccatagaacacacattacaaagaataatgttttaagcttgaaaaattaattctaaagttcatttggaagaaaacatatatgaaaataatcagaaacagtaaaaaaattatgaaaacacctgccatacaatgcattcacacataagatacaaaactataataataaatcagcatgctatttacacaaaaataaagtcaagaaaacagaaagtaaggaattatatctaaatatatttgaaaagccagtttatgttaaaggcggcattttaaatcagtgagaaaaatacaaatgattggcttgatattttgtgggaaaatttgcatactaactttacttcttccaataaattccagatgaattaaggattcaaatgtaagaagaaaacatgtactagaagaaaattcaataattttataatattagagttaagtagcattttctgtgaataaagttagaaacccaggaaggaagagaatgattgactctgttgtacacattttaaaaacttggtataacaaacaaataacacacacatgtgattgctaaactggagaatatatttaaaacatatgtaatagatgaaaaggtgaatgccaatagaaaattaggaaatgagtataataaaattaaaaatagccaataagtatatgaaagggtgattagctattagtaagcaaaagaaatgcaaatttaaaaatagggggtatgtagtttttgcctgtcatattgataaagtttgataatcatttttagccagaattaacaagggtagaagaaaatgaacatccacatactgataaggaataaaaactggacattaattgatatagtagatttaaatatatctaagttcaatatgttaattcttttgactttttttcctatttctagaaatgtatcattagaaaataagcgaactactatacatgtttgttacagatttgtctataatagagcaaaatggaaatatgtaacagtaggaatttagttatataagttataaagcagccatacagtaaaataccatctagccaatacactgtaacccttgacggctaatatggtttggctgtgtccccacccaaatctcatctggaattataattcccataatccccacatgttgtgggaggtaactgaatagtgggggtggttatccccatgctgctgttcttgtgataatgagagttctcacaagatctggtggttttataaggggcttttccctctttgttcattcttttccttcctgctgccatatgaggaaggatgtgtttgcttcccccttcagtcataagtttcctgaggcctccccagccatgctgatgtgtgagtcaattaaacctcttttctttataaatcacccagtcttgggtatttcttcacagcagcatgagaacaaactaatacaactgtagcttaacatggaaaatgaaatgatatatgctgtactcacatttgtatgaacatattttataaatatgaatatacatacatgtatgaaaggagaaaactggaaggatataataaagatgttgacaatactaactttttgaggtggtgggattaatggtgattttcactttctttttataacattatgaattctgaattttttcaaaaacatacctgtattacttttataattagaaaaataatttctgaaatatttttcattgatacataatatttgtacgtatttatgtaacaatgtgatattttgttacatgcatagaatgtaatgatcaagttagagtatatagagtatccatcaccttgagtatatatcacttctatgtgttgggaacatttcaagtcttccagccgttttgaaatacacaatatattattaactacagtcactctactgtggaacattagaactgattccttctgtctaactgtacgttggtatccattaacaaacctctcttcatctcctcccttgatcttggccacagttcccagtgtctggtatctatcattctactttcaacctccatgctctcaatgtttttagctcctacatttgagtgagaacatgtgatactgtctttctgtgctcggcttaattcacttactataatggccttcagttctatccatgttgctgcaaacaacactttatactttctttttggtagaatagtatttcattgtatacatgtaccacattttctttatccattcatttgttgatggacacttagattgattctgtatctttgctactgtgaatagtgctgcaataaacatgggcatacagatatacctttgatatactgtgtattactccattttcatgctgatgataaagacatacccaagactgggaagaaaaagaggtttaatggacttacagtcccagcagtgggattgctggatcatacgagagttctatttttagtttttctgagaaattttcatactgtttaccatagtggctgtagtagttcacatttacaccaacaatgtttaagagttcctttttctgcacatccttaccagcataaattattttttgtcattttaataatagccattctaactggggtaagatgatctctcaatgtggttttgatttgcatttccctgatgattactgacgttgagcatgcattttgttttcatattcctgttgactacttgtatgtcttttgagaaatgtctactgatgtccttgacattattttgacattcaaaaagtcatggatatgttttataatgaaagatagaattgcatggcttttaaaaaaaggctcaactaagtcatttatttagatgtctaatgcacagaataattcatagaaaattataatttatttagttaccttgacattattcctccctcatcaatttctccacctcatagaaggtggacttttaggtagtaaagattgtgatcattatttgccacctaaattaagaagaaaacttaaaacgtgtcaatcgtttgattttaagcatacagctcaatgaatttagaaagatgtttacacctttgtaagcaccatcacaatctgatacagaacattaccatcatcctctttacctcttttccgtctatcccaacctctgttaccggcttaaagtaagcactgatctgcattgtcactatagattagtattcattttatataattttatatcaatgaaatcatataatatatactcttatgtccagcatctttcactcagcatgtttttgagattcatgttgttgcatgtaacagtagtttgttctttttttatgtctggtagtattgttttgtcacaacttgctattcaactatttttggaagcttgggctgtgtccaagagctgctatgaatattaatataaacatctttgtgcatacttatgttttttcttaaatatatacctagaaatatatacctatatatagggtaggaatatgtatagtatttataagaaacaggcacatcatttcccaaagagattatgccattcagcatttccactagcaatgcaagggagtttcatgtgttccatatccccttcgacatggatactgactttttttttttttttttttttgagacggagtttcgctcttgttgcccaggctggagtgcaatggcatgatcttggctcactgcaacctccgcctcctgcgttcaagcgattctcctgcctcagcctcctgagtagctgggatcacaaggcgtgcgccaccatgcctggctaattttgtatttttagcagagacggggttttctccgtgttggtcaggctggtctcgaactccggagacctcaggtgatctgcccgcctcggctcccaaaatgttgggattacaggcgtgagtcactgcgcctggccgactgtcttttatatgttatccattcttgtgggactatattatctctttgcattttcctcataactagtgatgctgagcatctgtttgtctgcttattgcccatttaggtagattctttggtatattttatgttcaacatttttctcacttttaattgcatttttaaattattgagatataaatgttatgtatatattctaaatacaagttctttattagatatatgtattgtgaatattttatgctcatctatggtttacctttttgttttcttcatatttcttaaagagcagaagttttaaaatttaaatccattttaacatttttttaatgatttgtccttttggtttctatttaagagcccctagagcctatatgccaatgtcttgaagattttctcctatgtattcttctggaaatttttatagttttattatttacattcaagtccgtgacccattttgaattgatttttgtgtgtggtatgaagtagggaagatgatttattttcctcctacagctatctagtttttttgtagtgttatttcttaaaaagactttcctttctggccagatatggtggctcacacgtgtaatcccagcatttttgaaggttgaggtgggaggattgcttgaagccatgagtttgagatcagcctgggcaacagagcaagatctcatatctacaaaaataaaaaataaaatagccaggcatggtggcatgcatctgtattcctagctactcaggaagctgaggtgggagaattgcttgagctgaggagttcgaagctgcagtaagctgtgattgacactgcactccagtctgggtgacagtgagaccctgtctctacaaaaatataaataagtaaacaaaaataaaaataaatactttcttttccctataacattacctggggacctttatcaaaaatcagttgaccgtatatgcacatctccatttctcttttctattctgctccaccagaatagatacagtatgtacagctgtactatattataccagtacggctgtcttggttactgtagcttttattttttgtttgtttgttgggacagagtcttgctttgtcgcccggctggagtgaggtggcgcaatcttggctcactgcaacctccgactccctggttcaagagattctcctgcctcagcctcccgagtagctgggattacaggcatgtgtcaccaggcccagctattttttgtacttttagtagagacagggtttcaacatgttggccaggatgatctcgatctcctgaccttgtgatctgcccaccttggcctccccaaagtgctgggattacaggcgtgagccaccgcacccggccactgtagctttttatcatcagtttaattcttgaaatcagatggtgttgttcatccaatttttgtcttcttttccaaaaatcctttgggcttttctagatcatttgaatttccatataaattttagcatcaacttgatgatttctaaagaaattttctgtgatattgacaaaaaatgtgttgattaaattaataaatctatggagaatcgatattataacagtattgaacaactttccaattcacgaatgttgtacgagcttcttatctttaggtattctttaatttccttcaacaaatattttgtcatctagaaataaagacagtttcattctttcctttctgatttgtataccttcattttttgtctttcgcatttgttagtacctcttgtacaatgtcaaatagaagtgctgagagctatcttccttcctttcctaatcttagaggacaattatttggtttttcaccattaagtttgatgttagctgtgggtttttcatagatgaccttcattaagattgggaagtgttttttcttagttaactaagattttttaaaattacaagtgagtacggaatgaaaaaatgcttttctgtatctatggagatgatcttattgtttttctccattattcttttaatatgacaagtaatactgattaatttttgaagattaaaccaacctcacacttctgggataaaccttactttgtcatttattgaatattgtgtttgtaatattttttggaattgttctgttaatatttggtcagtagtttttctacttcgtgagaatttttgtctaatttttagtttctttgtgatgtatctatatacttttagtatcagagtacagtagcccctccgtattcatgattttgctttctgtggtttattactaatggtcaactgtggtccaaaatcaggtgagtacaatagttattttaagggagagtgagagagagagactacattcatataacttttattatagtatatttttataattgtcctattttattagcaatttttaaaatcttgtattgtggataatttacaaattaaactttatcataggtgtgtatacatagggaaaaacatagtatttgtagggtttggtagtatctgcagtttcaggcatccaccagggaacttggaacgtataccctgtggttaaggggggactactgcaatacagttctcacaaagccagttagaaagtgttccttgatttttgttctctttttcctaagaagtttgtatagaatttttattatttattttaaaaatatttggcagaacttacctgcgaatccaaacagaccctagaatttctgtgtttgaatgctgtaaaatacaaattgatttctttggcagatattggaatatttacatgtcctatttccttgtgtgtcaattttggtaatttgtttcaagaaattttgttatttcatctaagctatcaaatttattgcctgaagttgtcataaacttcccttattattcttctaatgtctgaaaatctagaggttatctgttttattcctgatatcagtgagttgtgcctttcttttctcttgagaaatctagaattttttcagttttattaaaattttcaaaggaccaacttttgcttgtattgattttctctattgtgtctttttatttcattaatttctgttcttatccttattatttgactatttattttgtcttcagtccagtcttttaattcattttcgcttcctaagattagatcattaattttggacctttcttcttcactgacttaaggtataaaaactataaatatccctttctacatgctttagctacatatcacaaattgattttttataaagtatcattcggtcaaaaacgttttctaatttactttgtgcttccttctttgtcccatctaaatcatcttctaaatccccaacaaaattcccttctttaggatttagttggtttattcttaaatgtttaggtcttcttctaaatatatcatttctaatttaattctgtgaggtcagagaatacactatgaaaaatttccatcttttgaaacctactatgattgttttattggaccagcgtatgatcaatcttgctgccaggccatgtgcacttgaaatggatgtgaatttgtactttttgggtgaagcagtctttaaaagtcattaaggctaatgtggttgaatgtgttgttcagctcttctaaatccttatgaattttttctaagttatgttatcaattcctgagaaatgggtattaaaatctctaactatgaatgtgaacttgtctgcatattcctaagttctataggtttgggtttcatgtatgttaaagctctgatattaagcacatgctcgatttctgatgtataaatcatttatcattaggaagaatccatatttgtatctagtaatgttccttgtttttaagtcatctttgttggggtaatatattgggggttatttcattttggttcattccttaattttcagaaaataagatattcaaatatatgaatacaaggagaatattcaagagaacgacaggaacaaccagcttccttccattttgaaattaagatttttaaaaaaacaagctgttaaaatctggttgttctgctagtctaaattgttgagaaatagagtcctggttaatcaatctagagctgaaactattttcaaataattatgcttcagtattcacagtccactggaaacacacttgaagccaaatatttcctggcaacagaggtgaactgatagcattcgataaaacatgacctgagaagcatctaaacagacaatatttgctttgccattgaggattccctatcttgcagctataatttccccacagcaagtaccctttgcctggttcacagtatagctttctgctgttttccttaagctgtgattcagccatctgtaacacacaaaatgtggcgtgacattttaaatgattaaaacagccactctagctttcttaaagtttttgtggtatatcttttttttttttttttttttacttgtacatacatgtggttttgcatttagaaagcttctctttttgacagcatgtagttatttcttgcttttgaatctagtctcataatctctgccttttgttatactgcttagtccatttaaatttaatatagttattgatatggttgcatttagggatgtcattttgctatttgctgtctatttgtcccttgcattttttgttcctgtctttttcatttcttgccttattctgatttttgttttgtatttcaattcctcctgtgacttttaaactatgttttattacttatttttatttattcctctagggattaaagtatatagatggtctccaatttataatggtcgatttataatttttcaactttacaatggtgtgaaagcaatatgcattcagcagaaactgtattctgagtgcccatacaaccattctgttttcccatttcagtacagtattcaataagttacatgagatattcaatactttattacaaaataggctttctgttagatgatattgtccacctttagggtaatgtaagtgttgtgagcacatataagttaggctagactaagctatggtgtattttcaatgtaatgatatcttcaacttgtaataggttcattgggatgtgaccccatcataagtcatggagtgtctgtatatcttcatcgcagtcaactttaatatcgaattgcttcaagtaaaatataggagctctgcaacagcatatttccatttatactcctcccctcatccttggtggagagaggtacagacatagcgaatagtgtttgcaaaggcatggagacagtaagaaacactctgcaattggggacacagtagttcagaatggttggaacaaaaactgaggagagaaaagagactgaagaggtaattagaggaatgatttacaaggggcttatacactgtgataagctgtttacacgttatccggagagcaatggcaagccattaaagtgttttatgcaaaagagtgatatgatcagatttacattttggaaaaattaatctgattccaacacgaaaaatagacttgcagaagagaaagacttgaagctgatcactcaggaggctgttaattcaagtcagaaaaaaatagtggttactctcagggtcatgggtgtaggcttgggtaaatgggcaaattcaagaggtattctgaggcacaacagaaatgcttcacagccaatcggctgtggagggtgtatgagaggagaagccaagattatttacactcttttgacaactgggtgagacctggtgtccttcactgagatggagaatttaaagcagcatgaggaattcctggtttcctcaaatgtgtctatcactagaccaaaatgtgtggggtgcctgggcagattaatgacttttccactccttaaaaagaatattattttgtaatagcttttagaatttctttggtagggcagggaaatagattttcaattataatcagatgactatgtccaacataaaagttttatgatgtacttcatactttccagttcgtttttgaattgacggtaaagtgcgagtcgttttttatagattccactggagagtactgtcttatttggcagaatttgcccaatctgcctatcaccaattaaatatagaagtaattggcatcttatttctgatttatttcaatagtggttaagagaaagttcatttattgtttagattccttaatttggctgtaagtatgtctgccacggaagacagtatctaactaaatcatggccaaaactgaactagaaaggagctcaactaaggtggatcaatttcagctccaaagtgaaggactgccaaaaagaagggtggataagcaccccggcaagcctgctgtaggcaaggtccctttacatctggaactgctcccccccttctacgactgtccttcagctaggcaaaagtggataatttggggtcatatctcatcaactttttgagtagcttagaaactgtggaggaatgttgtgctttgttattctcctcacaaatatttctcagttttagcccagaaggcaaactgctggctccacttagctttcactgtcagcagaagtcttacaatccaaagcttgctcataatgtccgactgtgaccaaggtttgacaagatgaattttgtttcattaggaataaagcaggaagctaaaatctatagggagttgactagggcctttccattaattctgatcaaagggattctcaagcacaatgattagtacgtaccttttaaaacctagcatgtaaagttggatatttttatacttacatttttcgtatgctgggtatttattccccacttattctattcatgtaaggaacacaaatcaaaatatcaggaaatagacttaaagaagcaacatgaaagactaaaaatagcataaatgtgtgctcacttatacctggcccaaattctgattttgacatttgttagctgtgggactttttcatctatgtctatgattctcactatttcctctgttaatttttgataacacagaataactgagcattaaaggtggtatacatggtgcctagcacataaataatagctgtcattgtgattattttttataggataatggtttcgtttgttgaatcagtatttgtcaggacagaaagcaaaccaaataaaggcatatatttcctctgcaataggactacacttcagaaagatgtcctcaaacagatacagtgataaggagagtgaagagattggtaaaatggagaaagagaaatgaattttaagcaaccattatttttaaaaaacacaagtaagaaaggaaagagatcatggttgttgtatgttgtttaaaaagaaagtttaggaggaaacagctgctttgatggataaggtaatgataaattgcttagcctggaaattctatgattaatttagttctctgactggcaaatgaacaagggcacaaaacaataaatggatagcacagaaatctctgtaaaccttctgacaatctataagacttttttgtttttttgaagtcagtaaagctatttctcaaatggagaagaatgggtgaagagtgggttgaggtaagggtaaaaaaaaaaaaaaagcaagcaaaggttttaatgaataatggtgtccaaaatacatctgaggctataatttccagatatctaaaaactgtaacttcagaaatcctggactccatgaaatcagatactgaagagttgtgaaagttgtataaaacattttaaaactaaaagaaatcaattttagtatgagcaagtctggaaaatcaccagggttacctaagttctttgaaggaccccaagccaacttgagatgaagcccaaagtcccagacctggcaggaaacattggatttcaactctctttttacagaaataaaatatatctttatacatgatttctaattatcctccaaaccattgcatttttacctatttctctctacttatttatggtaaggaaggaatggaaactttcaatattgaggttcaacttggagaacattcaaggggaaatggaaacagccaaaatgaaagccagacttggagagcatcaaatgtgttatatattataacatatttttttctaaaagtttacaggtgtaatgctaaaattattcagtggctcacgcaagtaggtagacagttactcactattgtaaatacctttcaattagctatatgctgattaccaattctgggggtaactgaagatagtattttggtctataattacttggctagggactgatatatgctggcaattattatatggtttgaagcctataaagacaatgtgagattctatctgtataaaaattagctgaattagctgttaatatgatttaatgcaatgaaatcgatataaaatgggcatacaactactaaattgagcagacaatatagtcagacagcatctttattcttttcttctattgtctctttataatttattcaggggaggtaagaggatcaagaaaattgttatttaattggaactgtgctatagataacttaatgtcctctgggactggggaatttcaaagctcagtccttttgtgtagcaatttctgggggttcttcaggatccacaatcaagagctatcctgcatgtagtttcctttcatctggatgagtaaatctccattctggcttgttgagtagttattccatagtctctaggaatatcttatttgcagaggtcctgtaacctcttccaggtggccttgttataaagtatgtatatgtatgttgccttcaacggcatggaaaaaactcatttgcccaaaaaacctctggaaatgcagagcaatcccaatacagcagcaactttctttactctcccacaagaaacaaaagaggatatctagcctaatatttgttttctagatttgccaggaaggagttagacagaagtcatgatgtgtctttaactacaggcaaagactattaaggattccatataatcctgttgaagcaattttctcctgatttcaggagaaggggaaagaaacttttcttgcttgatgagtcatttgcctaatgttacagtctcagtaagggaacaagtatttctatccaggattttttgactctcagtatttttttttcagtccaggtttttttgagctcttaacttttaccttatacttctctcatgctttatcactgaaatacctctcattgcaaatagatagcaactctattttaaaaagcagattttttccagtaacgcttccttttaaaaatagaaaaaaaaaaaacccacacaattttctcattttctctctgggttatgctttgttatctttttccctgattctcagtcatctttccaatggactgtatctatctgaaaacatgaattcatcttgtattccagcgactagtgaacaattagcaaagcttgtcctaagtcattaattgatagtttctgtttaatctttcccgaaactggagagccctctgttctcgtgtttattttgatctctttggaatgcaaattatttgctcttctacagttctgaatctccttttggcctacatagaaatacttggacatatatagtatgcctattctacttaaaattttaaaagatgaaagtgatttttgtctagctttgaggtctctttgaaattaatattactaattaaagggtagttggcttaagatgcctgctggcctcacaaatgcgacacaaaatgaccctaatctataaggcagtataaggtaatggctaaaagcacatatgcgcaaccgtcaaactgtgtttaaatcttaaccctctattattctcagttttcttacctttaaaatgagaacaatattaactatcctacagggttactgtgtgaatgaaatgtgatcgtgtacataaagtcagagctccatacttttattattattatcactatttaggcaaagggaaatgttgctcattgtatgacacaaaatctctcaactgaaggaagtactgaaaaccctttttgatgcaaatagccacagagaggatatgcaatctggaggcaatggattaatctattaaggtagatgttaaagtctgttaagtattttatattacagctgaaaacaaaggaggtaatcatactcagggcaaaaattcctgctaagaagttacttaagttcctctaaagatacagttaggacaagctatgaaatacatgcctcaatatacaccacggaatactatgcagccataaaaaagaatcagttaacgtcctttgcagggacatggatgaaatttgaaaccatcatcctcaacaaactaacacaggaacagaaaaccaaacaccgcttgttctcactcataagtgggaattgaacagtgggaacacatggacacagggaggggaacatcccacactggggcctgtcaggggttgtgaggaagcgggaaggagagcattaggacaaatacctaatgcatgtggggcttaaaacctagatgacaggttgatagctgcagcaaaccaccatggcacatatatacctatgtaacaaacctgcatgttcagcacacgtatcccagaatttacagtaaaattaaaaaaagaaaaaaaataaatatgcgcctcaactttgggtcaaagaaagtttggctgccttctgtgataattgttcaggtttcaaaacccacccaggcccatctagatagaacgtgtgcctacggagaacaactacccctccttcataaggttattaaattttacttgggaaatatcaactggagaagaattctgttaagtagttttcccttgcagattcttcaattttatcgattgttccatgaaaaactggactctttgaagtgtggatattcttgaacaaaagataatctctctggagattacctggttttaattagttggtgctgaatgcacctagacattttagcctctttctcacttaaagctgttcagacaagatagctgtcttaaatcccttctggaacactctggaaatgaacaaataaatttctaccagcttctgtaacagataaacccttaaatctcagtggcttaaaacaatagaagtttattagttctgctctgtgaagacatcgagggacttgggctttattttgtggctcctccctcttctaggtctttgaagtcctttccatttgacatgaaaaaagatgaagaggatcataattataaggttttcataaaccagacccaacaataaactcataatgtctgttcacatttcattagtcagaactcagtcatgtgggcacacccaactaaatgcaaaggaggcaggaacatgtagtttagctacgtggctatgaagtagagaaaatgctggtgtgtagcttgccagtatctgccaaaataaatataaattgatattaatatgaatctagtatatatgcctagatttatgcttctattttttgtttatttataaattgtttcagagaagacacaggcatctggaaaatgacctattgtctatctatctatttatatcaactatctaaatgatcactgatgccattttgtatttaactctgtgtgcatgtttttacacattagagaaacacatcttgccatagtaaggtttaactctgacctttgttaatgtaatccttttccagatacagctgcatctaaaattcccatttgcatgcctactcttaattcatactaaattgttattagattcctaggtggtataaatgcaacctttaaaacaattatatatcagtcaagctaagcaagaacatgcaattctttatattccaaaaactgtaataacatattttttgcctgtaactttagcagatatttgggaacttttatctactgatggttgccaacttactgcttgagttctgtccaaaaaagagtagaaaactatcaaagtaggaagtatatttaattgaactcaataaacaccttctggctaccttttatatgcaaagtggagctggggacagagatgagcaaatgcaatactattctaaaacagcttatagtctagtaaggaaactctgtccagtaaacaaattaattatattgactttcccaaattggaatcacataattttaagcagcaaagatgcactttattacattattttatatattgaaatactgaaaaaacaatatccagctatggaaagacaattgtattattcatgactcatggttccaaatggactattatgcaggaattaaaatgatggctataagagatatttaataatttggaaaatgtttatataaaaaagatattaagtgaaaaaataaatttatatctacatcctgaacatagttaaggaaaaataccttcatgcataaagcaaaagaatgaaaggaaatatgccaaactttaaagtgttagattgtgctataggtattagttacttattctaggagttctgctttctcttcattttttatttaaaaaatgttttcaatgcgcattgtattgcactgattttgaggaaacaataaaaacaaaaatacaataaaagtccttcaaaattcaatcataggtaaactctgttctgaatgaataatgtatatagataacttgctatatctttagtcaattaattagccacattataaagttagggcaaagataaggctccttttctttactacttctattttccctgttatggtaatttacctctacctttaaaacatttataatatataattgtatataaaattataatttctcacctctctctctctctactaaggaaattacatataggagaggtagagagaagatcaaatatgtatatattctagtttatttatattttgataaacatttttgaaatcatagggaatcacattaatatttacattaatataatatacatgctaattatcctcttctgaataatttgtattgaaagaaaaccaataaatggctcagcaaacagattttcatgattcaaaatgaagtgaaaaacagataaagtatgaaagagcagatagagtataaaacagcttacataaagaaatgaatcctggaaatttaactttgttttatggaaaacaaagtcatttcaggctttaacttagccacttcaggagtataattcataggttatgtttatatgaaagcttcattgagtatgtacaactaggtgaacacttagttcagttttccaacaagaaaactggttttaaaataagcctgttagtgtctaacgatgtgtggccagaaaaaaagaaatattaactaacaatttctggaacaaatcatttacagggctactaaatatctttctatataatatttggaaataatgataataataaaaatacttatgacatgattatctgatatccattattttattcagtcctcaaaacaatctcccctgagataggaactgttctcattaccattttgtagataagaaaagtgagtctctgggttaagtttacttgtacaaggacttgcagcaaagaagtgatagaaaggggattcaaactcacgtctttctggctctaaagtcctagttactctagtaaaacaaacaaacaaacaaacaaacacaaccaaaaaaaccctgagtggtaggtggcattattcctatccctttaacagaataggcaattgagtctcaggagatctgagctactagatcaaggtcagttaggtagtgtggcagaactaggattccaatgcaaatctgtcattgacctggctgaggtccctctacccatctttgaaaagctgtagacctgccgtagcagaaaaactaagccctatccctcaatacattttgtaaatgaaacaagcagcatttattatacaatttactagtttcagctttatcaaggcctcataatgttgtattaatatgttgtattaatattgcatgttctcagcatgaaaaatccaaggtgaaagtgggtacatttgtatctgctctgtaatctaggttttctacaagtagagtgaccatagactataccacacacactgggatgcttctgtaggagtggggacactgtgtgtagtaatgctgggcagcggtgaaaaacagagactgtcttagtcaaaggaggacatatggccaccactgttcctgggacatgtagaccctccctcttgacagtcattggctggtttttcccttaggctcgggggatctgttataaatactcttgtctcagatattgctctgaaaccaactgagaacttttaatgtaaatctgaagaaacgtatctttctttgttcctaattgattaatctagttttaggaaaaacatgtctaaaatcaagtaagaggttttgagctggaattgagcagattttcctgccttttggggggcattgtcatgtttacagctagaagactgttacagtaaggggtttgcattttaaccctgagtaaacattgatttttgtgttccatttttgctgtagaaagagtgatgcttatgaagtctattaacacccaaggaagtaatgttgccttcaactttcaatccttgctctgatctccattgtgagaacttggactaataagagtgaactatgttattttcttatcaacattgttctaattggcagctgacttcatgattaaaaacttggaactagcaattcatcatcaagacatcaaagatataatggtatgctatggaaacagagatataaccatgaaaataaataacatggaaagagaatagggcattttgaatagccatatctgagagcaatttctgattttgtaaatggtgataactgtgttaatctagtatgtaaactcataaggcatgagtttcccaatgtcaaggataatatctacatctttctatttgttttgatacttaaatgagttgaaagtacataaaatagcaagcatagagaaagcccctagcaaatggtggttctcctctttttattttttatttaaaatagcaaagtcaaaccccaagttctatagctacatgctgtacctgtatttttcacaataaacatactaaacgtcacaatctatcttttttccctcctattccctctattttcacttctttttcttgtccttactgtttccatctttccttctatttcttctgtttttttcttattatgccctcttcccttccccatctttccctctcacccaaagtcttaaggtggccaacatattataaaatgaacatactgcacatccgcatgtgaaaaatgatttgaaatttaaattttattattttttagattgagttctgctccatcgcccaggctggagtgcggtggccatgatctggacttgctgcaacctccgcctggctggttcaagcaattcttctgcttcagccacccaagtagctgggattacagctgtgcatcaccacgcctggctaattttttttcttgtatgtttagtagagaaggggtttcaccatgttgaccaggctggtctcaaactcttgacctcaagtgatctgcccacctcagcctcccaaagtgctgggattacagacatgagccacggcgcccggcctgaaatttagtctttttagaagtgatcgttattatcaaaatcattagccctttaatcaaggataagtcaggtttgtttataaggcctttggggacagatttcaatggcatctcttagaaaagaaacacgggatgtgtaaagtgctgacaaaatttttcctctggaggataaatttctctgtagcagacagacacatgaatattatatttagatagagtgctcttcaatattagtttcattccttaaaacaaaatggaaaatattggtatatgtaaagcctttactatccttataagattgaaacttctgttagtgctcatgtttgtttatatttttcttctttgatcctttccctaaggccttcaataatgggtactgcaatggaaccaaagtcacaaaaggacttataaaaaggaattaaaaaacgaaagagaaaggaatgaaaggtacttaggtaaaagaaagaggaggaagttgaggaatcaaacttctctgtcttggtttaggaaacggtgagggcatctaaggatttattgtatgaatctgatttttcagtacttttctgcatcagcagctgggttccggtaactgaaagctgattactgcgtaaaggagtgaaaaatagatgttaattagataaaattgtctgaggagaatagcaacattttggaaacctgggatataagaaagctagactttctgcaagtttatttaacaagggagagtttccccttcttatcctaatcttcgtttctctgtcctcctaaaagccctcctaaaaatcctccaacaacctcagtccgtcatgaacaagtcacagatccacagtgcagagtctggactagtgctgaccttgacagtgatggacaccctgtgatctggacttggctctccatcacaacaatcccaggtctatttactgtaagaccaatttacagactaaagggcttaacttttctgtccacgcaggtagaaatttctgagtattccaggcaggctggtattgaggcttaccacaggagtcagaagttatttttccacctggaatgcacttcaatttttccacatggactactccctgatttcctcaccactgccacaaaggacattgatagttacattcaaactgacatacaaaattaaacatctaagagatgccaggatagttaccaaaactttaacacttgaatcagtaggccaagtaaagatctgctgttaccagtgtgggtgaacattgttcaatctgtgagggctcagagacaacaaggctgaaaaaaagcaaattttctctccctctcttcttgagctgagacatccatcttctcctattctctgatatgggagctccttgttctcaggcctttgggctcagtctatgttgtatcactggctttcctggttttccggcttgcagagagcagatggtaggacttcttggccttcataattgcatgatccaatgaccataaatctgtgtgtaagtttgtgtgcatccacatcttattgattctgtttctctggggaattctgactaaaacagacactttaaataaatgtcattgttggcttaaagcagtggattctccagttttagtatactaagaagtcatcctggaagagtataacagggaagaatatttgttctgattcatcaggtccagggaggtacctatgaatcttcactgttcatgaacaatttcaggtgattctcattcagctgatgaaaggaccactcttccaatagaagagtgtagaacagaaactctattctaaggaattcacgcctcaaaggaaggaatgggtcaaattctctttctgacttaacagcaatagctgtgaaactgaagctctaaaacatttaaggaaggatatgtttcaacaggaaaggaaaagaagccaacgtggtcagtatgtttcctaggaaagagagtcactggatgagatggggatggtcactgccagcttagcccagcctttgggttttcagatatagcttctgagtatctttcctgtggaaagagtacctgggcgtccttgaagaccacttgaagattctagtattgccattgcgagaaaaaaatgttactttaagaataatcaaaggacatgatggttcattcaccaatcttttgggtttttattgtattagtgttttatcaaaagccagataaagtggcagctctgtgtgtgaccaatgacatttacatataaggcacattcctgtgacattcccagattatgagtctgtgggatagataaaatatattgattaactccacccttttctcttctactcaagagtacaaatggactcaagagtaagtaaaaatggtggtgttatatggagagtcagtggttcattctgcttgttaataggcttcattcctcaaacttccacaatcaagctgttattgatcaaaaatgacttgtcatagccatcacaactgctgcgtgaacacgcagttgggaactgtgacaagagaggtggctttgtactttatggccctgagaggatgaggattacatgctgtcatgttaggggttcaggagagatgttacctcaagctgcaatcctccatgatgggtcctctctactcttcctgggattgcagaaaagatctgtaattgaacaccatctatttttctgcactgtcttatcagcggtcataacaggtcttcagagaaagctttttagggggcttttgagtgctacacagtgttggtgtagttttgaaggacggtagcaatgtctgaaaaacacagcgcagagtcaccttcctattgagtcaccaaaggcctgcaggtactccttggataatggggattccctcgaagaacctgcaacacagtccatgcaatgctagtcaccatgactgtgttcattaccacccggtattgcatgcttttattcagggcttgttataacttcaagtgttaccaggacaaaagcagtcagtaatccttctgattactgaatggacgttttgaccataaacagttgggcttaacaaacagggagcaggtaattaaaataccttaaagtcatttaatttattcaatatttcagccatcactaagatgagaaaagaaaaaaaagtttcttgcttatcaccttagagaaagaaagggtcgacagggcaagtgtaagaataatctcaacctgttcgaggaattccaagcctatttaattctagaaaattttgaaacgctacttggtttcaggaaatgcttgctgtaagggtcaaagacaggcaggttagaagcacaatcctaacttatcaaacctgccccagacatactccacattgttcattctgttgccagaggagttattagaaatctagacttctgatttgcatcctaggaatatcagagtgaggacctagaggcatttttttcctcatgatgtatttagctttaaggactgtgtagaaataaatatttagatctttaatagcaaagggatgagagataaattctgtgtgtcgaatccacattttttggttactggcaagaatttagtgattgaagttaagaactcaatactgtgattaacgtgctatttaatgtgccagtcttagtaatgcactatttaaagtatctttctttttaaaagtccctactatgtagaatttggtttaggattgaaaacctacttggaatagtggtaaatgcttaacaactggctttccaaagggtggggtaaatgggggggctggggttgaggaagtcctgttttctaccttttgcagatttccatgatgtaaatattttctatcatgatcaatttctacctcacaatatgataacatgcttataaaatttgtggaaaatcaacagttgattcttgcaaagctgatataagttggatccagcacacacaagtacctggaccctacttctttgaatgcaatagctccatatatattaagaccctgttttatgtaatgtatataattttgacgtaaattttgtgtaaccaaatgtaatacattgtacttttaaaaaaccttgttattggttcaaaacactgttatgtcttatttcataaaactgtttctgaaagttctgaaaggctgcaagtgcattgaaaatttcctaaattcattataggtgaaatctgacacaaattttattgtcttcaaaagatttccattttaaaaagtatatatttaatttgtcttttgtgttacattttcacatttgatagttgcatagtaaagaaaggcagttcttaatcaaacttggtgattatatggaaacaagtgtctattaggcctcattttgagggcaggaaggtggcacagactaatggttaagcccatgggtttggaatcaggctggtcctagcacttaccacctgaatgaattaaaatggggcagttacttaacctgtttgcctcaattttacctttgtaaaatgggatactaacagtacctacttcataaaattgttgcaggcttaaacaagttaacatatgtaaagtgcttagagcagtgtctgccacttactaagtaccacatgattctgcttttatggccactaatatattttaggacagcaattaacaagctattagtgtagaactcgataaatgttgccttagattagggttctcaaagtatggggcccccaaaatctgtgttttaataagcatgcaggtatatctgatgaactcctgtgttctaaaagtgtgaatgttctttctgggagaaagtgtccctccatattatagttttttgagaccaaatggtctggattaagcaaactgcttaacaattaaaaaatagctataattttatatgccaggcataatgctaggtttttttctgtgtatcatagcatttactcctcacaacaactctagaaaggaggtactgctattgtcattgttttatagataggcaattgattttcagagtccttaagacatgtgcccaatgtcgcagtctagtaataagtctggttccatcatctctacttttgcccactataccatacggcctaatatttctaaatagggactattcagaaatctcactttcatttaagaaattaagttttaggaaggtgattaagctttaagaaagcacaaaataaatgttacatccttcatattttccagttgagtagatgccaggctgggagtcagcctcactggaaaagaataatttgtgtgataatacacaatgaactggaccactctcgtggtattttgcagaactttctgtgtatttttttttaaatctaagtttgtttctaaatacataaatctctgagaaagcccgtgagaagattccactaaggcagcaacaaagacttctgttccactggactttttttaggtaaatggaaaaaaaaaagaagtggaagcaaacaactgaacattcgtaagatgctatctctcaataattacgtaatattatggaaatagactctaggcaacattctaaaatttgggctttacctactttttttttttccattttcaaagagtggaagaccacaaaagagaaaagatattcacaatcacagaccacagagataaagacaagaggagacatttcagggttactcctaatgctaagtatctgagaattaaacctcccagacaaccaggaaggcttcaactgctgggaatattcacacctttttggatgactaattaattacttcaggtgatagagagctcgaagggcactaaagagtgtgtgtcgggggcgggttggggggagcagtcttacccttattgcctcaaaagaaaattaccttttgcacttctccagattacgacgactccctgactacaagtataaataaaaataatctattcagaagcatctattacaaataacattctagggagagctcttgactgcatatcctcagaagacaagttttattagaaataaaaaaggagtgtgagcatactaaacagcagcaccatcactatacacatgttaaatattttactactgtgttagtgaaatatttaaagtgatctctaaacttttctccccccatcacatgggagcctgaatatgtcactacccaatgctgtctgacaacctcacgttggcaaaatgcttcccaggggaaagaaaaaaaaaaaggaagagaaaacaagaaacaattcatgtgaaagagtgactgcaactattttgatttttaataggaaagaaatagatctcatattaaacaaagtggtgaggctaggcattaagagatgttgcaagccgtttgtcccagattctggctctgcaaacaagccccagcaggcttcaatgaaaacatcatttttggtgtagctgagtgtgtggctcgactgctcttagctgcctcttgctgaatgatgtcactggaaaggacatccaataaaaaagcctctcggacctgcttatactgtgtgggttctttgtcctttacagcctttgctcctgggatgaaatgtaagaacacttcagctccagagtcagctttggcgctgatcctatcctgaattctaagaacttttaagccttctttagattctaaatgagccatctttagccaaactgcaattcaatgcaacagatgtctggagggacactgaacatgtggctgaaaatggatcaaacagataacaactagatttatgtctaaatggggtcttgctatagagagaatgtttgcattactgcaaaatttatatgttaaatcctaacccccaaggtgatggcatttggagatagaaccttcgagaagtgtttaggtcatgagggtgaagtcctaatgaatgggtttattagtgcccttataaaagggaccccagaaacctccctcacccctttccaccatgtgaggacacagggagaagatgctgtctgtgaaccaggaagtgggcctttagcagataccacatatattggtgccttcatgaaggtcttcctactatgcaaaactgtgagaaataaatttctgtggtttacaagccacctagtctatggtattctgtcatagcaacctgaacagactaagacaggtctcttctagaccaatctatacttgcctttaatatagaatccagcaccaaggcctaagacaccactggatacctctgtaaaactctccccacacacattttactacagctaatgttgcaatgttgaaaaatggaaaatacagaaaagctattgattcttttggaccatcggattgatatcattgagaacttactatgtgctaagcactttacatatattgtctaacaatactgggagaaaaatagttatctctgttttataaaagagttcaaggctcagagaagttaagccacttatttaaggtcatactgttaagtcaatgttagaattggaatttgaacattggtcagtccctttctaaaccccatatacttaattgctaaaccagaaatagaaagtatgctttacattgtgagctgtgaacagtcatcagtgggaatggccacctgaagccactgaattgagatgacatctaaggctgagtgtgtgggctcacaaggaaggaggatcaggtcaatcagcaatgcaggggtagtggcagctcttgtaccaggatttgccatccttacttccatcttactggtcctcagttactaatctctatcttttattttgtttggttttctataagcttaacatgtatgggaagaaaattcagttaaaaggaaaggcctagggttggtatactcctgggtcactgcttcacttggtgatccaggggcagtcagttcttatttttcatatatgacctaaaggaaccaaactgggtagcctctggaattaaataattgtgtgcataaatatatatacacattttaataaaatagtttttacattatcttgcaaattatattttatactgtttaatattctcctcctgctagtaatctacgtgaatgaaaaaggaaaatagaggtatggaaaagtatgtaatctttacataaagtagaatcctatatttacttcccctatagttcacccctgcaatgtcactgtaatttggaagagcattccactgggatcctttgatatcaatgccaatgataaaaggaaagacttcttattactagaaatggaaaaccactattattgcatattaaaggaaaaaggctttcacaggaaataattagttcttgctctgaattaagcaaactaaacccttaatgtaaatgataactgagaaaaatcagtttcattttctgtccataaaactgaggaggaggaagaatcatatctcatgtgggtagtcaccatctctcacctattatggaggttggattccggtcccatcctgtattgacatgtgaaggggacaggacttaaggtgcatagtaactatttccaacaccagctgttcagagtactttagttaatacctcacttcgaggcaagaattttgccttgatactgagaaagaaaggtgcaaaggaaggatcctgcttagccagaagaagcaaaataatgtatagtaatgaagccagtcttaaacacagttcaagaaagacacagctttagctataaggcactcaaacgtgcaggatgctaagtgcctttctatgccatttattcattcaattccctggcaataaactactaagaaaattttaaactaataatgcattttacaggttgaatctgaggccctgattttccagaaaaactttccagaaaaacatggtaaggcacagcaattggaggaaaactgtccaagcttctggccatcaagtattacacatttatttatttacttagtgcttccaagttcaggaggcagaatatattgctattgcctttaaagggaatatcttcaatgttttgaccgctgctaacaagatgattagcatgtctttaaaccatctttattaagcagatgtttgccctggcatttttccagcccttcttgggtcatcaagcctaatattctcttttcatttgttggtatgctgttcatttctggtcctcagtgaggggactgcttcttgaccttgtcatgcacatggtttgatttcataagtgagaggttggcctatctgggatgggtgaggatattcccttagcccttgcacaggtcatcagtgaagctcaggcagcttgaggggataaggcaataggggaagtgcttcttaagtgatactttttccttggtgaggactctgtttatgtttagtttcttatgtgacataatgaattaggaactaaaggcaatttgaagatttgtgccctatgtgcagaacagaaatttaatgtatgaaagcaaaccacaggtcagttaggagagttgatcaatattgatattgctctttaatgaaaggaaataaccctgatggattttccttgggattgctgatgagtatgtatttgtactcaacacatggggcttttcattgatctcagtcaaattaaaattttattaacaagtcagacatccatctgtatttttccagaagttccactgtttccaaaagccagttaatactcctgcctctgtttctctctctctgaattaacatttacacatccattatgtgccaaacactttcccatgttttatctcacctagtcctcttaacaaccttgtaagataatattatctccatttacagataagaaaatcgaggcagaaaacagctaggtaactttccccttatcacacagataataaaaagcgaaacatgagctcaaatagatctagttttctttgacactaaagttcgtattatttctacaaacctcacactgttcccagtggcagaatgagggttattttgaagtatggttttgtttgaatggagatgatatgaaaggataaatgacgaggatggcaaaaaaaaaaaaaaaagaaaaaaaagaaaaaaaaagaaaaaaaaaagaaaaaaaatttcctataccagcagttcaggaactcttataacccacccaggaggacctaaggactgctgttgttcccctcttattgagagagcagatcttcattgtccatctagattagtgaaggtccagaaagaaaaacatggcacctccaagtaaagtgacagagtttagcacatgtgaccctaaagccttctgagattggtcccttggtttttagaagctataatgcaaatacaatagtagtttgaagttttctactccctgactatttggatacagtgttctcactttgttcaaaggctgattttagacatccaagcaacatgtaccaggttagtttgaggtttaatcaataaaattgaccaggaaagaattcaaaagccacaccgtctgattctatacttcatatatggggcagacaccacgctcttgtcttgtgtttaatctacagagtctctgtgaaaactgacttttccttccctcatgaaattttaaattacagcctgccttatatttagtgggctgcagggttactatggcaatcagctcctgaagtatagggattttatctgagcattttagtgaagagtacattagaggtcagaggtttgtctctgttcctcttctacacattgggaccctttccccaaatggatggtcagatgcatgctctcaattgcctcataaatacaccacacataatttataaatcagccggacactaggaatgggctcttttgtataaaggaaatgaagtatacttcagaagtaaatctgtgagatttccaaaaatgggagaaacagttcagtgtcaacacatatagacatacatataaacacatacacatgcatgcatgtgcatacagataaacacacagcaactaatatttattaagtgtttcctacatatcaggttctaagaacttcacatgcattaactcaattcccttaataaccatatatggtaggttacatcctcatccctttttgtgaatgggaaactgaggcatataaaggttaagtaacttaccttatttagctcacacagctaataagtggcaaaactgtgatgttaaaactgagtaatctgattaaagaggttcttctctgaactaccctatgctggtttaagatttgtgctgagagcagagaacctggatatgaatcttagctatagctttgtgatcttggatgacaagtcacttcaatgatgcttacttagcctcagcttcctattagtaaactgtggttaataatatcaaccctacacaatggttgaggggagttaatgagaaaaatgtatgtaaagtgctttacatacacttacgaactgtaaagtgctacatacatgttatcaatccattgtacatgcagcacacaatacgtactctgtctttcctacttatacttctcggtcaccttgcctctccccacaatgaactgaacacataaaaacatataatatggaaaaataatttcctaatacccttgaaacattttcatacgtcctaatctaactattaataattgtatacatacattttatgtctcagagaaaatgaaataatttcagagcaatggttacaaattttaccacatcaagttatgtgaaatgcatgcatcttagaagctctatgaatttatatgcttacataaaaagcattagttaatagtagagatgttactgccatcaagacaatgagactggtgtacactggtgttccgtatcataaatacacagactggaagttctcaatcatttgaagtaggtgggaccttaacggaaaagaggcacagtgaggaagtgagacaccaagtaggacacagggcattgaccctggattcagaaaacccagatacaagtcatcatccatccaaaagtcattgaattcctaccatgtaccaggaccctgttggtaggtaccagagatgcaaaagcatataaagacatgatgctttcctagagtcatcctgcatcccactaactgtgtgaccttacatcagtcattgtatcttactatgaaaagccttgatttccatattaataaaagaaagcaaataaagaatcagagaggtaaaatcaccattcaaagttcatgcatctaactggtggcacagaaaaaggtgagaataaaacttcaaacttccaatttggtactttccctgaccagatttcatcattccttttgcaattcccaccgtggtttgtttcacatacttaagtttgactgtcacatgccaagatattagttattaatttttgagttatcccagagttttttctctgctttcctaccagaaatttctggcaaggtctacatcagagtcttccttttcttgtcctccaagatgggcgtggtcttgcacagttccagggctgtgcagtggaagaatgacagaaaaggggcagagtagaggacgaaaagaagaaagagaaaacaagggctgtggagttttcatgggttgagaaaggcagcttatactgtgtggggcagtggactgggaagaacaaacagaaaaacaagattttaagattaccagagatttgtggtccctttcataatattgaggaatgctagcttgagtagttttgaagttattcttggttgcctgggttgtagtcatttaagcacaattgctctgaaattgatctatgagggtaacaggtttatgagccttacaacaaccattggcttcatcttcttagcagtggaagactgcatgtggaccttcccaatgcatctcatatgtgagactcaaccaggttttaataggtgagcagtgagctgtgtagctcaactggttgaaatctagtgatgaaatggtatcagcaaatggaattgggtcttctgaacactgtcttgttaagtaaatacctatgtcaaaacttccttcaaagctctgagttagaagggaaaacacacctcctgtcattcataagcctgagctctgggctctggattgtggtctgagggaatatagaaagagcattgctcttttatgggctaaggagatggaattctttctactatagatcactgagaaaatcagcataatatttaattcattttgtgttcctagctctggagtaggggtcatagctggctcttgatctttagaattttatattctagaagcagagtaaggtaaggagattggcttttactgagatcatgtgataatgagtttatattcatcatctgtttctaaaaaaatctttataacaccctatgtggtggcattagtattatctccattttataaatgaggaaaattttgagtttaaatgacttgcccaaggtcacaacattgtaattatcacagtatattttaggcaggaaaaggaaatagcgtatttaattataaagtaaatgctgtaaacaatagagttttaggggaagaggttgaactgaagtaagcacttctgttttgacaaaaataattagacacgtttctctttggactctgaattattttagtttaacagtttaggtgtgatataaatacatggaaatgagacaacagaattgttatgacattcttcttttctgaatgaggaaagaaggtgtgtctaccagtagtttctcactcttcacaacatgagtgtcataacacatcaaccatgagcatcatatatatacaacatgtatttttcttccacttatttttggttctgaatctgctgtgatgtgaaagtgtaataattttagtcaatcaaaatagtatttcaaattaaacagctccacaacaaggcatcaaacataaaatttacagtatacatccaacataaaaggttaggatatccccgattttctcctcttgttttcatattcagttaagacattgcatttggactcaggagcccttggcttgaaggctagcttgaacagtttaactgtgcatctttgagtaaattaataataccaagtttctgaatctttgttttctcatctgtgtgatttgaggataatttttgggggattttttgacattaattagcaaaacacaagaaaaagtgtagtacaagataaggcatacagtaggtggtaaatgtttatggttttcaattagggtttattattattacttctatgatgatgatgattactatgattctactggctgagagaaaaaggtagcctaaacaagcaaaatccccttgaaattccccccaacacttcccaggccatcctgaatatcccagcaaacagagcagaagaaaggtgaatgaagatatcaagtgcagacagactccagtgaggtgaaaattgcaatggtgagaggttgatggtaaaatcaaacggaacttgttattttgtcattctgatggactggaactgaggattttcaatttcctctccaacccaagacacttctcactggaaaactctcacaatcacatttataacaaaggagaggcaatgttattctcagaaattccttttagaaagtaaactgccttgttggggaaagtatttcttctgggtggtagatgactaggccctgaggaaattggtttaggctgaattcttacttacaaaccttggggtggagctggcttctggagggggaacaggagaaaaaaaaaacagccagagaagacagaaaagagacagaagatggtccattatcccatgttacattttccagtgaccacattccccaactcaacacacacacacacacagagcagttaatcttcaggacatctttaaacaaaaacaaaaaagaaaaggaaaaacaaaactaagaaataacaggggcaaagggactgagtacttttgaaattagcacctgtgacccgtggaagcaggaagtggggcaacgggaggtaagctgtccacagccattacagtagtgaatttagtactctccggttatatacgcagagtttgggcaccatttaggagtagggcctttaggagtgggacttcctagtactatttattcattcaacaatatttcctaagggtctatgttaggaaaaactgacagcctctcactgctcttgcacgagaatgcacaggaaagaaagggactgcaggtctgactttgagggaaggtaggtgcaaacagatcatggctggagtatcagggaaagtgctcgtccctccttgagcactttctccttaaaggctgtaaaactagtttcctaaagatgtagaggtatacattccaaaatcaacatggtaacggtcatttgtgacataatgcttaagactggccaaacgagctggagaagggtgggttatacagaaaggagaaagtacatggtatctttttggggatgttctactatccaagaagaggaagagcataaaagagggctggctccctgcacatcagttcctcaactcagtcagcaagacctgctccttgggctatttcctatggagataaggtggggaatagtaattcccactttttcactccatctcacttatggtcgacttttttttgtgtgtgtgtgagtttcagcaaaattgttaacttttctacatgtcagtcaactactcaataaatgaagctaaaaaaccaaccttcaaggggtacttatgaggatgaaagtagatgtcttctaaaatgaataaaatttctcccatagcaaatattcttaataagtagctattagttttgagtcttccttgtcaacatttgcaatgtggctaaatatgtctgtagtcaggatatttccctccctcccgtctttccttcctctcttccttgcttctttcctcccttccctcctttcctgagacaggttctcactatgttacctaggctgggctcaaacgatccctccaggctcagccttttgagtagctgagaatataggtatgtgtcactgtgcctggctgactttaaaagctagttgctttaagtatagattagactttcaattctagctttgtaagtactgtaccccccaaacagctaagacaatagctctagatcactgttagattaaataaacaagatatttggtttgaagacgttagcttcgtatgccaaagtaaagcattcactccatctcactatggtcaactatttttgactgtgggagaagtggggttgtctatgtaggtaactccttggccttgtaagtgaatgctattgtgtttctcagactgtggccttggaaggatccaattaactcatgtggagccctaaaattccacttaaataaatcaagtacccagattcatttatgactctttaaatatatatatacacacacacaaaatcccaaaccaaattgaccttcccacaaacctgttctcccttttatacgttaagttctagggtacatgtgcacaatgtgcaggtttgttacatatgcataatgtgccatgttggcgtgctgcatccattaactcgtcatttatattaggtgtatctcctaatgctatccctcctccatccctccaccccacaacaggccctggtgtgtgatgttccccttcctgtgtccaagtgttctcatagtttaattcccacctatgatcgagaacatgtggtgtttgtttttttgtccttgtgatagtttgctgagaatgatggtttcctgcttcatccatgtccctacaaaggacatgaactcattttttatggctgcatagtattccatggtgtatatgtgccacattttctcaatccagtctatcgttgatggacatttgggttggttccaagtctttgctattgtgaatagtgccacaataaacatatgtgtgcatgtgtctttatagcagcatgatttataatcctttgggtatacacccagtaatgggatggctgggtccaatggtatttctagttctagatccctgaggaatcaccacactgtcttccacaatggttgaactagcttacagtcccaccaacagtgtaaaagtgttcctatttctccacatcctctccagcacctgttgtttcctgactttttaatgatcgtcattctaactggtgtgagatggtatctcactgtggttttgatttgtatttgtctgatggccagtgatgagcattttttcatgtctgtcggctgcataaatgtcttcttttgagtagtgtctgttcatatcctttgcccactttttgatggggttgtttgtttctgttctccctatctttataactggcatcactgttcatctgacctcgcccacagactgttctttctctactcttcctatctctgtaactggcaccactgttcatccagttgctcagagcaggtcagcagctatcattgattcctgtctttctcataccaccctcatccaattaatcagcaacttgattgatcacttcatcttaaaaaagaaaaaaagatgaaactattcttatcacttccactgctaccaccctagttcacatcataattatctcttgcttgaatgactgcaatagcctctcagtcttcttcctctaccactgctcaccaacctgagccttctatttcccataaagccatcagagcagtcagttcgcccagctttgttgatagttttgaaacttgtccaaatcttctccaccttgggaaatttgcaatccttctttctccctggaaagctctaacccaggtctttgcatggcttgttctttcactaagttcagcattcccatcaagggtctgctcatcatcctctgctagtcttctgatttattattattcaaagcctctgtcactacctggaattttactgtatgctgatttgttcatttttgattgcctagtttcccaacaaaatataagatacattcagatggggattttatcctacctattgcttcatcttcaaagcatatagtttgtgatcaagaagtacttatttaatgaataacagagtgaatgctctctgtgtgtgtgtgtgtgtgtgtgtgtgtgtgtgtatgtgtgcaggaatacagaaaatatcgaactatagaaagaactatatcatgagtggaaagttctggcaggcactaggggatgaaatgctcaggcagacattaggccaatccagaaagccagcatcatcaccatatatatagaaactgcattatgattatgcacagctggaaccaaagacctatgtccagaacaaaagaacacagataactatgagttaaacaccgtgctacacactttaacgcattgacccatttagttctcaccccaacaagactggttatttttctcattttgaccaaatgaagaaacagaaatctggaaagcttaatgatgaagttcatgcaagaaagttgtagaactgggatttaaactcaggttttatgatttcaagccttttgctcttcccctaaaactgttgttctatgttcttaacaatagttggactaagctcaaaagaaggaaaaagagaagagaagagaggaggaatgagaagtggttccagctctaggaacctcaatcaagccacaagtctgcacagatcattccctattgctatagtgcatactaagcaatcattcctttgaatgaattgttagtattaaaatcactctccttcagcaaatagcactgcttacttcattttaactgatctttttacacatacattgtccaactgttaggctgagtcttatgaaattgccaatattctaccatttttgacctacaaaaacagcatttcaacaagattcaacataatagaatgagcattccctgaaggcaggtatcacatctaatgtagctttgccactagtttctgactgattaaatatctgttcatgatttctgtatatattatcatcactcttatttaaacagatagaggatagacacaatggcttatgttcctcagcacattggatatattttagaaatgttgctgagcttcagtatctgcaaaaagcatcacttcagtggtctcaataccccccccccttttatttttaacttcagtagtgaactttacccatcgaagcttccagccaatggaatataatatatgaagtagtcaattttaaaaatttggaacaaaggcattaaaaaaagaaaaactatgtattatatcaaaatgagtctttttaacactcctgtggggagaaaaaatacccttatttcacagtagaggaggttatcgcattcagtggttgagtgcattgaccaatgtaagtggaagagtcagaatgaaaacccaggtctgcctgacacaaagtctatgtggttaaccactctgatatactacatcatctctgcctagcaggcatcaagggctttgctccctgtaaaaagaagtcattaaaggtgtcatgaaaacagggatcccacactaatttgctacctggcatccattttctccagcgtgcctaaaagcaaagagctgaacttgctctcctgaagaaaccagggagttcagaatctctggtgtaaacagccactttccacggggaaggcagcctctctcagcctaagtcttaccaaatacagctgggcaggacagggccagcacagaccttatactataccgaaaagccaacaaaaaaagggaagggtactctgaaaatgccagcattgaaaatcaaggaaaaattacacaaaccttaatgattattctaagctctgtttttctttctcaaagcacttagattcaggtactcacactactacataaggactctggttgaatacaatgaacggcaacaacaacaacaacaaaggatttttttccatactgaggtgagttattgagggtgtctacagccttctctgaagagcttagagagtaatttttctctcccggatgatttgcttgtggctttggtctttttacctcagtgcaagcaagtggataggtgacctttcaaggttattccataagccctggcaatctgtgttcagatgataaatcaaaacaaagacagttcagaggttcgccagggctctttaggggcagccacaattagcatagctctctcaagacccggcagatgctaggcgtcaaggcatccttatttttagaacactggaggtggttgcccccaaaaaggatatagacagaaagaggagctgaccatgtcaagggcaacttcaaacacataggaacacaagtaaaacattgatcatgcaaacatagggaccgtataactttacatttggcagccattgccactagctgtttctcccatctcataagactcctatggatagaacattttagaagacaaaagtgagaaatatgcattattttatgtcagaggaagtcctggtaggtgtttgcattgttttgtgagaaataggcagtcatattaaaatattatatgtttcagtacctgtcacttttcagctgagctgccttccattttttaaaaaatgtgcatttgatcccaatttgctttcacctgtctctcaatttccacaagactctagttgtcaccaatatcgtacactcattttcacttctatctgtacctaaacccaaaccctgactatgggaaattactactctgggtattcggacgcatttctccaacttttctgcttctgtcaggtgttaatgacaaaggtgttaatgacaacactgcaggctgtggcccccaaataactcaccatcaggttgatgaattttcactgaaaatacccctccagtcctttgccctaacctgtcactgacatatataaacattttgactttatatatgtgtgcttaaatccttttgttttctaatatttggatactaatcccaagaagggcagtggatacatgcaaaataattgaaaaccatgtaaaacgtagccatagatacaatgactacataaatcatgatgtgttggttcaatgtaatgtatgcacttacataaaattattcaacaattatttattgagtctatgtgccatattttatgcaagttgttagagcagaggcaaagaaaactatctctatatggaaatattatcataggtaaggaaaagccaaaaaaaattaaaatagttatgtaatgcagtaaatgttataatgaaggcgagactaggatgctgcgggagaacagaggagggagtgatcaatgcaaaactaatttaataatataaagtgaaaaaataaaattatatcaatactataaacacattatacatgcatatagacaaacattaggaagcaatgagggaaagtgaagttatgttaaggtggtggatttctggttggttttctcttttttccttctctttatttttgtaataaatgaaagtttggtgagggaacattaactaaaagtaaatggtgccttgtgtgaagcgtcacttataaaatggatcttaccaaactaataggagacacaaaaggatactgacagactttctatacatagacacatgaaactgatgtgcagaccaatcccaataccactgaaaaggcaacttgtgagaactatgggagctattttttccttatattaactagaatatattgtcattagatgggaaatcaactgtagaaatcaatcattgtctggataaaaatcattaatcacttgacgatggttaatgcaaaatattgactaatatgctaatttcacagatgatgctaacatttatctaattttctggagtttggtaaggctagcattcaaattgcagttgaatttagagttcttttatgtcatattaaattggtaattttcccccctctttttctttgccttttcacatgcatccaaagttaagaaatagcttttctttctttgttgaggtaatattttgaacttggattgtggataatttcagtattattgttggtttctcatgaacaatatccatatgaattctcctacgtgttgaaatcctatctatcaataaaagcccaggctgggcatggtgtctcatgcctgtaatcccaacatattgggaggctgaggtggaggattgcttgagcccaggaggttgaggctacagtgattcatgatcataccactgcactccagccttccagcctgggtaacatagtgagaccctgtcacatacacaaaaaagttcatatctagccacaactttcttatgaaatctttcctgtcgaaaacaaatcttaaatggatatattttcctctttttagaatgcctgcctctttaaatataggttaataattggtaatttattagtgtctaaatatttgtgtgctagtcttcactactttaattataattgctgaaagaaaggtaatcttacattttaacatttacccctagtacctagtaaatggctgcaaacataaaagcaattgaatcaaaccgacacagaacattttatccaactgctgctgaatatgcattctttttgtgagcacctggaacattttgcaatatagaccatatgttaggctgaaaaccaagtttcaacaaattaaaaaaaaaaatcaaaatcttattacgtgtcttctctgaccaccgtggaataaaactaaaaataacgaggaactttggaaactgtacaaaaaatatggaaattaatcaacatactcctgaatgaccaatgagtcaataaagaaattaagaaggaaacttaaaaatttcttgagacacattaaaatggaaacaacatactaaaacctataggatacagcaaaagtagtactaaacggaaatttatagcaataaatgaccacatcaaaaaagtaaaaagacttcagataaacatcccaaaaatggacctcaaagaactagaaaagtgagaacaaaccaaacccgaaattagtagaatgaaagaaataaagatcaaagcagaaataaatcaaattgaaactaaaaaaaaggaaaatttcgtttttaaaaaaagttaaacaaattgacaaacatttgactagactaagaaaaatgagaaaagaaccaaataagtaaaattgttagagtaggcagataggtagacatgagcaggagaggggagcccctgagaaaagggaggtctgggaaatcccacgccccagggaccactggaaccagcatgctggatatgaggaggggaagttcctaggcagaaaggaacacccattaagaagccctgtaatcattcactctgcatttaacctgtcagaacgtagttcgatgcatgcctaaggaggggcaaagggcaatgaagaaattcctaagagataacacaggaaccattcatattcaacattggcccacgcatgtgcaccaattaatagtaactgatggtcctacaaaagcctgagacagggactaggcagggaggtggtggggaaagaagtaggggacttaaggcagggctgacatcacaaaatcccaatgcagaactctcagggtgctgctggcccattcccttaagcagcttgcagcttgctttgtcttatcttttcagagtgtactgtctctctctcaataaactctctgctcttaatttgccttcaatgaattctttttggctaaattagtcacttggcagaatactttctctaagtaacactaataaccaggattcctgaacctcctggtaatgaaacaaagacaaaaaaggagaccttataactgataccacagaaatacaaagaatcattagagaatcgtgtgcagcaatacaccaataaattgaaaaacctcgaagaaatggataaattcttaaacacatgcaccctaccaagattgaaccataaagaaatagtaaatctgaacagactaataatgaataatgagatagaggtggtaataaaaagcctcccatcataaaaaatcccaggccctgatggcatcactgctgaattccaccaaatatttaaagacctaatactaattctactcaaactgttacaaaaatttaaaaagaaatacttctaaactcattccatgaggccagctttaccctgctacccaaaccagacaaagacgaacaataaaaaacgctacatgccaatatccttaatgaacacagatgcagacatcctaaacaaaatattagcaaaccaaattgaacaacacattaaaaagagcagtctctatcatcaggtgggatttattccagagatgtaaagatggttaatcacattagtagaatcaaggacaaaagccatatgattatttgatgatctcaataaatgccaaaaagcacttgactaaattttacatcactgcatggtaaaaactttcaacaaattgagtataaatttagaagtaatatacctctaaacaataaagaccatgtatggacaaacacacagctaacatcatactgaatggggcaaaattgaaagcctttaaaggtttggaacaagacaaggatgcccaatttcaccacttatattcaacatagtactaaaagttttagcaaaagcaattatacagcagaaagagatacaaggcatccaaatgggaaagaagtcaactgtatttgtctgcaaatgatatgaccttacatttagaaaaacttaaaaacttaaaaacttcaataaaaatgttagaactgataaattaattcagtaaggttgcagtaaatgaaaaaaaatgctcaccatcattactcatctgggaaatacaaatcataaccacagtgagatatcatttcatccccattaaaatggctattatcaaaaagacagaaaataacagatactggtaaggatgttgagaaaggggagcacttgtattttgttggtggaaatgcaaattagtgtagctaccatggaaaacagtataaaggttcttcaaaaaaactaaaatacaactatcttatgatccaaaaatctcactgctgtgtatatataagaaagaaaatcaatgttttagagatatctgcactcctatgtttattgcagcactattcatataatagccaaaatatagactcaatctaaatgtccatcaatggacaaataggtaaaaaatgtggtacatatacatactggaatactattcagccatgaagaatggaatcctgtcatttgcagtaacatagatggaactggaggatatcatatgaagtgaaataagccaggcacagaaaaacaaatctctcatgtgcaaattatctcatggaggtagtaaatggaatggtggttactagtgacagggaaaggtagtgggaagaggagatttaaaaaaaggggggttagttaatgggtaatacagttagatagaattaataaattctagtgtccaatagcacaatagggcaactatagctaacagtaatgtattgtatatttcaaaatagctagaagatttgcaacattccacacacaaagaagtgataaatgtttgaggtagtggatatcccaattaccctgatttgatcattacacattgtatgcttgtagcaaaatatcacatctccataaatatgtagaattagtatgtatcaataaagaataaaaattaaaacacttaaagagcccaataaatgcttttaaaaatttgtattttcacatacacacatgacatacctattattttcagctttagctgacacaggtttcaaaaattctcttatgtcaaattgaatttttaaactccaaaagaggaatttaatattcatatacacatattcagcaagattccttacaataccatcagttacttctgacatataatgactcttgctggctttatactgaatttaatcaaagcccagtacaactttctgcaacattggtaactgggtcaaatgcataggccactcaaggtctgggctaattacctacatttgtaccacctggcagatgtgaaagacttaagatgtgcacgtgctcattaattgagggtcaagctgttctttgtagaattcagcaaaacttcagctgaaatataatgccattcattttgcggtaaaattcccaggttattaagcactttgagatgtgctcccccctccccccgtcataagtgagaaatctgagtccagatgaacttcaaacctggccctgctcctacaagctgtgtgaccctggacagatccctgccccttgttgggcctcagactcctgcctataacatattttttctaatgaattactaagtacttttatgctcagactgtaattctttactctttaattgaatacttgcagctaatttttactgtgtacttactatgtggcaggcaatttgcttttatgagtttgcactctgtatcaggctgaaattaagccatcttgggtttacccacaatggagatctttgcaaaaatgtatctttttgccttgtctgtgaactactgataatccagtgatttgttctctttaagactaaatgggtcgaaagcaagttcaatgctaatttaatgcacttattttccagccaccaagcaaattattccttcccaagtcatgttcagtggagcaggtgttatccgtttcaaaatgtaggcctaactggtgcatcttttaaatgggtttcaggaaggggattcacatgagcctttttttggggtgggagggggggaggtggacaccagtctgaattagttgctattttgaaaattataatattttagtttaatataatgagcttgatacccactgaggtagcttgtctccaagataacggccatcaattcctttcttctctgtatgcacaggcccttgaaaggtaaggtctgtttctcttgctacttgaatctgagctagcctatgtctacattgaccaacagaatgtagagaaatggagaatatggagaaagtggtgctgtgtgactctgaggctaggtcatatgaaacctttcagcctccacctgactcttttggaatgctcactttcggtgaagccagctgccatgtaaaaatgccaactgctcaaagaccattatgctgtggagaagtctaaactagccatgggaagaagcttcatagggggatatgcctgaccagccctcagctgttccagttatgccagcccaggaaccagcaaggatgccctcagatgattccagtctcagccaccatctgacgtcagatatataagaatttgaggcctggcacggtggctcatgcctgtaatcccaccactttgggatgccaaggcaggcagatcacctgaggccaggaattcgagaccagcctggccaacattgtgaaaccccgtttctactaaaaatgaaaaagaagtagctgtgcgtggtggcaggcacctataatcccagctacttgggaggtttaggcaggagaattgctgaaaccagggaagtggaggttgcagtgagctgagatcatgccattactgggtcatgcattccatcctgggtgatagagggagactgtctcaaaaaaacagaacaaaacaaaacagaattcgagtaagaactgcccagctgagatccataactgccacagcatgagagagaagagtaaactattattatgaggtgggttgttgttacaccatacaaattttaaaaatactctaagttcagccttaagtacctagggttctacagaaggtgcagattagggtcagacccagagttgtctcttacttttggtatctggttaaaatcttggcacagtagagaatttatgtgcacctaggagtgaagaatcaagaggcaaaagatttatagaccctaaactaaaataatacctggaagaagaaaggcacattgggtcctggacctcatactccaggttagtgcacataactaaaaatgaaaaagcaaaaaaaaacccaacactgccaacaacaacaacatactctctgaaaagccaagacagagaagccaagagggtttaggaaggccataatcagaaagcatcaaccacaaaaattataatggaggaatgcctgggtaagagactcaggtggaaaagagaaagatatgatgttttgtgtgcaggtgtaacttgccagctggccgacgaactgcagatttgacttcataaacctctacgacttaatcacagtgcctaatcttcagagagagagagagagagagagagagagagagagagtctgtgtgatgcacgtgcatttgcatgtatgcttatgtagggagtgtgatagaccttatatataaaggatactcattgggcttttcatccttgacacagtatgtttatagtgggtcacttctttcctctgctgcctccctggaagagactgccaccaggtttctggagtgcccttccagaagtcttcttttgaaatattagtgatatccattatcatgtacactgacttctctaagtccaatgaaagactgactgtgcaaaggacttctatagattaggagagaggtagatgctgacttctaggacttgggaactcctaaatatatattatttaacatagaggtaataaaaatcgtacatgtattaatggcacatgtatgccattaaaagtaatggcaaaaaccacaatcacttttgcaccaacctaataaaaggcaataaaatggattttaaataacaaattctcctgtgactcaatattagctccactatacatgatgtcaaataattgttgttacggtacttgaaataagcttttgaggggattggattgttttctaaaacctctttctcagatatgcaacaatgatgtgacattgattttagatacttaacaggataaactcagtgaaaagactagacacgagtgaagcaacctgaatacctcacattcaccgaagaagctctatggagggtattgtattaaattatgagaggtggcagcagtgctcaaattgccatatggcacagctccaaaatcaacttgtaagctttttggtaacttgaaataagttttcccactgaaagaacattataaaggatgctagctttactgggaagacttcagaaacagattccacacatcacagagccacagagtggtattaacaagccgaaaagaaggaggagaaaaaaaggagggagaaaaagaaaaggaaggttggggattattttccttctggctccttcactataaatttcaaaagcctgagtcaatggagttggattaaattctttaataaagatactgtggaaaattatttctttaggcaccagacttttacatggttccatgcttgtcaaatgaccaacttaatttactagaatacaatctctgcattcctgacaccatattcaatcagacaaacatttattgagcagtatctgaatgtctgacacagtgataagctctatagagcaatagttctgacgtttttggatttcatagtttttaaaagtgggggcactacccgaaagttgacaatagttttttatttgccaagaaagtacacataaaaaaactgccatatattctcataattattcttcactctagcctgatagaaactttatccagactctcaagttgggagccactgtactgtgaagtacctaaaattaatacaaaacatattcccacctgcctagtctccttatcctgacatgccagctcaattcttattcaaacaatgtctaaaactgttatttctgtcaagacaattccaaattacttttacaaaatattttcgactaattgattactacttaacaaatcaatccttcttatttctagacatcatctgtttgggatctataatcaccatcaatgtgttttcacacatttttaaaggaattttcttaatctagtacagaagtttccaaacaaatttttttttaactatagaatcctttcttcaaatgaaatcttattcagaaagaccaatatgtaaaatagatcaaagtgagctgttctgattgaagcagccagcttggcttcccttgcccctcttccacatgccacagaagccctcagggcactttcacacaacctccagggatccacagagcattcctgaatagcaactgatgtaacagaatcatcgacttgtagaatttctaagtcaggagatgttagggactatcacaagttatacaataagcccatgatcaagaagaaccttggagctcaactggtttatgcctttcaactcccagataagaaaactaaggcccagaaagtgtgcaaaatatgctcccaatcttctgcgcctgtgttacattcagtgctacttaatggcagacataactacaaatcaagatttatttgcccaagtccagtgcttttcctatattgttgcaagtctttcagaggcattgttccggggaaaagataggaccattcggaaaagaaatttatttaaagcagagaagagaaagcagggggcagaaaggaaaaaaaaagcacaagtacagctgaattattgttagtttcaagtctgaaggaaactaggaatgaaatcattgtttacaagaggcttacaatctagtcaggaaaaaaaggatgatgcacaaaaggatgtttacaacttctgtgatgctctaagaagatctactccaagcaatgacaagtatttatcaaaattttgataattgatacattgaaagttactctgagatatgagaaaaacttgccacaccacacagttgaaaattaaaatttatagcaaaatttgacaatcaagttcataaaagctgccctatggcaaaactttcatacattttgggaaggagcacttactatttcacaagtcacagcactcagataggctaaacctagaccgatcaatcagattgaatattacagtgtgagcaccagcaacatgaccaatgaacatagataaatgggtcctgggagcagacagtgtaggcagatttatacactaatattttattgtccaccatgaacttaccgtcagtgcccaacaaattaaattctctcttcccttccctccattttttttttgttccctctcgtatttcaatttgtttcatatgacaaacccaagcctgtaaaattcatctatcagcaagtggttctaaattagaaagtaccacaactgagaaagaagcagactttctaatagtgccaatttatttatttttctattgttgaaaaccactatagtcatattaaaggaacttattcaaaaaaattctcatttctataactgttttccatttgtccagattcccaatctgtttatattcttatatatttttaaaatagttcaaatcatgctgtgccacataattttgcattcttgttgattgttgccctctgtaagaatttgtgtgatgttgctacttagtctgtttgacagagacccttaaacaaagccaatgtatatggagatatttaagtacaagtccttgaataacgccatttcagtcaacatcatttcatcataacattgatgagaaaaaaaatcgattcctagctagggccactgtctgtgtggagatggcacattctccccgtcagtgggttttctcaggctactctggtttccttcgaaacaccatagatgtgcatgttagctgcgttggtgtgtttcaatcgtgtggtgtgttctaatcccagtgtgagtgcgtgtcagtgtatgtgtgagtgtgccctacaatgggatggcatcctgtccatggatagttgctctcttgagtgtgaagctgctggaatgggctctggccacctgtgacccccaaatggaaaaagtggattgaaaaatgaataagttaatgaatatgaattattataaaattaaaatttgtaaagtatatatgataatcacacaaatgcatgacaataaatgatgtggtaagaaagcattagtgatcctgccatatttgtgattatttgcttttggactgcatggtggtagggagagctccttaaaatttctgctttgcaaacatttattccttgatttaattcactacaacaactgctgtcactcactgattcacaaaaaattgggtaattatctcactcatttttattagtttttgttaaccatatagatatatagatatatagatagatagatagatagatagatagatagatagatagatatagagagagagagagttagagagttcacatttatttcagtgtttactattagaggtgttttgggtctttatttagaagttcaatgatttttgagatggagtctcgctgtgttgcccaggctggagtacagtggcacaatctcggctcactgcaagctccgcctcccgagttcatgccattcttctcctgcctcagcctcctgagtagctgggactacaggcgcctgccaccacacccggctaatttttcgtatttttagtagaaacggggtttcaccatgttagccaggatggtctcgatctcctgaccttgtgatccgcccgccttggcctcccagttgatgatgtttttgtaactagaaatatgccagaggaacttaatccttgattataccaattggtctgtggtaaaattggttttgttatatgtcctaagttgcagtttccaggaacctaacaacattaagtgaggatttattgcatatgaaaactagtcatcttggttgggaccgagtttgtcttatttgaacaccactatgtaccaacactaaggaaatgcaaacattgctggttgaatatttttttaactagccatttgaaaaaagagtgaatttgaacccacttaatacataatttaacccaaaggtgacatgctttctttttaagaacaatgaaataatcaaactagccttcagtatgagaattataatttgtacgatatctgtcttggaacatcttgaattggccccttattaatctagcttttcttgatacagtggtttgtattaaaaatgaagtatcgacctaatcctatataataacaattaatcatttcccatgataagtttttgatctttgtttttcttatatactttaaaataccaggcaagataaattatattatttaaatttaatgtatatttaaatagacagtagcctgttagttcattaaaaggtagagatttttatccgattcatttttttctctcacagcttaaagcacagtattgtacaaatagtatatgctcaataaaagttaattgaattgcattgatcttagtttcaaaataatcaattactagaagacgtaccttcttgataaatgtaagccagtttgtcacataggttctgacacttatgagtcatttagtgtatttatcaattaactgcgttgatggtaaggagtgtgatatattagttgatgacatatcaactaatagttgataaatagtgtgataagtagttttttttccccagagtttgaaacattctctggcttatagtggatactcaacaaaggcacctgaacaaattaatggagttcaagagaaagcaaaattgggctgggttttgaagacaggtaagagagctgatgtagcagaatgagaaagagacaccaaaatagggtgatggtttgaaatggaggtatgggtagagatagaaatgttggagaatgcggcagggatctctgttttggtagcaggtatgtatataagaggagttccttccagaaatgggtttgtgtttttatcgatatgatttttaaaaccatcaaccagcccagtaataatgaacagtaatgaacatgggaggctttttcttagacatatgcagcgaggctgcctttgttacgcaagaagaggggaaatgtccctgatacccataattaggcagtacatctgaaagtggcaggatacagttgtttccttcccttggaaaaagggaaataattaactagctttcccagtaacacatgactctcaactggataaactttctacttcctgcacgatgtgactggctgaggtcataccaatccagtggtcctcagccaaataatcatgtcaggcattttccatagtgttatgtgcccaccatggacactttagaagttaagaccatgtgtagctgttttaaccttagccaatttggttatcatgtttcttaactgctctggtgaggatatcatatgtgattcccaacttctctgagatgatttcagaacaaatgagacaggattaaaaaacttttctcagggcctcattttattctttccctttccccttctcttgccagtctttttccctctacttttcttccccacagtttctatctaattctccacatatcctaagacacttggtattcggtgttccaaattgatatacttattttttaagtgagaagttcaatcttttctttttaagtttaaagaatatggctggtcccaaagtcttgtggggctgtaggcttgcttgagtgtgttgtgttggtggtgatttcagtctgagattcatttcagccgatgagggaagtaaaaatggcaatgaatttatttttaatatataatcttttattttgattgcagctttgacagaactgcatttttcaaatctttcctttatagggccaccaagacagagcagaggagaaacagcttcataagaaagcatccaaaaatgcatagatggccttatcattttgagatagtcaacctggcccagtattccttctttgtctggtttctattaaagccattaatggattcagagcactgcactttctgtctatcttcctaaagatgtaaaccccagtagcatcagaatcatatgaataggcctgtatgtactgataagcaattatcactggggtaaaaggaagaatgataaggtctaggcctatcacagggcaaagacattaagatttatttccagtgtcaccaggagagctttgctacccatgcaaagctccttccggaagaaaaaaagaaaaaagatggaaaaaagcataaggggagataacatttcttgcaaacatttatcagtcaaaacaagaaactctgaatgtgaaattgaaacacaatcacaaagtcaattttaaatggggaaaagagccacagaaaacatgggccttctgaggattaaaaagaagaaatccttacctaagattaaaaaaatccttaccagagatcaaaatagtggggctatcagagggaggaatagtggagattgcctttacaagtgatttgggattgaaataatttatacagcttgtattcagccactgagagcaagatggaaaatttatataactgtataaaatgccttgcattagacaagaactataaaaaatagaacagaagctcaactccagggacacagaatttttttattaggaaatctaggttggccatggaatgtaattttaatcatgaactcaatgatgatgcatattaattccaaaccaacccttttaaccatggtatattttgccccagtaggactacaataatctctcaaggatagatgaaaactcttttagggaacacttctcactacatgttctttcttaaggcctcctctcagaggagttatctagcagatcatggcatgctaaaatgatgtatcatacatcaacctcagtgttgccatgtctcagaaatgctttcccctaaaactaaacagcaatacctaacaaatgtttatggttgaacaagtgtagagagcagctaatccacatatactgagctagtctaattcattttatctattcatgtaacaattatttattgaatacctagtatgtgttaggcaccagactaagtactagggatgcttccaatctggacccttgtgactagcaatggggcaatcttgtgtttcactagtctgttagtttgcttttaagctgtttcataaagctagtaactcctctttaaaacaaaatcacttacgtagcatagaatagcagacttgtacagatagaaacaaactcagagacagtcatctagcccaactccttaatataagaaacaaagtaagttctatagtctcttgttgacagcctcatcgtccacgttaggaagtggcgccaaacccaggaaatagtgttatgtaaaataacagacaccctggagagtcatttatagaagaatagaaaacaattgcatggtagaagaggagggcaggaaagacaaaaagcgctacgcatgatgaaaactgagtaacagtccagtaccaagtaaaggcttactagcagaaaagttactagattactactccaaaaatgaacagtaaatctgactgtgaaaatgtccttttaattatattttatccactaaaataacctcacttatctttatttctgaaatattaaaatggctctattgataattaagataaaatggctatggggaaccctctgttagtcaccagatgccctgacaaataaaacaaaacattggagaaaatataatgggattctatcagttttacagataattccatcaaactgactctcataccttggagctgcagaaacatcagtggtttcctaaatgttatcattttttattttcataacaatcatctgacggttggatggcaaacacaccaatttttatgctacagtgagaacatgtaagtgacctggtgtgaaagtcacaaaagaaatcaagattatggactacatttttctggctcctggcttggttttctttccattttaccacggtgtcactcaaacaagcctaatgttcaaaaagttcagcaggtgagttcttcctctgctcatgacaacattcatgtggcatcttccgccgagcttagatggtgaagatgaccagcgcatgtttactgaatgaccactttttgttgaaatcaggggcttttgttatatgtcctaatggaggctcccgtcttacatcgtttgtcatcagaatctccttcactctcaggagaggtctgcaaaggtgagtgggctttctatgaaaagtgatgaagtagggagaaactcaaagattatgttgctgagttgcaaactactggaaaatattaaagtctaatatgattctcttatgatgtttctcagccttctggtatttattcctctatatcatcataacttgtgtgttaaaaatatacatctatttacctatgttatacatataatatagatgatatctataaaatatgtaaatacaaccagaaaggtacagctgtatccttcttaaatcagtgaacatatccatttaatataactccactcttgcaacttctattcaccattgcactgaagattctactcaagacagttatggaaggaaaaaaaggaaaagactcagattgtaaaggaagaattaaaaatctctctttgttgatgacatctaaaataatccactaaaaactattagaatagatgagttttagcaagatttcagaatacaagatcaatataaatacataaatactgaatgtatttgacaatctgaaaatgaaatttaaaaaattgaatttccaatagcatcaagaagaataagatacttagaactaagtttaagaaaacaaatgcaaaactaaaacattgttgaaagacattaaaggcctaagcatatggaaatataccacatatgttcaccgattgaaaggtttaatactgttaagatgacagtgcccaccaaagtgatttgcagatttaatgtaatacatatcaaaatcatgactgctttttgtttgcagaaatagaaaagctgatttaaatttcataaagaaattataaggaacccaaggtgccaaaacaatctcaagaaagaatatatttggattattcacacttaccgatttcaaaatttactataaagcaacagtaatcaaaacagtgtggtgctgacattaggacagacatatagactaatggaatagaattgagagtctagaaataaatttgttgtttttttgacagataattcaaagggaaaagttttttttttttccaacatatggtgctgagacaaatggatatccatatgcaaaagaataaagttgaacccctaacttcatatgatacacacaaaaaagttaactcaaaatgagtcatagacaaactatgaggctcttagaagaacacacaggaatacatcttcatgatcctgggttagctaagatcttcttacagtatcaaaagcacaagtgataaaaaaaaaaagataaaatgggctctatcaaaatgaaaactagtgctgcaaataataccattaagaaaatgaatagacaacccacagaatgcaataaaacatttgtaaattataaatatataataaaaacttgtaagaagactatatatagaacttttatgactcaataaaataacccaattaaaaatagacaaaagatctgaatagatatgtctcccaagaagattttaaaatgaccactaaacacatgaaaaaaatattcaacatcattagccatcagggaaagacaaatcgaagccacaatgaaatactacttcacatctgctagatggttacaataaaaaaggcagatagcaacaagtgttgacaatgatgtggagatatgggaactctcatatattcctggtggaaatgtaaaatggtgcagcctgtttgaacaacagtttggcagtttctcaaaaagttactatggtaacataggtgtaccacataacccagcacttctactcctgggtacatactcaagagaagtaacaataaatatctatacaaaaacttgcatgtgaacattcatagcaccatttttcataatagccaaaaagtagaaacttccaaatgtccataaactgatgaacggataaataaaatgtgttatccgtatctatgcaaagaagtatcctttgacaataaaagggaatgaagtactgattaacatgctacaatcgggatgaatcttgatatcattacgcaaagtgaaaaaggtcattcacaaaagatcacgtattacatgattccagttacataaaatgtccatagaggaagcagaaagtgtacatcattgtgaatattctaaaaaccactgaattgtatacctaacatgtgtatcttaaaattttagcattaaattttctttttaattacaaaatttaagtataactgatttgtatggagatagtttgagttgtaacagcattgagtcagcatgactctgccctaacatagtttgtaacctagacacctggacactgagacctcactcctctgggcccctttcctcacccatatgataccacttgattgtttttcaagcattataatccctcctttttgctctgaataaaatcttacatggaaactcaatgtataaagcagagaaaagccctatttttctgattcaaacagggatggagtttctagatcccacccagtcaggtttatttcttgagttgctccctgcaatatcctcaaatagccacagagcaccatgggctcaacagcattccctagaaatactgttttaaaatcaatcaaggctggacacagtggctggcttacgcctataatctcagcactttgggaggcagagatgggaggattgcttgaggccaggagttcaagaacagcctggagaatattgtgagaccctgccactccaaaaagaaattaaaaaattagcaggcctggtggcatgtgcctgtcgtcccagctactggggaggccgaggtggaaggatgatctcttgaacccaagagttcgaggctgcagtgagccatgctcaggccactgcactccagcctgggtgacagactctgtctctaaaataaaataaatccaaatgggtccaaaggtaccttccaatcttaacattatccacagcttatccccttgtggtttagtagtcaattaggtacaataacatatggaacaaaaaagaggtgggtgaaattgagtgacattacgtcagtcaactggtctagggaaaggggatgtgagtagagaagggttcaagagaatgagaaagtcaaatgtaagaggccaggtcaaattgatttttaaatcagcagtaaggaacgaaggctgaatttctgtgacacgacacaaaaaattgctggcaccagaatttttcgtagggagggaaataacatttgtttggaaaaattccttcacaggttgttttaggaggtgagacaggcctggatatttggagaaaaggaatcaaatactgtgtacatcattctgcattaggaaatagcaagaatagagagtacaggggtgcaggggaaagagtcagaatgcctgacttaggaacatggaagagtagctgagtaacttttaaggacagtaagcaatttgaatttatgtgatataaacccctcttcattgtccccaaatctggacttcagtttgctgcacactcaaatacatggtactttagcagtagaaggtcaggcagatgggtgaagttatttgggccacttttctattccatttaattaaaagtgatggaattgtatttgatatatatattagttagaagcttcatgaccatagggattgctgagctctgtgcattttcatcttactgcagagtttaaataccctaaagtgtggtcacaaactgtgagaaagcctcaggctaagcatttctaatgttattcctggcaagagaagtggcctgatgagggagatgcctcctgtggtggacagtcaagaagacacaggcagggcatgaactcagatccacatgtatgccaacaactgccctgcatgtcaaagggaatgttggtctcagctgttaaccccaagcctctgaaggacagtcacattgtgtgggtcactcttataaccacagcattaatgaatttatttcttcatctagggtgcagtggaacttggtgattatgttcttctgccagctttgtgtcagtacaatcccacctttattttccccagaagagttggtttaggacttcataaaaggaaacaagtctcctcttaccactgagcaaaattgccttctctgctttctttttgcccaccacagggtagtggctgggaaaagagtggagggaaagggaaactgagaagcatgtataaggtcacatacatatgagctacacatggggaggatgtgaaggtggagaggagctggtctcatgaggactttatgccttccccacttgcgagagaatggagagtttaaaaagtttctggcttaccttgcttttttgcatgtggccaaaagggttataggttcctcatgatttatcctcaaggataaaaaaaaaaaaaagttaatcaaagttagagtcttctaggttctaaccttctctactgcctttctctactgtctctgctgccaaggtccattcaacggcagtgagaggagtgcaatgctaatcatagttttacaagacgtagcctgactttttgttcctccaacaatccattcaagccaccagctcctccttttctcaccctacttctgattggcaacccctccataccgcctggccaagacactttactccacaagccagtcatccatcatcagttatttcagttggggtttgtagctttctcaagatgatcatttttgctcatagctgccacctccctgggcaactcccacttatagccccaaggagcctactttcttttcttcacttttatgatatctccattcaaaaactgtctatctgaaattgactattaaaagaaacaccaccttctctaaattcctgtttgttctcagtctttggacagcagcagaatcacttgcagcgcttgttaagacagattcctgagctccatcctgattctgattgcggaattacataaagaatgctgcgtgagattttgtttttctaacaacttctccagtaatattgatgttgttggtctagggttagcatgttgagaacgaatgctttacacattttaaacctgtaaaatgttggaatgatgttttagcatagggtacccgagtgtattttctgagcactgggtctctagtaacaatcaggattttagggatgataaaagacattttggcacatagaattccctatttctgccttccacttttggtctttgtatttctttttcttctcctttatatatgtattttaaattcttcactcttattcaccttttcctcctgctccaagcctgacttagaagggtcttatgatccagacgattgtaacatgtaataggaatagtgtgagaaagaagccccaaggtaaaaggaatctgcttatctgctgtactcagggaaaaatctcgttgatgttaaactagtgtggtctctccttcctctagcatagttattcaggaatcaatcaatcaaaattatccaaatatcctgcaaacatttggcttaaaacttttatcagtattttcaacaactgtcaaatactcttgtacagaggaatgtggcaaagacggggagtgaatgagaagaagctgatagtaagtagctctacttttagtttcttattgtctacaatggctcttcattttgaagctggagctttgctttatggttggttcctggcttgctaataagaagcagatgtttcccacaaagatatttctgattctttttttctatacccctactttcaacttggagttggaaatcagtaagttcaagggaatttattacctttatcctcttagcacatgaaattggaagatgatagggttttaactagttgtcagattgttaggtgaaaggatatttctggctaaagaatggggctttcattgccgttattttcttttcaattctttctgcagttcctagaaagaaatcaaactagttacattgctaaggtgaagaagtacatgctctggtatttttgcagtgaagttcttcaggccctgatacctctcaagcccagatgtcaatcatttccagcaagtgcagcctttttttgccaccactgtgtaggacgtggttaccactcagaaattatggcaagttaatctgcaggccttattcaataattcttagaaacacatgaacacagttggtgcgctcgagcatttggaaaattaaattattctttagaattagcctactgagctggaagaaaataaagaacacttaccaaaggggaaaaaatgacaaaaaattctaatgactaatggtttttcattataattgcataatagtctcttgatacaagtgctactcattgttctgataattcactgatccattaggcccctccatacatatgcaagcacctagattagaaaacagaagaataagaatatgtaattgcactcaagtgccttaaattagatcaattcaatggcactcttaaccatcctactattagcagatgctgagaatatgagaaatgataagcaacttccaactgatacactagataaattttacttttttatccaggataagacaattaacaaaggtaacatttagttcatagtaacattttaaaaatttctgacgattatgcatagtgtgctataaacattcatctactagtttttatgtagacaagtttttatttcccttggacatattcctagaagttgagttgttgagccacaaattatattttgtgactgtctgaccttgaagggcccacagaagataattctgtgttggtggttataagaatctaggtatatgttagtcctcatagaactgtacaccaaaaaagtgactactacctcatgcaaattcaatatttttaataatttagaaaactctccaaataatctgcatagatttataaattccatcaaattattacatgaatcattaacatacctctagtgcttcaaaaactaaagtttgtacaaaaaatgtggtgataaaaaacaaaatagttcctgaagtgaataatttttagtgggtagagttatatatcacatatagcaaagttgtgtctcaaattgaatgtcaagagaactggaaattctttgatccaaaaggcaaccaaatcgtccacgctactcagtccttattcaagatcctttaacaaaatggaaatatattagtgggaagtaattcttggataggagctgggataacaagttcctcttattaaacctactgatttcattctcctattctcccaaggtttagcaaaagcaggccttacattacaaatttcttgtagtattgagaaaaggttccacttctgtacatggagcttacaaattttttatcccatggagaattgttaaagattataaaaatgcatagaacacacacagggcaataatgtattgaggagttttaaattgtaatttttactgtcaagcccgtaagtaaatcatcaatgcaagaattctgaggttcaacgtttaaataagaaaattagtactcttccttctatgtttaaattccgtgtttgacattgtctggaaaaatgtcaataaatattacttgtgatattttcaattttcaaagcaattattacattaggaacacaggttttggaaagaatcacaactaatgtccctgaaagggtaatgatgccaaggatagttgtttttaataaaaagttagaatgtacatcgtgacaaactaacaatcacaattagagctatctttgtcccttttctaccctcaaaacaacctgagactcaggtgataatcccagtttaccttaatgttaataatttttagttattaatttgttcattttacaaatatatattggatataactatgcaccctgaactgtgctgaatgtttcagatgcaatggagagcaaagcacttgaactctgatttacaagaggagaccaaataatcacacaaatatttaatgagaaactgtgctaactaaccgttatgaaggaaaagtaaaagggacaaaaaaaaaaaaaaaagatacctcagggatatattaaggaaatgtacctattctgaagtttaatggaggcttccttggagaagtggcatttgatcctgattttgtgaccaatgacctgcatttcctgattccaatttcttttccctcctcattccagctaatatccaagaataatctcagggtaattgctttaggttccaaatgggacctaaaattacattaaaagctggcagtagatacaatggcagtggcctatgtgggactctgagcataggcttggcattatgtccagggtttccgttgcagatcccaccacttccaaatacttaggtcaggctatctgaggtacaacatgagctacaaacccttttatcttctaggatatttttatcccctgaaagtctgacttctgaaatgaatttaatattatcaagaaataggaaggagaactgtatctgacaaatatgacatttcaaatcagagtcggaagttcttatagtaaaagacaaatttcccacagaaataataaaaacccctaagagactactatgaacacctctatgcacacaagctagaaaatctagaagaaatggataaatctctggaaatatacaacctcccaagactgaaccaggaagacactgaatctccaaacatatcaatgagttcccaaattaaaccagtaaaaaaaaaaaaaaaaaagcctaccaacccacaaaaagcccaggaccaggcagactcacagctgaattctaccacatgtataaagaagagctggtatcaatcctacggaaaatagtccaaaaaattgaggaggaaggacttctcctcgactcattctatcaaatcaggaacctaataccaaaacttagcagagacaacaacaacaaaacaacaacttcaggccaatatccttgatgaacatagatggaaaaatcctcaacaaaatactagcaaaccaaaacctgcagcatataaaacagctaattcaccacgatcaagtaggcttcatccctaggatgcaaggttggttcaacatacatacatcaataaatgtgattcaccacataaacagagctaaaaacaaaaaccacctgatcatttcaatagatgcagaaaaggcttttgataaaagccaacatcccttcatgttaaaaactctcaataaactaggcattgaaggaacacacttcaaaataataagagccatctatgacaaacccacagccaacatcatactgaacaggcaaaagctggaaacattctccttgagaactagaataccacaaggatgccctttcactactcctatgcaacatagtactggaagccctagccagagcaattaggcaagagaaagcgataacaggcatgcaaataggaagagaggaaatcaaagtatctctgtttgcagacattatgaccgtattcctagaaaatcccatagtgtctgcccaaaagccccttggtcagataaacaaattcagcaaaatttcaggatacaaaaataaatgtacataaatcagatcataaatcaatatctataaatcagtagtacttctatatatcggcaacatccaagctgagagccaaatcaagaacacagtcccttaagccacaaacagagtaaaatacctaggaatacagctaatcagggaggttgaaagatctctacaaatgagaatttcaaaacactgcttaaagaaatcagagatgacacaaattggaaaacattccatgctcatggataggaagaatcaatactgtaataatggccatgctgcccaaagcagtatgattcaatgctattcctatcaaactaccaatgacattcttctcagaattggaaaaaactattttaaaattcatatggaaacaaaaaacagctcaaatagccaaggcaatcctaagcataaagaagaaagctggaggcatcacacgacctgacttcaagctatattacaaatccatagagtaaccaaaacagcatggtattggaacagaaacagacccatagaccaatgaaacagaatagagcgcctgaaaataatgccatatgcctacaatcatctgacctttgacaaagtcaacaaaagcaagcaatggggaaagggatacctagtcaataaatggtgctgggctgactggctagccatatgcagaaaattgaaactggaccccttccttacaccatatcccaaaactaactcaagatcaattaaagacttaactgtagaacctaaaactataaaagtcccagaggaaaacctagaaaataccattctggacatagaccctggcaaagatttcatgatgaagatgccaaaagcaattccaacaacaacaaaaattgacaaatgggacctaattaaactgaagcacttctgcacagccgatacagaatgaaatatattctcccattatagaatcagagaaaatatttgcaaactatgcatccaacaaaggtctaatatctagactctaagaaacttaaaataacaagcaaaaaaccaaactattaaaaagtagacaaaggacatgaacagatacttttcagaagacatacatgcagctaataagcatatgaaaaaaatcctcagcatcgctaatcactggggaaatgcaaatacaaaccacaatgagttaccatctcacatcagtcagaatggctattaccaaaaagtcaaaaaaaatcacagatgaaggcaaggttgaagagaaaagggggcacttatacattgctggggggaatgtaaattagttcagctattagaacagtgtggtgatttctcaaggagcttaaaacagaattaccatttgacccagcaacccattattgggtatatacgcaaagaaatacaaattactatatacagatacatgcacacatattcattgcagcactattcacaagatgaggaatcatacactatgggatactatgtagccataaaatagaataagatcatgtcctttgcagcaacatgagtggagctgggggccatcatcctaaatgaacacaggaacagaaaaccaaatactgcatgttctcacttatacatgggagccaaacattgagtacacatgggcactaagaagggaaaaacagacactgaggcctacttgacagatgaagatgggaggaggggcactgaaaatctacctattgggtactatgcttttacctgaatgatgaaataaactgctctccaaacccgtgacatgcagtttgctaatataacaaagctacacatatactgctgaacctaaaacttaaaaaaaaaaatcagtttccaactatggcacctaggggaatatatgtttttttttttccattccttagtaatggattagcaaacacataataaaagctcaccacaactagtgagtgctgggtagggaaccatggaaagaaacaaaggaagattagaaccctaatctggtcttttatgtgactctgggggaatactaaactcaccaatgaaacaaactgaaggcagtgacaaagaatattgtaataatataatcaggtatatttaatctatgagtatttgctcatatttgctatgagtaaaatagcaaataaagtggtcagatgcatcagaattgagcagggcttatctttaagtggtagggtcatggcctattcctaatttattctttttgcttatctatactttctgaatactgactctaccattctattttttcattagggatgcaaaagcaatattttttctaaaaataatgtatatatatgtgtgtatatattatattgcttatcaaattcaggatttaagcctcagttttttcaccaatttaaccaacttgctgagtaacctttggcaaattccccttgcctcctggactcaagttcttcctacttgtcaaatgaggagatgggccaggtctgtttcccaaacttagccaatcttcagaatcctttcagccaactgttaaaaataaaatcccaagagcacctgaaatcagccaaatgagacattccagagagaagcccgggaagatgtgttgtacaagtgcccccaagtgattcatagaaatagccaagcctcagaaacactacactagatgatgcttatggtcacttccagtctgaatgagccatctctgcgttaacatttagcacacagcatgcaatccctctctaagtgggaaaatgactcttgttggaactgggcaggagcactgagagcacagcctttccttttatctggtttcagtgttagggtcatgctgggcttatacaataaactagaaagtgttatttgggaagctgaggagggcagaccacttgaggtcaggagtttgtgaccagcctaaccaatacggtgaaacctcgactctactaacaatacaaaaactagccaggtgtggtggcaggcacctgtcatcccagctactcaggaggctgagacatgcgaatcactttaacctgggtggtggaggttgctgtgagccgagatcgcactactgcactccagcctggccaacagagtgagactctgtcttataaaaacaaaacaaaacaaaacaaaacaaaacaaaacaaaacaaacaaaacaagaaagtgttacctctgcttctatttttgaggagactgtggaaaattagcatcaatctttggtagtattcaccagtggaaccatctgggcctggtgcattatttttttgaaaggtaattattgattcaacatcttaaacagaggtaagcctattcagattgtatcaatttctccctgttttggtagtttgtgtcttttgaggatttagtccactttatctaaggtaacaaaattgcaggaatagttgcttgtagcatttctttatcatttaaacctccttggaatctatagtaatgacccctctctctcatttctgatattggtaatttgtggcttttccttattattatttttggctagcctggctaaagatttatcagttgtattgatcatttcaaagaaccagcttttggtttcatttcttttctttgttttctttctttccattgcattgatttttgctcaatttttttttattatttcttttcttctgttgctttaggcttaacttgctcttttttaatttcctatggtggaagcttaaattatttagatgtttttttctaatatatgcacttgatgctacaaaatatttctaaggactgatttttctgtatcatacattttaataagtagtattttcgttttcatttaaaggtattcttcagagttctttgacccatgtgttatgtacaagtgtcttttaatttctaaatatttgacattttctagctgtctttctgttattgatttctactttaatcccattgtagtctaagtacattgtataattcttattaaagtttttgaggtgtcttatggcccacagtgtggtctattttggtgaatgctccacgtgagtatcagaagaatgtatattttcctgttgctggatgccatattctataaatgtcaattagattaagttgattggtagagctgtttgggtcaactgtatcattattgattgtctgcctgcttgatttaccaattattgaaagagagctgttaaagtttccaacaataatagtgaattggtccatttctccttggaattttatcagttttgcctcttattttgatgctttgtggttaggtacacatacatcttggattgttatgtactcttggagaactgacctatttatataatgctctttatcccagataattttccttgttctgaagtcagtttcgtttaatacactacttctgtttcttttgattagtaggagcacagtaaaattttttccatctttgtttttaagccgaatcttgatctttaaagtgggttttcttgcagatgacatggagttgtgttttgtttttgtatttttaattcactttaaaatgttccataattactgcatttaaccataaatatttaaagtaatattgataaaactggattaatatctaccatatttgaattgttttatatttgttacatttgttcttggttcttttctgccctctctagatttagttgaatatttatatgattcaattttagctcctcttttggaatatcagttataccttattaaattttattaaaaattaaattttgcaatatacataattcactaataaagtccaatttcaaataccactatattgcttgatatgtggtgcaggtattttaacagaatatccttgaaatttctccctcctattcttcgtgacattgctatcattcatttcactcgtcctatcttctataatcactcaatacatcattgctactattaaacagttcttttatatcaattaagattagaagtaagaaaaataaaattttatccttccttattccttctgttacactcttcttaatataggtatgagtttctgacctatataatttccttttccctgaaggatttattttaacatctgcagagtggtcttctggtcatgaaatccctcagcttttgctggtctgaaaaactaattctcttttgaggttgagtttcactggatattctatatttgtggactttttccctttcaacagtttaaatattttttatttcattctgttcttgcttgcataactctcttctttttctctctccttccttcctttccttcattttgatatttatcctgctggtgtttgctgaacttcttggattctgtggtttagtatctgtcattaattttgggaaattttcgtcattattacttacatttcttctgttttctcttctcctttctcttttaattatgtttatgatataccttttgaaattgtcctacaactctggatgttctctgctgattttttgttttgttttgtttttcagtttgggaggcttctattgtgacttatcttaaaagctcattgtttcttttctcagctgtgtctgttctactaatgaactcctcaaagacatttttcattctattttttatttctagcattttgattctttctcagagttttccatatctctgattatattaatcatgtgttattgtgtattttctacattttcaattagagcctttaacatattaatcagctattttaaattccttatctgataatttgaaaatctgtgtcacagaatcagtctgattctgatgtttgcattttgtcttcagacttttttcttgttttactataccttgtaattttttgttcaaagttggacatgatgtttcaggtaataggagctgaggtaaatgtaccttaacccataaaagtttaatgtttatctggctagaagttgaactgtgtttaatggttgctgtatttgggtaccctaatagaggaattagaggcttcaaattcctgtaatatccttgtttttgtcacttcattaagtagaatctatgcctggcagttctttcatctgtaacccactgttactatattggaaacttgttggtatggtggtaaggtgtagagagggaaaatgttctatactcttatgaaccaatctcagtctttcagtgggcttgcgttttgtggttatgaccttacaagttttcttagcttctccgcagcccagttgaaacaggaaagctagaggatgctgaagtcagagaaatatatctttctcctggcaggacaaagccttttcctctggatttgtcatttgttaagaagtctcttggcatatttcacaatggtaactcttcttcttctcccctgccaaagccaagaagagatctttcctgggtttctaacatgagaacctggtgactttcctagagataaaacttaccaaagtatggggccccctaagattatgccacacaggaattttttcctttagctagtccatactcagcctccaacaatccatcaaatctaccactgaagtttttctacccatttatggttccagtagcatctgtccagggaagcgaatttcatttttgcgtctctggattcacctttctgtttagattctgggatagcagtttgctttgtattctcaattctatgaggagtccaagaaatgtcaccaatttttcagtttgctcagatttttctagttttaagaacaggagtgaccacttccaagctctttacctgtgggaactgcaactggaaatggccctttctgagaaataaccatgcatttctggtgatacctttaagcaaatcagcatgatttttaaataagtactttcagggctgcttcctacagttgtgaaggttgtgctctacaaggacaaccaggctaagaggcaaaaagagggtggcatctagtttgtgcaaaggtgcccggaggatgggtggagggtgggtaacagctgaccctgctttgcaaggttgcacaagggaggttgaagcctgagctcatcaattccaaccatcttatgaaacaatccagtggctcttcttagctcagtttgtggggaacattcagaactgctccaaggattccttcatcttgttcaggctttgatggaacagggccagtagcagagagctctttcagatcttcagattttgcatttatctccagcctcactctttgagaaggccaaagcctccttttgtaatacctttcctttatcatgcctccaactgccttatgcttgcctagctgcctggttagacagcttacatttgtaaccaacaagtgagttccaatgttccaaagtcattgcatcttcatggatatcctcattcattgttctggggagccacatggtgaatgtgaacttgagttctgaagagtaggcttgtgccaggcagccagcttccccgacgtggagccaaatgttgcatctgagcagcatttgagcagtatctccccagccgcgacaatgaaatcaggtccttactagagagtaggggattggtgactgtagactctggtaatgattctggcactgcaccagtagcaggcagccctcatttgttttgctgcctagcacccgggcgagatcattgtttattatggctcaaaggcagtaatcatttcacataatgtgaggatttctttcactcaattactttcatgctttgggctgatgagaataataatcatgtgttgattaccggtatcttgacagatgatgctgagaaacgcaggtcactgcttgctcctacccttttttccccttaaacactcaaggttgtgatttggaatttcattcagtcaccactattacatcccaaagtttctgatgctgagaagaccaagacaaaatatttcttacaggggccctcaattcctgcagtctgccctatgggataatttatgttgatttgttttaaagagacaggcatacataattcatgtcctgtgcatttcggcttttggccattgaaaatactatctcttttggcagcgcttgcaggaactagctacaataaacatttcatacctcagtggacactcttttctcagctaaaagaagcctgacttatatgtagactccatcatgagaggcctgtatttaatgaattcagctgagcattttttccttccaaagcataaaacaagcttattatctgtatcaatagttggtttttctcaaaaggagtcaaggtgtgaatgggcatgaaagggaaattaaattgaaactcttggtggtttcatggttggaggccagtttaaaactcatactctaataactgcttttgaactagctaggagaattgttagatcagaaaagcatacagatttgaagagagacatcagggtaggcttcccatccagaaggcagagagccagacaaacgacacttttgaagatatcggtgccactgctgaggatggctggattcatacctgtgtagattacagggggttaaatatggtctacacatgtagtgccaaagtagtaatttaaaaatgcaaatctcatcaagctgctcttctcctcaaattccttcagtggctttccatttcacagaggatgaagaccaaggaggctgcatgatcatttgggtctccaatgcttcatcctcatccagtctcctgttgcctttacttactgtgttctagctactgaggccttcctttgcttctctacaactgtttgcttttacctaaaactcctgtttatgtttcaggattcatcctaaataatacttctcccaggaacttctgtttattctggtaagtttaaatccctttgttaagtgtactcatgccctttttgttgctaagattttattactcgggtaatttttgatgtttacatacctactagactgtaaactccttaaaggcacctggaggattccactttgcaaatgtatccacctaaggcataatagatattaaatgagtgagtaagttagtgcagtggttctcaaacagtttgaacatcagaatcacctggatggcttgataaggcacaggttgctgggcccctagagtttcttctgcataaagctgggaccaaataatctgcatttctaaggcgttctgggatggtgctgtagtcacactttgagaaccacataataatgtaaagtcttttcattactgcactactgcattcttaccatggggaccccaagttataaagcttgcattttggatccatctctgcaactaaatgcctggaaaaccttaagcaagttcttatattttcaagtcagtcaatacatcttactgtttcttatttttttgaggtatcccctccgttccttccctctgccctgtttctagatggaagcattgtaacctcacatttgaactactgtaaccacatccttattctcttggctaccattctctgctccttgaactatttattttttattgccagttataagtgcctcagatgtcattatgactaaactttgcccttgtctaaaaatgttgaagatctcagtattcaaggctttttcacgacctagatctcctgtgtgtgttgctcacctctcctaaatttgcatgcaactcttcatagcttattgtagttatctaatggtccatctttcctgacaggctgccagctgtataggggcaagcaccatgacattctcattcacttaacaaacttgacctgttgttgttgcatcataatacattactaaacagatgaaagtcactgaacactatattttgcctcttgtataacagtaacactgataaccctagaagcacttaaatggatttactctatgccagaattcattcttcaaacaactttacacatatcgatgtatttattcttacactaaagcatccccattttacgggtgaggaaattgaggtatagagaagtaacttgtccaagatctcgcaagtggtggttcaagcatgcatactctggaatttggctgtagttcattatcttacctaccatgactgaggcatagtccaaataatgcctaaaattacctgaagcaataacaatctcttgtgtgccagtttattgaactacacataatcacaaaaaaattattcagcaccttttatttgtagggagctacggcaaatactggggaagcaagcatgggtggaatacagcatgtaaggtgcaagtctgtctaatcctacaggtggaggcagacaacccatgtttcaccactttcttagtaatgtgaccttgggcaagttactcaacctttctgtgttccgtttctttaaaatggggaaaataaaacatattttacaaactttctggcaggattaaatgcgaggtggtatataaagtatttagcacaatgaaacacgtcatgtctgcttagtagataagagctatcattctagccctggccttaaggagcttcccatatattcatcagtagacagcaattggtagtgatgctcttggattaagaatttagctgccataaatttttgcctcaatatgtctaagacgaaatctcatgtgtccaggattggccccaaaagtatataggagtggtgggccatatccaattaaagaggaaatcaaacttaaagaacataaaatgattcataaatggaggttttttcttgaccactcacttatttgttatttattgagcaggtgtcaaactgctaggcaccaagaattcagagaagaaaatagtgtttgtcttttttctctcaaaactgttttcatcactcatgctatatttgaacttctgttattgactctcttgaccggtgttttaagataatgaagctaagtttaggcttatatagaaaacataccaaagagcttatattgaacagaattagaaggcttcaggttggtagacttttaacatagcttttccacaactaggcaggtgcaatgccatcatataaaatctttatttcatcgattctcatctttcactttagcagcttttcaagctgctctacctgtcatagcaacagtgttacatcatgatgagctggtaggatattacggacatctacagtataaaaggtggaagtaggatttaggtttctatagatgctatacttgctcatatacaaatgtatatacacgtaacacccagagaagattataacaatatacataatataatcattgaaattaatgaatggtagattgatgtatccagggggttgtttccaggacccccatagataccaaaaccagaagatgctcaagtactgtataaaaaatggcatagtatttgcatgtaacctatgcatatccttccatgtcactagattacttgtaacattaaaacaatataaatgccatgcaaattgttatattgtatttgtgttttttgtattttttttctttttgaatatttttgatgagcagttggttgaatccatggatgagaatccacagatatggagggctgcctacactcatatagggaaagcatatatataagtatacagacacacacaagcacacatttgtaatcatccaaattttacctcttctgagcctatggaaccaatttaatcttggtacagcaggccccaaggcaaccatcaaacactgcacagacaactgcttattgggtgcttcttagggaggctcacaggaactttcaaaaataggataggcggggctagatgagagtgagtatataaaagaccatctatgcagagaaatttcagcattgcatttttctccctatgaagaaatctgctcaattcatttgttttatggtatttaaatatcaaaaaataaggtccctttaagaagccaagtgataagacaatttttcatctagaacagtgattttcaaactttagtgcatattactatcactagaggctagtataaaatgcgaggtcagatccacaggatcgtttcttgggagtgggatccaggaatctgaattttaacaagcatcccactgttctgctgcgtttgatctgtggccaatatattgacaaacactaaagtgtaaattaaaaacaggcagggtacttctcagagctactcggttaacagaaaggagaacgaagatgcaaggcttgttgatctgtttggcaagagagatagttaagccactttgatattgagaggcaggtggggaaatttaccactctgagtaccagcagcaggagcagctatgaaaggaaccacatttatatccttctaaccgtcaaaaataaaatgaaggagttgatgtcggatataaaaagtgacctgaaatcagcaataactgatacgtttaagaatttattgagatagtcaaaactaataattagtcaaaactaatatgtgaaaattgttagctcttttagaaattaaggataaatatcatagggtgctgatattatataaaataacatgtgggaagttcttagaatagttcctggcatgtacaaattcttcaactgttgtatgtattattaacttgcaattatataactttgaaagcatttgttggttggatcaaggttataggtcagaaaggcacaataattccatagtccctagagaaataggaagattcctactgaaggagaggacaattcaagtgaagagcgtaagaaaatgaatctagaatcccagaaatcagagaaggtgatgtaaggccaccagatatcagaatacacaagtaaagctgatccccaaggagaaggtattctgacttgtaagagcttccatatactgcagacagtaattggctatcactgatcattcaggtaaagccaaaaattatagggaagaatcaaacactgcacagacaagtgcttattaatagaatgtgagaactcaggcaccaatgactcatgttcaacactaacttggaacatgagaaaacacttcttaagtgaggccatttctgagattctgagatagcaaagtataaaaccaactgtatatttactttcatgtcaatatattttatcacaatgtagtttttattaataagttgtgttgactaacaagtcaacaccctaaactaagactcattggtatttatgcaattaactcagaagaagtcttacaaaattcctaaggttactgttgtatcacaaagatgaaattttaaaaggtccagagacacttcactcccttataagctaaatatctggcaatcccaaatgtataaaatggcctggaagtgggaaataataagtgttggctactcaatgctttaagtatctaacagcagatattaagtgtctgctccaggacctggtatcacagcacttgcagtaatgcaccatccctttcagtttgagtgactgagttactcatattctcagaagctaattaatcttatttgaaataaaattctaacatgttgtaaccctactatcaacagcacactacattgtagcttaaggtggtacaattaagggcaaaaagtggcagggagtaatccaatgatgaaggaaatggaaaaacaaaaaaagcagacaaagattcaaaatgagactctgaagtcatttaagtaaatcctgtattcgcttgcataccattgacaaattgctgaactccccaaggccacattgcactttgagacaaaggggtagcaagagatagatgagagagagagatttcctgagaacaaggatttaaatgatatgatcaatcttatactttcccaattctaatattgattctataataattaatggagtcgattaatgaggctttatagtgttagatcaagctttcctcatatccaagcttctccttggctgtaaatgagccttcaaaatgggagaaacactcatcttcctggaggccgagactatataaaggatgtgatttctctgatatattaaaaatttaagtggtgggcttgtgttagctttggagatactcactaaataaaatgggaccatccaccatgtttaaccttgttttgcatatattaagcagtctctttatacccacttcagtagaaaaacaggatggtttttttttttttttacaatttttaaaaaatttaacattgacataattatatttatgggttacaatatgttttgacttatgtttacattgtggaatgattaaatcaatctaattgaatccatcaccttacaaatttctaaaaagctgatggattttgatggcatcagattgctttagtaggaatctaggatctgccacttacttgctgtgtgaccttagctacttctcactcactttcctcatctttaaagtggggacagtctggtgtctgccacacaacattggttttgggatgagattagttgagataattatgatctgctctgtctgtgtcggctaagccgattattgtttgtccagggctgattgggaatacctgggagacctctgccagctccctttcagtgctgtatggcagcaagctgtccagaacacacacttgtctatcaaaggaaaacagatcattacagagagatattagtgattctattcttaaactgttgggtaaaaccacgcttcaccatgatgctccaaatcctccttaaaataccttcaatctggtgtattattgtgacagccaactgtgtgccaggcaggcagtacctattaaaagttgtttggagattagggctcagagaacagctgggtacctttgttactagcagtctgctgactcaaaatgaggggtggggggggaaagcctcactgggatgaagacagcaaagaaaaaccgcagagctggggggaaaataaaaacagctttggcctttgaaaaccgattgctctgctgtcctgtcatgaagtaggtaatatgggcattcacaattccacacaggatctaattcaagtcttaaaaaaaaaatacaacatgataaaaacccaggtccaggtgcaggctgttttctcttggtacttggtttgaggaagcatttgttgctctattatgaaagcgcacacactgcctgccctcgctgcccagcaccccacctcagtctccagggctataggaatgctgatcacagatgggctcccactgccttagcagagggagattcctgtctttgtcaacattacatatgattcacataactaactgctcatgccttatgattccaggcaatcaatggtgaatctagttacagcttaagagaaccaggtgccagaaatatcttccatctctcagtgcctttgggcattctcattcagtactgaaagcagcttgacaaaggaggcaacataaatgtttttagtcccttttacagatgaaaacactgagacccaaaatgttcaaacatcctgcccatcgtcccagaactagttggcgacagaccaggaatcttggaatgaaaacctataacccatgagtgagcatacagtgacatagatcctgccagaaacactccacattttcaccccatgacaatggacactgtgtccctgaaaagttctactttggtttgggtctagtagatggtgccacatcagggaaacactgtacaacagaagggatacaattttaaaataaagttttccatcaggcggctgccttcttttgtctgagaaagatttgtgcctgaaagttttaggagacagcatcccagtcagcttcattctttctctgataatttatccatatgaaatccttgcggctctcaaatcagatgagaaatgttctagaatactagaaaacatggtgtagacagaagccagtactgttgcagctaatacaaagcctgaaaccctctgcatttgctgctatgatccctttacttacgttgttagttgcgtatgtgaattgtgccttccattccctttgcaaatgttcagtgggcttgcacagtgtgttacactaaataggtgtgcatgaattttaccaaatctcattgaattcctatggcttgtcttcagaactatacatgttacattccagagtcaaaagaagctcagtgatgggggtggggcaagagtcagtaccctccgaaatgggagcatgttggagacactgtggcaatgctagggagggggatctcttattagcagtcatcaaaggttcttgcccacttgcactggcctgctgttctgccctactgaaacctgtgcaggagagaaccatcaacagctttagttggtgggaaggggaggcagagcactaggagaataaactgccacggtatagttgtaaaaggctactggaaagtaaacacaccaaaatgtcaattaggtaatttcatcatggactgatgctttctctcctagtttttttatattttgaggatggattacttttataatggcaaaaaaaaaattacttcaaaattttttgcagtgtttctattctgccccaatttaataccatccttacaaagctcacatcatgtgtgaaacttattgaaaagtataaccaggataatctgctaaattcgttaggaagacagaagatgtagctgacttcagtgagagtttgaagtgaatgcaacccaagtcatgtatagttcacttgaaggacatttgttcagtcaacaaggatttcccatcccccacacccaagtccagccctttccagtgggcccttgtgcgttttattcttgtaaacacacttcaatatcaccttctctaagaaggggctgttcatttgtatgagcttctgtaggtctcccttctaagagatgccttagcgaagcttcatgtgctctggaggtctcgggccctcctccctgtctaggaggctcctccaaagtgaattagcttcatttcccattttcattctaccttaaacctgtgaggtgtttgtttcctggggccagggcttgctggggcgttcagcagcctgcacaccagctgctgctctgctccccagtgtacatcttgtaacaacgcagctcctttgctggttgttgaataggtagaggggcagctgtgaagggcagaagaaagccgattatttcactttctttcttttcggaattctgctttgtgatcttgttccctcttagaatgtttcccgagaagcccgttctatttagctcttctcttgctagggagcattttctgacagttttccaaaatgtgtatattccaggcagttagttggaggtttcgcacatattctagttaggaaagctcagcctggcttttgtggcccagaagcccagaatttcagcaactcacaaagaactcaaatatccttatgtgtgatatttgaaggatagggctttgcaagtcagcctagaaaacgaggataatatctcttggctgtagaacaaactgaaaactcattccattctggcttggagaacaaggatttctctctcagaacaagttttcagggatgatagttaatgacctgtcatgtttttcttatgatttcaaaaaactaaattaaaattgctacttatttttataaattatatgtgaaatgtatttaataatttaaacttacttcttaaattgcttttcttcagagaccttttgtctcctctcacttgtttgacctcagtcttcagaagcaaaccaaaataccatttcaggtagatcagttagcaattgctaataaagtgtgagttgcagattttgagtgtatagagtaagtgtagctagctatgagcactgtgtacatgagaagtatctatcactgtgtctttctccattccacagctcttgcaaaccacagaactcaacatccatgcaactccttaactgatgtgcctgtttggatattcaaatactttctaaaaaaccaaaaattatgcattagcttgcagcacctacactctagaaaaatcaaccctcagggtcttttggtaccatggtctggagttgcttttattttcctagcttttgtcagcatactgctaactcggttgataagtgttctttctgtttaatgatttatgcttcagagggatttgtataggcaaaatagataaagccatatatttccttataggacatattttagatgacattactttgaattcagaacctgtgctctcactgtgggtatcaatgacttcctcaaaacaattcaataatttcaagggcactgtctcatttgtgaaggtcttttacagttaatatgactacctcagataattacaatactgcttctggtatgctacagtatataatagaatccagtgttattaactgaaatgaaatagtcgaatttttggtaaatgtaacaatttgataattagccacacatgctattatccattccatattcacataattggtaaatgttatgcagttttatcttcagtgaaaacatttaagtatcttgttgacttttgtttcagagaaaacatttttaaaattctatgaatgtcttagggcactagaattgaagtgaaatacatcttttgagcatacagagctgacatcattgtaggggtatgttgaatatatgttatgtattttatgtattttagtagaaaggtgctgtatgaatgtgaaagctcctaattagcttttgtaaatcctctagctatgaattgctttttaaacaaggatgaaatgatagcagaacacacacacacaaacacacacacacacacacacacatgcgctaatataatactgactcatcaggcagttgacatgatgtggtcattcaatatctagcctctacttttaaaaaattattgttggaatagtagataggaatatagatttagcaaagtgctttgagatttaggaagcatctctacagaatgccaagaaagtgttaaagaatttaaatgagacctaaaggagttttctactggtgaggcagtaattatattagaagccaaaccatcacatattaaggactgttttgtgctcaccatttgtaggtgaaaaggcaatcttttggaagacaaaaagaacaaacagcccatcatcatgtagaaatgtagaaacattgtgctgttcacaatcttgttaccaataattagctaattattcttttttactaaaagcgaaaggatacatgagcactgcacatcatgggaaaggagaggtgtcatcagaacaggctgcagacacacatccagggtaaagttagctggattattgtgggtcctggttggtcaaaccatggttgccaggaaaaccaggaagatttaagttatcaatctagttctagtagacctatgactgagggtatttatctgtctagaaggaagaatttttagtcaatggaggcaataattttaggcaaatatggtttccatcagaaaagtccaaaggaaaagtgttgctttgggaaatatgcgaagaatgacaaagggacaagactttagcccaaagattggtgcaacctaacctgagttgactcataagtccatgattcaatggaggacagtagttcatttttagtaggctagtcaaatatctaaaatggaaaaatgcaaatagatacacgtgtaagataagagacaattaggaaaaaaggctccttacaaagttagctcaagaaaattcaaaagaagcaggagaagccagactatttctagacacagaaaatataatgactagctcagcctcaacaaaaggtctgaaagtaaaattggactggaaaaatagaaggttctcagaccatacaaatgagaagttgggtgtttaagtgagacaagtgtaacatttactgcacttagttacacattaagggctctgcacacatcttgatgtatctgtgtattattcatccatgctgctgcttggcttattgtggatgaattcctatttctaaggatccgagttcaagcagtcaattcaagtgatgttaaagtaggaaaacggaagtatgggtggaataaaataaccacataatcacaacctgtgtctactccaggtacggagacaactctgaattgaacgcctagttatacaaacagtagttatgcaacaaacagcagctgtctgacttggatctatcatcttaccagggcgcactaagttgctctagcaccatctcttgccatttctagacttaaactttatactccagtaagactaaattgcttactatttcagaacttttcacactatttaccttgccttgatcttttcctgctcgttttcctgttgggctgctattcattcttcaactcttcagctaatcttctgtctcctttaaaaaaaaagtcttctgagagctcctcaacagtcttaattactcgttcctttgcactgccttgtctcttataggcttttttattcttgctgtttcacactgcattttaatttgtttgttatgtagttattttatccgcagcgcttgagctctttggaagaaacagtgtcttgttcatctttgtggcttcatagctggcatacagccagaattgccatggaagggactcaatgaactaccaataaattagcgaatgaatgaattagaacccaggaactcaaatatggatcacaaatgtggttgcctttagttctagcaaattttcatgcagtatctgtaagacacaacctcttaaaacacctatttggaggcagatactatgttaggcgtcagctactctactagtcctttacctgaagtaactcatatacagtgtcaccaaaaccctgtgagaagggatgttctccctttagataaggaagctgaggcataaagaggttaagtaattttcccaggattacacagtgaatagtaactgaactaagatgaaacagtggtagtgagtttcagagctgagctctcaaccaccataccactttttaataagattttatgaaagttggctcttcttagataattctgaaaaatgagtccggaatttcattttctggaatgataagaggcattttagctgaagcaacccaacatttgtaatggatttaatttgagaccatgccaggacagttatcatggttcatttaagtatccattaagtggatggggaaaagaaaaccactatgagaccagaaggggcctctaatgagaaaaaagaagaggatgtgggaaactaagtatctgaagtattgggaacatatattatacaacattatagagacgtgcacctgctcatattcataaattttaaaaaagccttgcttatggctgggcgcggtggctcacgcctgtaatcccagcactttgggaggccgaggcgggcggatcacgaggtcaggagatcgagaccatcccggctaaaacggtgaaacccagtctctactaaaaatacaaaaaattagccgggcgtagtggtgggcgcctgtagtcccagctacttgggaggctgaggcaggagaatggcgtgaacccgggaggcggagcttgcagtgagccgagattgcaccactgcagtccagcctgggcgacagagcgagactccgtctcaaaaaaaaaaaaaaaagccttgcttataaaattataacatatgtagtagacccaagcagtgttgaaatcaaacactccaacaaacaaaatgtacattcaaagaaaagcagcctctttgcatgtatttttcagatactgaagaatattcgcaaaccacagcaatatttttaaaattctatttgtttctgtattcacttccctcagacaccatagttgttcgctctctagaagttgtcactaaatctcttccaaataaaccttctgaatttccttctctaggtctacaattctttttgattgtgtagcacgaaatcttaaaggagtttggcaaggaaagatcttcctttgtcggggagtaagggggagggaggaagtttagggcaaagccaaggacccttttagtaagcaaggggaagaggacggacctctatatgaacaattgttcctctggctcaccaaattgaaaaacaagtataagtaggccgtgggcatctacaaactgaacatacataaagttgttttctataaatgtttcccagaggaataaggctgcacccttaattttaagaaattgggctaataaaaggaaaaggccaatacacttgactacgcaattttaaaaagcttaagaagttctatatataaactaagtgcaaaggtgatctgggatttttatttgggcaaaatttaagagaacacgttattgcatatacttctaaaagaggcgcaactaacagtgggaagacaagagggaaaaaataaagcttaacaaaggagatgccatctaggttgccttgaaggatgagtgtaacaggtgtgtgtgtgtgtatgtaaaaagatgagcaggacacagtaacagtgctatctcttataattccattgagtacatgtaagtcttttggactctgtatataaacagtattacatctgggtggatatgctgttgaccactgagaagggaagaaaatctttatatctttatggagtatacttctgagtgaaggctaactcaatcatggcaagtctcctgatgtcatttcatcaggcacaaaagattagtctttaaatagtctcccaattaaaattctgttccttaatagacacaaatgccagtgcctcccttacgtggtgttaggcttatgagaatttccatttctgttgtctttcctctttggagtgtccctctctgacccacccccttgtgagatatactggaggatcagctccatggggtcttagatgggctgaacattccatcctctatacatttgccactctttgaaaacaaactattaaaacatgtgccaagcttgagtccatgtgctaatcagcatgagataaggtgaactattttcatcctgggagactttttcaaaaccattttccttctttcactgcattttgactataaatcaaatgttgaatgattatcactcccttccttataaactaaattttgccttctttattttttttgctgctattagcaaaacagattgattcattagaagctagctgcagtctcttcaatttctccatagaatgcagttgcagcaaaggcaaattactaatagtttatcttgaacaatgaggctcagtgtttgaccgggaagccttcactactaaaaataagtctgaatttcaaaaactgctgaattggaaggttcctagcaatggtccaatgtaacttccttctcaactttaagtggttgttcaaaaagacagcttgaagttttttttttttttttttttggacagggattcactacctcacaagacagatggctcttcattattaaaatcttttttctttcccctcgaaaggttcatggcagtttctttatctgaattatgaaccatgtcataatagagatttataataaatccattgttccaatactaactgagcgctatcaacttcaaatactgctgctgttggctataatacattgagtgtctactacctaatagctgctttgccttgactgtttctaaaatctcagacaacattcaaaggaagctttattattcctgttttactgataaggaaacagactcagataatttaactgacttttcccaaaacagactaacagagccagtattttgaacccaggggtgtctggctccaaaattcacttattttcccactaaaaaatatactctgctactttgatctactgcctattatatcaggcactgagctagatgctatagaggtagaggaattgacctatagtatatattctacccaggaagttatcaatttggcaggaaagacagtcacatattgacagtatctatagcagagaggacttcatccaactgtgtcttgtcctctaggtagaataccacagcactactgttagcatttcctttgtaaaactgaaggtctaaaactttccaaaaaagctaccactattgttgactgaaaaatgttccctcaaaagagatccaagaccatctttgtgtctgaatctagcatctattctgtctattgcacctcataaactgttttctcagagttatgaggtggaagaggtcagcacaggttcatacaatgtggcaagaattctggaccagggtccagatcaacgtaacttagttcacaaaaattgtcagagaacagtgcagtagatagactggctgttgtcttaatgttcatactgtacggagtgagtgagctgcttggaactctttacctgtgtgcttctgtgtataaaacctgctctgaattgtccttccttgaataaaaataatgctaggtatgtagaatatagaggggtgctgggtatgtgtgcgtgtgtagttaagagctacttagaggaaaattggctgacatggaaggctgatataatttaagtccagcccaactgagcattcagatgttttaaagtctcagttctgacttgagatgtaaaatccatcaacaagaaaaagtaaatcatggaagaaaaatatgatttatatatttgatctaatcaaatcactttatatttggcagagatgtgagcccagagaattatcagttcaggaccacacatattgttagcgacatattataatttacatatattttccttttccatgacaccttaccctacaacatacaaatttatagttataattattgtaactcaaaaagtttataaactccgtagtacctggaataatattttcaaaacccatgaactactttagcatgatctttgcagtgagtcaatgaggtgcagtagaaataaaacaggtgttagattcagacagagctggttttaaagcttagctctgtgacttcctaagctgtatggttttgggcaagtaactgaacttctagattttcagtttcatcatctgtaaaatggggagaataaaatttacctacatacatacttctaaggatttaatcaaatacagtgtataaagcacgaagcttagtacaattacaaatgttagttccgatgagtcaggatctacatattatttacttccttttcttccatttgctttcaatttaaaactctggttcatttaagaacagacatgattaggacatgcttcagagtagaaaattcaccccattaatgttaatctccatgactatcacccctacaacttgctcccttttgctctaccctgaggaaatcaatcagctccatattaattgtcaacttgtataaaacagcaaaatctgacaaattttggaaaaagatgaaaaagtcactggtatatgctgggagtttgaggatgagctatgtctttgactgtcatatgaatatttttaatggcatactgttttgagttttgtagagaagctatagaagaggaagtgttataaccaaagtccaccatctttcatcttgaacctcttattagcatgtctaggatatgaaagaaaggtacaaattcaagaggatatttttccctactctaattctcatcatgtgtcttatggaaaaattcatatattcaatctatttttcagtctccatttcagactcccactataatcaagataatgtacttgcttcattcatgttctgcaatcaatatcatcttatattctttattcttcccctctcccccatatatgttatctttgcctattttcttccttcttccctttaacaaatgttattatacaaataagagttctgattaatatcgagagtgaaagttattaatgaaacattgccactttgtctcactgcagctgaatttgccagatacctagttcagtagcaccgtgatgagaaaaatcccgtaaacatttctaaagaaaacaggtacactttaagggtctaatgcaatgtgacttgaggatatttcatggtttgaataaagactgcctagataggatgcacaggcaaattggggcaccctgcctgggctaagcccctggtgttaatgagacactctgcagggcatcctggctgcaccaacgagacaggtagaagatgtcagtgtgtgcctcctcggcatttgaagctagcactaattttcaaatttccgtcctgcctggcaggggaaacacttcctcagacacatgataaaactgcggtaagaagtggaataacaaggctctggcaaggcctgtttcagacagccattgtgttcactagctgtgttgactgcatgccctcaacactcacacatgaataactcaagtgaactgactacctctctttactgtacacattgaggaagatttttcatctgacaagtgtagtatgtagaaggagagtatggcagtctctgcagtggttgaaggtgaggggttgagagactggaaacaaattacgtaaatgcatgtttgcttaatattagaaaaacaacactcccttgatcagaactcaaagcataaggaatgctgttctagttattaccccatttttgagaacttttctttatggaaagtttcaaacatatacaaaactatgaaagaattaaccctcatgtacccatcacccagtttcaacaatgatcaaattttgctcaatgatcaattttgtttcatctaccacctttcttgtccccacccaatcctccacctcacattacatggaaacaatcctggcatgactaatttcatctacaatgattttgcatatatatctccaggagctatttaaaagcctgatagctacaaaacaaacaataattccctataatcaagtatccgtttagtcaatgttcaatttccctgacatttttacattgtgtttgaatcaagatcaaaataagattgttctattgcagttggttgatgtatatgttagtactatttttaatctatgtgttttccccatttggtttggagtattcttcgaatgtgaagctccatgcctttgtactagcagttttagatctgtctttaaaacttcaggcaagttaaatgtctacgtatggaggaatgcttgaatcaactacactatgtgtgtttgcttaaatcttgggcatgatgcagttgaaagaatggcctttgtgaaataagttatttttgaacctgaatgtatcatttgtaaaatgggagtaatgataccacctcaaggattaagtacattcatctcccattatggtgctaagtatataacaccagagcataaatgggtattttaaatggtatacatgttaaaattatatcaaattttttaatgaacgtatttccccattaaatcatgttagatttcaactaagtctttttcttcagggaaggagacagtgggggctgccccatgcatcatggatcagctgtaagtctcaaaacagactttcctaagaacatagacaacctgaaagccaggtttctggagcaacagcatgggttgctaattttaaagtccctcctttctcatatgaagagataggccttataacaatattttttgtttggtttgatttttttttaggttgacagaaaaaacacaggataaagtatggtatggtagttctaagtcaagcaagaagaggaaaccatgctatcaatgctggtgcaggggagaatccaaacgagcagagagatgtgaacaaaaagtccaaactggaagggaagagagttagggcaagcaggtgggaagcatgtgtcttggcttctctctcaggcatatgttataaggaatcagagacttttccgtaggttgaagagaaagctgaaagtgcaggggtggtttccctttctgtacttagaaaatttcacctttaactcagggccaaatccaaagtaatataggagcgatggtgtaaaactgataaagatggttagacagacgagcagaaaacagttttcctgactcccatgtgcatttcgtaatcccagtgtgccagtgggcccaggggagcgagtgtgggggctctgagaaagccagtgaaccagtagaagtcaggcaatataatagaagaggaaaaaattgagactttttcccccccatccttatgatcccacataagccattttccggtccattcccaccactacccctccaaaaaaaacccacacacacacaaactacagattgtcttgtaaagaaacagatggaaaacaaatctaaaacactgagcctgtaaaatacgctcagtcacccaagggactatttttaacctcaccctgacagagggagagttaaactttgagtattttatagacagactgcttaaactggaagaaattaagctattatgaattgtcaagttttccgaattacctaataagaatcaagttagctctagcaacttataaagctatattctctttgcatatctgaatgttgtgtaatttgactctaatgcacaatgatacaggggaaaagtagaactcagaattttaaaagtgattataaacatgtaaaatgaagtatgagagaaaagattgagaattattgttctaaaatgtaaatagtttgtgtttgattatgggagcctagaggattttcttcttactcttgtcatttaatacttacagatatttttaaacttggaatattgaccaaattaaacacattacaattaataagcaatgattgaacactaattttcacaggtactatgctaagcactatggaagataaaggtggatgagacatggccccaaagccaaatgaacttacagcgtggagagacatatgggtaagcggcaagggaattcaacactgattatctcctagctatgagaaactacaatgttcttcccatctactacaacccacctcctgaggatttcaattcagtttgatgatgatgaaaagcaaagagttaaactatgataactcaggtttctcttcatttcctcatgtgtccctttggcaaaaagtttagacctataatgaggatgatccatgcctccactagtggacatagcttggtatgatgtgaggcatccatccgtttttgggatacctgaagttcagctaaatgttatttcatagttcacattatgaagccatttattggctaaaaccactttttaaatgagatccttttgctatttcaatagctaacttcccttagatgcagtatacgattgatattgcattgaatgctataaaagcatactgtgtgacaagaagaagagtttaacagtttaactctgtacaggaccattaagaatttatctaggttagaagttctccagtcttagcctgtatcagaagcatttgcatgacttgttaagattcagactggtggaccccaccctcactttccgattcagtagtccggaatggggtccaccaatttgcatttctaactgtggtttttggtggacgctactggtcctggacttgcactttaagaacctataatttaagccaacttcctttgcagtttaggaatacttttgtaactttttcctctgcttaaacacttcagaaggtgaaacactaaattgcaaagtcagttttactgttggactggctaattcttaaagattttactgtctccttgaaatttctgttcattatattttccctcctgctcatagtagctcttaaaatgtcttattttaaccacacctaaagttcccacctctcaaccatttattccacatatctcctctttatctaccacgatattgtcccctgatgcaactctgttatataagctactcaaagtatgtggccaagaacacaacattgttgatgttgatccactgggactatcaccttccataaactgacgtgtatctattaacacaggattttgctggatttcactactttaaagaaattgttgtggaaacgcgttctgggtatgtgatttgagaagttgtagcacagtgagatgggagaaagcatcctggctgcaagataaatgctgctgctgggaataggcctcccctagcagcccctaagtaatgcttagcagattgtagggaacccaaacaatccccataagcagacagtaaatagattaagagagcaatcagtggcttaacatgtggtcagtgactccactatgaaggctagacaggtaggtattgcaagggtggagatgtacttcgtctttcggccactttgtatgtaagtttcccctacataacaaatctttggctacccaccaacctgtagtgatctgactctttggtcggagcttgccctccttttatggaggatgattgtaggttctggcagggagttctcccagcagcaatcatgtcacttcattgggtcatactgtatgaaagatctactaaacaactgagttttttcatattcaaacagatagtggccttccacttcttttccagttgaaatattaactatagcacagtaactttttattcaacattttcatagttcttaattccagtttaataaatacaggacggcagttaagagcatggccttcaaagacagttctgggtgcaaatcatagctctactatttaacaaccatgtggccctagacagcttacatgatcaatctacacctcagcttcctcgggagagttatggtgatagtaacggtagctaccttgtgggaggtcttctatgaataacctgagataacataattagcacaatgtcgggtgcatattacatgcttagtaaatgttagctgtcattttattaaaagcaatagaacacttaaaattatactgaacaagaaaagagcaaagtattttttttacagaaacctataaatcttcagaagaataaaggtaggtataatttttgccagaatgggactaaaaattacttatctgttcaccccagggaaatttacagatttagtgcaacttcaaagtagcaatgtgattttttagaatcaacgtaatttccacaaaaaatatgaaaagtgtgactgtaatagaaaataaaaagaaaaaatctaatcacattagacattaaacttacaaagaagttttagaacttaaaactgcatgtactggcagaaacacaaagccacctcagtgagaaggggtaggaaaattagaaataaatccaaaacaaatcagctttccaaaaaaggggtaagacatttaataaggattaaaatataacaatttaggaaacaagtgttagaggcatgccttacacaatgtaataatccacagaagaaactcgggaaacacattgccccaactaaatctataaatacagaaagcctctactaagtgaaaacattgtaattaaattttttgtataacaataactaaaattcagaaggaaatctcaaagtgaaaaagctgggtaagccaatgacatgaacatcaaaattacataaatattaataaacaaataccgaggaaacactatcccaaatggaacctgaagatacctttagtcacctattaaaaaagcaaatggattaagaaatattgtattcattgccagtgaaagtaaggaatccatttatttatttatagtgatcttataaattggcatacctcttttggacagtaattaagcataataatttatagactgattcggtaattttattctctagaatttctaattattcaacaaacaatatatgcacagaacacttatctacgatgccaaaaggctgaaaatagcataaatgtccaagattaaaggaaaagatttaataaattcaacctagaaaaatatgtaatcattaaaatgataattatgaaggatatatagaaatgttaaaagtaccacaatcgatgaaaatagcaacatatatatgtaactatatatatatgtagtttgtgtttgtgtttatgccaacatatatagttatgtttatgcacatagaacaaattctatcccgagtgtaacaaagcaaatgcatgtatgtgaaatataaaaggcaaaaagtactaatagcagtattagaattatgattaatttttaaatcatttaagcattctttgaagttttctttccagtataaattaaaattaactttgaattcctcttctgtaacagagtaatgtgtttgcacatcactaagtgtatgcaatgccttcatgtcttcatgcctttatcctagtcagcaatgcatcatgggacaacatcaagagctctgtggcccatagtcatcccttgtactcacccagcatgtgtttactgagccgatattctggctgtcttttgtatatacaagaataacccaatatatctcagccctgttggtctagtggaggtagacatgtcaatgatcattaagttacaacatagtacgtacagtactagggttaggctattttagaacccccaaggtggtatcaaattcaacatagcaggtaataaaacatattagatcttatttctacgggatgggtagagttagcgaggcaaaaaggataagtggctggaggaaagacattgcatatagggactaggcatgaaggtaggaaatagcatggtgagtaagaaatatgtttgcagtatggaagggcaagggcttcaggttcatgtttaagtctagattttaccgcttattagcttattattcaaatcttatctaaaaatgcaaataattccatttatgtcacaaattgatataaggatgaaatgagaccaaatgtgtaaaggaggcattataatgcctgatgcggcaggtctaacaggtctatttcaagggctttgacattactggaaccaagtacaaggtgggatgaggtaggaggtaggagacaatcagatcatggagaacttcttcatcaaggctaaagcggttggactccattccataagtcactgaagcctctgaagatttttaaatcaagagagcaacatgatcagggttgtttttcagatggatcactaaaaactgtcttgaagctggatttgatggggccaagcctggcagcaaggtcagtttgtgggctgttttaatagttctggagacagtgaaggctgaagcaggaatggaaatgaggaaatggttggagaaatattcatcaggtaaaaaggtagggctttgtgattagattgagatggaaggagagaagagtgaggggtcaagtataactagctctctagtgtgggtggctgagtgaagcaactaaaattctgaataaaaaggaggaacaaattgagggaaggcaatgagttattggtaccatgtgcctggcagtatactcagttctgaggttacaaaaatgagtaagacatacttcctgtctgtaaggaactcacatgctggtagggaagacaaccaaagaaataaaatacactttggttaaagccccatatctggagtcttgacagcaaaatatttaatatctaatcataaggaaatcagataaatcctaagtaagggatattctgcaagacaatctaaaaactcttcaaaagctattaatgtcattcaagaaaaaccactgggaaacagttcaatgttaaaatactacaagagtaacggcaatcaaatgtaatgtgtgatcactgatagggttctaatcccctccatactccagaataacagttaaaagaacactactatgctaattagaaacaattgcatatgaaccgaaataccacccttcataacactgttaaatgtcttaggtgtaccattgcttcgtggttatgtagaagagcccaggcattccactgtaagtgctaaacacctaaagagttggggtagcatgccatgatgtctacaacttaaaatattcatgtaattcatacatgttgatataatgcattcacatagaggaataacatgtgtaagtggggcaaatgttcaatttggtgattttatataagttgaaagagtaataaataccattaatctacagatgagttttttcaaaatattgaaaacacactgtagtacatgttatgacagtggtgggctcaacatactcatcagtaagaagtatagatgaaatacaaggatggttgaaacaaagttctgtttttagctaacctctttctcagttccagcttttagctaactcctttctccaaggtcgtcttctcctgctttccttttcctacacaggatgctatgtgaaaaccatttcagaagagttctggctgtggtggttagttgaggcacattccaatcacagatgcagttgaggtcatgactacaacaccatcagctagtatagttttctccaaagtgaagactgaaaactatcagaaagaatatagctagatacagtattgggtcaagttcataaaacatatgacaaatccctccgtctctgcagaaaagtttctttccaaaaatttaacagcattttacattcttaacttttgtctactaaatagacttctcatttgtccactgattctggaaacaattctaacaactttcatttattgactacttctatgcaccaagtgtatgcacatcaaatgctggtattttgcatatatttatccaaaaaatttatgaagtgaataccttgcactggagacacagcagggaacagataaattcctacctcttagaggtgatttcatcctaatgatctcaaatttcacttacgatctcattcaatcttcacaataacctaaaagggagatttcatgagatttcaaaccctgcctaggattaagctagattccaaccacagtcattcaagttccacagcacatagttttgttctattttactgcttctttccaataactcagcatcactggaatttcaggaatttgtaagttgatataaacagatttcatcaagaatagaaggaacacctctcaaaatccaaattaaaaaaacaggatacagtctgtccaagaatatgcaagacagccagggacacagcacagtagtgttagagtttcttatacctaacaataaaaaacacagaatattcaaaatcataattgccctgggcactgtaagcattgcctcaaattccaactgtcctagatctctcattatacagttggggctgtctcttgcactatgctctctgcgttcttatcactttgatatgctaaggagctttgaatttagcagagggtaaactgggcccagtaagtggtttcagatttaaattttaattcgttaaagaagcacatagttcctctgtagtgaattcaacaaaattatggattctcaaaagaaaaccaaaatattcctatggcaacttgatctttgacaaagtagggaagtgttgtaagtttgagagtcacttcatgaaaactagccgtgagaatggcaatttaaagtgctaacacagcaattacaagtaatgactagtttattaggctattatttgaacattatttctgctttaacacgaagcacattgctcacaccttgtggttagtagccactgtggggaatttggggggttccaagaagctagagagcacatttctgggacttctggttttcactattgggaacatcatttcccagaggtataccaggccatttgctcaagcaccatctgccagagatgacactgcacagcccaagccagtcctttacctggaagcagcagaaacacctggtttcatggtacgcatctctcatataaacttatgtcatgggtcctcaaagatgaaaccagcaaatcctaagaacctgtgctgttcattcctaagctttctggcagttagggtctccaaactacaaattggagcccaagaaagtaaaagaattttcttaaggaatcagatctagtaagtgggagagaagagacatcttagttctcaagtacatgacatttggcatcaaagggttttcttacaagggaagtaatcatttggatattttatgtgacagtaatttggacttgcaatatctagataattgctactgtactccacatctatgtgtacaagtaaaaatctgtattcaaatacatttaagacattgagcatccagtacatgtaagacattatgctagaaagtggggataacaaggtgaccaatataggtatgttttctgtcctcatcaagtttataatccagagagtaatacaaagcagtaaacaggcaagaacatgtgataacccctgtgacaggggaaccataaggtataatgagagtcataggaaggctccagaatttgacttggattcaaggaaatatttagtagactaggtgatatctatacaggccatgtagcatttatactgagtcctggagaatggagaggaattacatgacaaggagagagaggggctcaggcagcagcagcaacacaggctaactgggaaactgccagcagtttagtatgaccgggtcttaggctgcaagggagagagtcgtaagagacaaaactagaatgctaagcagaagcaagatcataaaaaaactgcagagcaaacacaaacacattttctaaagaactcttaattgtatacgaataaatggtagttgtttattcacatcttgacaaaaatagaatagaaactgaatctgaagccttaattgatgatgctacatttggagttctttcccgggatatcagcttgctacagatcagataaggtttacaatcaaaacactgtggccagtctcagggtttgcaaattagatgagtggttcttagcgctggttgcaaatcaagatcacctggggaattgtaaaataaactgatgtcgaggcctcatcatgaaatcttgatataataggtctatattggaactggatatgggtatgttggtaatttttaaaagaacgtaaatagaggcaggaaagaacccaatgtattttctattctcagaaatgattacgtgttttcagctaaaccatgaggtacttgcactctaattgggaacacagctcctgctttgtttgtcttatcaatagctagccaaagaatagatactcaaatgaagacaactgagtaacagatatggggtaaaaaggaaggccaagtattatatagtctgtggttagtatcagttaccagttgtcgagggcctgtatatatgcaattctgcatctacagagtacgtgggttgcagcccagctagcagacaaaaaaaaagagaaagtgggattctgtgatgggaggtggggagaagcctgttataaaagtcaaaatgttgagactgaagttattgggaccttagcctgttgtacatttattataaggcattaggagaaatcttaatgacaagaaatagtgccagacagaaaaatccaaagacctgggagcccttctctcaccttttcacttttcttactcagttcaaccagcaggagctacagctgcatcttagatttttcttttgactcttggatggtttggctatttttaacacttttacttagatgctacaagatgccgaaagatcagtagtagctgatgagatggaacattttataagacttgtctggatctccacgttactgctatactgacatatatacacacaattttatctagaccttagctaacgtagtatatattaggtatattaagaaattagtgttatgtttactgcatgaagtttgaagttccattaactgtttaaaaaattttagaagaaaaacttacaacacttgatcactccccttttatcttcctcaaaagtgaacaaaaacagagcaggcattaatttgactttgtcttttggtcaacagttgcctcccctaattcacaaaaaattatagtaaataagtttaagttaaaaacccaatagcttatattgatatccacaaataccatattataagtgatcatattccaggctataacttaatttttaattttcaatatttccttaagtttactatactaaatctaagccttaggttgttatgccttattttagaaatggagccttttcaaatatccaagcactactttcacatattcctgttttttgtatgcctcatactacaaagctacagtcttctttcctcttaaatgtgaatactccttacataagctttactgaaatttaatttgctttctgattaaaacaaaacgcacaaacttgcaaaaaaaatatatatagcctcccagagggaagctagatggtaatcaaaaatttccaaaaaccggagaatgctttacttacagaaagcatttcaaagcaaaatgctgaagtcttttgttttccttgtggtttatccttatgtaaattggcttaattttttaagtttctgcagacaatttcttatgaacgtgaaaataacttacgaataaggtagaagcctcaaactgatttccttttccctgtagttgcttataacatgtgttttaaatggcttagtaatttcttgatagaacaggtacaggtggatggaaaagggctgctcaaataaactctaaacaagcttcagccaaggagtctgaatggccaggctattttagctattgccacatttctgttgggtataagggcatttgcagcaagtctgtttgcataaaataagaacttgtaaaaagagagtaaggttcacttttaggaaaatgtaaggtacttctgtggattggctgtgacttccactttgaattggaattcttcgttcgaagtgtaaggcttcagtctaatttctcaaaatgttttctctctatcataggcttacataaaaacggcgtcttgctattaagtttgttaggtttgctagattgtcaaaaaacaaaatgcttctttgttaactacctgttacttaaaattctttaaaagatatgtactcaaagacaagtctctcttggaagtttaagtagttcaaattgctatctttagttctatttgaagcctatggatatagttttatctaaaaaagtcttcttgcttagtctgttcacaacttactttggtttcgaaggaggcatttggcaaaagttaaatgtggctgattaccacgattacttctcgagaccctcactaagacagttactacttgaatctatcattacaacagttactattgttactacttgagaccttcattatgagacgaaaagaaagaacatagaaatgaaaacttaagacaaaagaaactattttaaaggaaagatccagagaaaaaagaaaggagctccccgctttcagtgagcaaaggcaacctctgagcgtctaccgcccttcctatttattgtgtagcaagagcagggcggagcaggtaacgattggtcggctgcttaattgataacaggtttatattattactaacaggcttcagatgtgcctaatggcaagaaacactgcacttggggcgtgactgccctcggcattccttctgggtggcagactcaatttgtcagtttgctgacattttgcatttatgagaaacagtttgctgtttactcgtacagcctccagtggtatattcagtagatcacgaccctcattctttcagcctccatcagttaaatattgtttttgtcctgtctcagcactctttccatgggaaaactagtttcccatactctttaatgaatatcatgtggttcttctcatctacaccacccaccttcacatcccagggatacctcagtgatttgcatacagctcagacctgaatacagcaccctacacagtgattggctaaagccaattagcccctggcaggacctagcaagaaaaccataatttaggatctgcagctctaagaatgatcttagatatgtcaccagctgttctgcagatgtatggagcagaagagacagggcctgtggcttaagcttgacttttactttcgtcacttgcaactccaaagaattctgatatatacagagagaagctaagttgttaggcatttcttttataatgaagtgtcattgtgtctttgacatgtgcaaattctcagttcatgcttttttaaaatacaagaatgatagaaactgaaatgaccttggattaagcatgctacataattgtcacataatttgatattatattggattttaagagagtgtcttggtttaggttaatcacagaaacactttccatagtgttgatgattctatataaaataactaaagagtaccaagaaataaaatgaaaatctacatgataatgtaatgattgttattctaattttgaagtagtggctgttgcgcttatgaatgaatgcagttagaccaaaaagttaaacctgacttaacccaagatgtctatgcctgttctactaagatgctggctacactatttttttctgaggtattccaactgatttgggctgaaatatattccacatttaacgcatttggcaaccaataagttaagcaaaagtaaagttttttttttttattgcaggatttctcagaaccctgtttatgataatgtgtattgtaaatctacaaaagggaaacagcatattcagcctttctcaagcttatttaattatggaaccatttgccagtaagcgcttttgaggattagtgttctatgagatacagttttcaaaatttaggcccatgttatgaaaatgagccttgttcatggctttccagttgtgaatgtatgcatatatgtgtgtatatatatacacacacacatatgtatataagtatatatatatacatatatatacacatatatgtatatacatatatatacacatatatgtatatacatatatatacacacatatataaacctgttcaagtaaatacgaaacctctcttcttcatccactttacaaggtaacatggtagaagatcaagaatacgttcatgttaacaccagcttttccactgcctacctgctttttaagcatattaactcacagctttttggtgacaatcaaaaagtatctactctcttccggctacccttcacctacttctgtgtgtagttaactcctgcttattcttcagaaatcagctcaagcgttgtcaccttctgtcaggtcctctttgctcctgtgtatcattatatcatagcagataccacactgcatgataaataatagcttttcttttatatactattctctcctattaaactttgagttactttgaagccaaaaccatgatttgataatttttatatctttggaggcaagcatttgcctgacatttagtaagtgcccaataaatagttgtgccagttgaaaagtcatcccttttagatacttacccttgccaataaataattccagctgctagttgatactacaaggcttaatggatcaaagtatttgatgccatcatcactaaaatctcttttggcagtctcaagatggggtgctgccaccagtggtggagtacaatacaataactggtatgccaaaagaaaacagatattctatttattaataggccattttacaattaaggaaatctttaatcttcatggatatacaacatgctcattgtcactcatatatggtcactcatacataaggtacccaatgtagttttacacaagagagtgagtgctacaatacataggtataaaaatgacataactcattctttctttttccgcagcacatgcttaaataaacttatagtttctcttactggacttacactaaataaatgttatgaagtagataaatgactttaataaattccttccaagcacaccagtttgaagataaagcaaaatgtaagttatacaaacaccaatgaacaagaaaattaaagaagtaattttctctaatttctattataaacattcagccaatttataaggtaaatatagtaacagtctaatcagaaaataaaaccataaaattccaaacttatcaaaaaatattgcactatggacttaagtccactcataataagttagctgggattaatgatagtataaagacattgcaatttctaagatattaaaaatatagctaattccaacttaatctaaactactgttaaaactttgcatttttcttaggtatgaacacttgtacatgcatgcaatttataagtaaacaattatatataaattggtgtgcatgctcacattttatttcctgttatgatggtgtatatcaaaaaagattcagagctcacaacttcaattataccaagtattttataatagaagtgtttcctagtagttaggctgttgggaaaaagctgagtgttgggagggaaactgaggcagggcttgcataatgtcctctggaatgtgtctagactttctggctccttgcttctagccctagatcgattgtattcccattatctcaaatagcagaacatgttccttataaatgctaaaccgtcacagctgtagatcatgtgcctacccttttgacctccacattctcaccacctgtttctttgttggattaccaataaatagcatgtgctcccagagctcggggccttcacaacctccatacactagtgatgcccccccaccccaccgggtcccagctttgtttctcgaactgtctttttctcaatcctttgactccgccggtctttgtccacccgcacgacttggtgttgggtctgatcaccccaacacaggcagtccagttagaactgtgccttcccttgccaaaaaggttacactcagggaatgctatgtaaccagtgctattcttcacaagtgtgaggagacagcagatgatgaaagaaccatcaggcttactagaattcaaccacagaccttttgaaaagcaaatctcttatctctagcaacttttgtgggaagaagcatttatagaacacatttatataaatatattcaattatgaacagtgtattggaaaggccctatagccatcatgttgacttttagcttaaattcattttatgaaaattatacaaccaacaatgccattctgaagaaattacttgaaggaaaggatactggattgacgcttctaaacaatggtttgtccagagcagattgcaggaggcctaagtacatgcaaatagaagaacggggtatgagaggcaaaggggagggctttggatgcaaaacacctgggttcaaatcatagctctgcttcttaccatctgtgactatcaaagattcactgatccttagtgtcagtttctaaagttatcaagttaaatgtactcataaattttagaaaatggttttaataataatcactattattacaaaattagaatacataaatatgtagtctcctatattgcagagcactagccaaaatgaaaactcaaaacatgaccacttgaccaaaagtggatacgtaatttttccccacaaaagcaacaaaaattccaatagcatctcctgggaattagaggcaaacagttgaattcagatcaaagaatgcaagaatatcttcaaacattcttgctaagctgaaattccatcaacactgatttcattgtaattacgatcttcctatcagaaaacatatattaagcccctaattacactgtataatgctaatagctaacacttggtttcttactatgtgccagtacttttgtaagtgccccacatattatttatacatttaatctttcataagtaagattttttatttacattttacaaatgagaaaaataggcacagaaagtcaaagcaacacgctaagttcacaaagccaggaagtaagtaaatctgtgattttaacctagcagtctgactttagagcttgaactaattattattatacaaccctgcctcaacgacaggctaactttccctgccctctgtgtgctccatatgtagagatggtaaactttcttaaatgtaagtgcaaagaagtgtaatagaatttaaacctgacaccagcatctgaaaggagattaaatacgacagcaaatcgtcagtccaaggttgggcaaatttaagacggaagtccaaaaggaaatgtgtaaatgaggtttcagactcagggaaaacctggcctgatcttaaacttgtcttcttcttttcttggaaatgccatgctcctttctcttcagggtttacagatacgctgtttcttcttataggaacactaacccccagtatccttcagatatcaatttcaatccccattttttagagaggcttttcttcctctcccctgaagttagggaagaatccacagtcgcatgctgttattataccttgcaattgttcttgatacaatcgtcatactcataattatttgttatggttatttttcaatttctttttttccttctagaggataagctctgcattctttctggttctctgatacacaccacacacctagcacagaacctggcatctagtatgtttcttaatgagtgaaggaaataatctaaatcctgactagtggctataaaggaaaaccatgctggtagtgaggccttcaacgtctattgggcacaatgcatactatttgggtaatgagtacacgaaaagcccagaatttaccaccacacaatatacccatgtaacataactacgcctcagtggcaggctactttctggaataatccagaagttgcataatatggctaggaacaacttttaccttttttgtttatgtgcagaaatagaggaatgtaataaaatatcattcatcaccagattctttttttttgttttaagccttacacatgattgtaaatgctttgtaccttttaatccataaaaataaaaaaagtaaatgaaataaaaggaaaatatgaccatgatgcccatgcaccatgggtacaggagcacaagtgatcacccacttctacaagtttctctctaaaattcatcccaataacctagagatccttctgaatagtagaatttttcactcaagcttcctgaaagcacaatcaaagaaatgacagtaacgcaaaatagcataggaaagtgattaagaacttcgacttggaaaccatactgcctaaattttaatcctggctctaatctcttcaagccccagttttcacatctgtaaaatgagcataataaaataacttatgaatagtgttataagaattgaaatcagaagttccatatgatgcatttttcacagtgcctggcaatattactaccaataatgatgaaatatatgtttagttttcagtgggaataaatgagatagaggtattctgtctcattgccagaaggttgttactactaacacttagtctaaacttccagagggacaagcctgattaggtccagatatttcagcaccacagaaacagacagaaaaaagaatccaagactggaaaagtaaaaggagctagggaagcggtttcaaattcagatcgaatgctgacataccttaccagattcccatagaatgcagtattgaaggttgccacaggattggtgactaccttctttttggaagtgtgtgtgctttcttcctcttgacattggaacatttcattaaggagttagcattttccatttcagagttatacatccatcaatgtctatccaatatcactgcaaatatctctgttaggatatatgctatatgtatatcacatatatactatatatgtgtatatatatactatatacatatatatgcatacatatatactacatattgtatatatactatatatacatatatactatacatgtatatatactatattgtatatacatatacatatatactatatattgtatatacatatatagtatatatacacaatcaaatatatatattttgtatatatacaaaatcaaatatatatattttgtatatatacaaaatcaaatatatatattttgtatatatacaaaatcaaatatatatattttgtatatatatatacaaaatttctaaatgtacttttttgaataacagctttattgagatataattcacatatcatacaatctacccatttaaaatatggtttcttcagttttttggtacgttcatagaggtgtgcaactatcaccacattttcatcaattactccaaaaattctttctgtactcattagctgtcactgcacttccatccaccaccaacccccagctgtaggcaaccacgaatttactatctctatagatttccttatccgaacatttcatttacttaatatatttttattactacatgtactccttaccctatcttgcaaggttgtacctggcttcagaaagatgtaacaactttgcttttacagttttcttactctgacagaaggaaaccatagaaccaaagcaaaaagacctcacgagcaggctagtttctggaacaatccagacattgcagaacatagctgggaacaattcatactttcttttagtttgtgtgcagaaacagaagaatgtaataaatatcacccatcatcagattgttttttgcttttaagccttacgaaggattgtaaatgcttaatacctcacagagatttttctgaaacaatattaattttttaaaaccagtgggtctttgattcatataatattaatagagtcatgtaatatatgccaggcactatgcttaagttttacaacaatcctgtggtagaaagtaggtcaatattattatccacatttttttttttaaagacaaggtcttgatatgttgcccaagctggcctcaaactcctgggtgcaggtgatcttccgacctcagcctcctaagtggctagaactcttatccccattttaaagataaggaaattgagactcagagtagtaaagtaaatattcccaaatcatataactcatacatggaagaagtaagaattaaattcagatctttccatttcgtcgtgtcctttccatcatgttacattttccactctcaaacaatcagtctttctgttataatttgacaggagctaactctataaaaatggtttatatttctccaagaccattttcctaagttactgatggctatagtttggacacttctacatgcaacagaaatgcttcattataattgatattgtggttctgagtaccaagcctcatgcaaacaatcctttttggtttcctgctttccctgattccacatgcagaaaggcttaagtatttgagttctagagtgtattgttttcctcagtcacacctcaatacataatattatctcctggttattaaatcccagtgggcttgttgcaaaataaaaaatagcataagaccaaaaacaatgtgtgatcattttacataaagaaaccagagctagaacttcagtagggggagaaaaaacaagagggaaagaactggtgataacaggtcagcccccgttagcagcagtggcataacatcagagaaatgtctaatcaccttaccagtcattgtggtctcttgctgtgtttaggacagtgtatttcagggtagattgccattttcctagcttttaagtgccttcgggttaaaggcaccgacatttccatgaggttgtacccattcaacctggggcaggaatcatcttctgcagtaaaacagggctgcttatagcaggttggatttccagagtcactggcacaagtcctctctgagcagaaatgggacgaagccaggcaggtctgcattgacgaaccagctgggcttgtctcggtatagtaacctaataagctccaactgtgagaggcaacactggtggtgagaatcccgactgttgatagcaacgggactttctccagtaagtttgatgagaaatccacgtggtcctatctgttagtaatatctggggcactacctcatccacttaattaacccctggagagctaaccaaggaactgctctgattacaaaataatgggtccatcaggcacaattaatacccaagtgaaacatggcagtttgcatgaaaacgattgaagtaaacagttccaggccctgaaaggggctcacttcctaattaacccttagagggctaatctgcttgcccaaacaaaaccaaacctggtgcctttgccaactggcatgttggggaaatgatttttgcatcaggtcttgctagcatggcactggcaagtggaaatgcctaatccctatagacctaaaccatagaacatcttgaaaacacagggttctgtgaacgtgttaaatagtgacttggtaaggcattactagattagagccctagaaagagacttacaaaaatccatattataggacgcacaacattcctacacatgctgcttgaggacaagacaagctttcttctatctgatagctccacagagcctggcataatgccctgcatacaggaagtgtatggcctaaattgtggacgtggcttgctttggagtgggattgggagagatcaaactgttggtttttctgatctccaagttaaaaaaaaaaaacaaaaaaaacactgtctcaagatcaatcaatttttataaccacatttttgttctgtattctaatgaggtttgtatttgttttgttcactgccatatccgtatccccagtctctagaacaatgtctggtaccaagcaagttcttttcaaaatacttgttaaataaatacatgaatgacctacaaagaggccattgtgaataagagggtgggggatggtcaggaatcatataaaagatcacatatttaagagttgcatagtaaaaacgggcagtgatttacatttgataaattgtagttggatgtttagtacctttttattactttaaaagtatattttaaaggcaatacaaaaatatttttattacattttaaaaatatgtatcttctaaaagtgtaagatagattcatgacactggctactaaataagtgaaactcctccatgaagcctcagattttgagagtctttcaggaatccggggtctgcatgggtctgatgcaataaggtgtgatggtataaaccatagtttcctcaccagtaaaatggggttaataccatctgtctttatctacatgtgaaaggctcagtaattgttatcaatcataatgagaatgagaatgatggtggcattggtgataacaaagaaaattatggcagcagctcacaaaaaccccagaaatattaaattgttcacaagtacagggaacaactgactcacctgtatgtatgtctggacacacatacacacatgcatataatgttctctctctgtagcttgacaacctcccaaaaataaaagctagccaaagaggttttctgtggctcctgtatgccaaaaaaaagcacattagaggggtgtgtcctgtacacggctgcagcggtttcatttgtttaaagcccctggaagtcttcagtgtggcaaactcagcaccctgttaccttaatttacctaatctttaagccaatgataactgctgactgtaccacagagacagcctaaattttctccatgattttgattgtcacatcacctggcacaaacactcacaatacatctgtgatcagcaacagagaaaaagtttggagaaatgtcagtggttggcttatctttcgtttgggcagaggaatactgagatcctggcttttatttgtctgcttagcatgattattaaatctatgttcaggggtggcaccaaagaaatcacagaatgagaccatgatctcatgcttagagaaaaagcttctccactgggctctttgtggtcctgaagatgtatcatgatctcagtccctacggggcttcccaggtggaaaccttagctaggagaataggaattcttatgaggactgaaccagctctctttccacattaggctcaagagtcctgggtttagtcttccattactgaactgtcattaaatgataagatttagggggaggaaaaatttatatcactcttagaagaaatacctgctgttctttctccaagactgacttaacaagatctttaaaatttagaaagggtctttaagaaacccttctggtctctgaatgcccaatttgctttaaattcctgggagacagtctaggctgtcaatataatctaagcaataatgtgttattcatatttctctgaggtcatcaatgtctctgcttgctattcttactattcttcagaataatggtgcttagtgaagcaatttcttcttaacttctactgtgtgcctagttacaggctatattcaaaagcctattataaaattctacacctcctcaccatccttcatccagagatttaaatataatttaggcctctctactcacctcgttatttgcttaataagtaatatctgcagatatggaatatgaactctggtcctcttattttatgccagcactcaaagtttcaaaatattcagggtcacataccttttatatttacaagcacaaaatattttcacagtaacagcccttttaaaatatctttgtgaacaattatatatcaacaatatgggtatcctgtgaatcttaattaagaagacacccattaacaattaccaagaggtaatagttaaattgtacattgaaaatagttgccaataataatattgcatatttaccaaaacttagagatagtatagcattttataaaatatcagatattaccctttcggaattgaatgcaataataagggaaactagatttcatggaaaataaaaacaattatatttaaaaacaaaaagttcagatttttgtgctttaatggaagagttccatatctggagttagttgaacatgtgttgagaacctagttgtgcctttggcaagctgtgtgacctcggacgatgtactttgcctctggaagatagtttcttccctgtaaaacatggcacacagggtgtggattaaaaaattaacactctcaatgaattttagaatgctagaaatttctagatgataaggaaatcttgggtaaggaagttagttttcagaagcaaaggatgtaacacaacccatgagtctttaagggcatgctgctaccgataatatctcacattttatcaacatttaataatttatgaattatttagcaacgcatcaacttcttcgattatcataacaatgctacgatgtagatacgttgggcattctagtcttcactttataggtaaggcaacagaagatcagagagttaaagtgacttgccataagcacccactgagacctcagtctgttaatacagttaaattccttgtatcctgaacttagcagtaaagcttgtctcagaaaatatactcaacaaagttgtggcatagtgctttggggcatcaattagttctctggaatgactaaagtctctgtcttctctacagtgcctttgtttacattttgattggatccccaaattgcttagactttatggaatcaaattttttcttttcatgtagtgtatgcatatacactgtcttagtcagctcggcctgccataacaaaataccataactggcttaaacaacagaaatttatttctgacatttctagaggctgcaaagtccaaggccaaagtgctttaaaggtaggtttctttttaagacctcttctcttgtcttatagggagccaccatcttgctgtgtgctcacaatgcctcttctttgtgtgcacatggggagagaaaatgagcaagctctctggagttttatttttataggggcagtaatctcatcataaggactccatctaaccctaattacctctcaaagtccccatctccaaataccattacattgggggtagagcttcaatatataaattttgggagacaccaacatttagtctacaacatattcattcatttattcattcaatagtaatcattacatacttagtagtaataacttttactcatttagcagtgaacaaagtagtttttctttttcaaatataccatacttattcgatctgcaaaacaatcctgtaagataagtaaagcagaaatttttatttccatcttacatatcaggaagtggagtctcagacagggaaagccaacttttaagcttgatttttgaattggagcttttgagttcaaatccaatactccatatacaatgcaacaaggtactatgaaggatacaaatctattcatttattcattcatgcaaaattttgacagagagtataccatgtgcttactataatcactgcagatacagcagtgaacaaaacacacagaatcatgctgccctttcggagcttatattctagatattgtatcctccagaaacatgcaatttggaagaacatgtgcacaaaaaactagagtacagagaagcagaagataaaaagccatctgagcatcaaaagcaagaaaatgctataggatttcaaaggacgtgcagagtgtttttggtataataaattcaggaaaatattcactgagagagaagcccttgaggtgaagtttggagggcaggtgaaatgaggatgtaagcaagaaagaaaaagagagattaagggttcgataggctgtcagttccctgaggtagagtttgttttgttttatttatctcttttaataagggcctagaatagatactggcatatagtcagtgctcattatttattgaattagcaatagatcactccaagcatagacatactatgaatgacaccctgaaggaggcaagagaaaggtttgtctatggagctattatgggaagagcaggttgtctaatgttcataacctaaagccaaacagaactatttttgtggtagagaaactatttcaactaatccttctgttttctgataatttaagcaggactcagcctagaaactgctttgcattcaacccatggtgcaggttttgatattccttccgaatgcctttcttataccactccaaaatggaattataacttctagagtttctggctctgtaatctcaccagatattctgatgagagaatgtattctgtctacgttgaggagcatactgaaagagtagcagcatttagtgcccagcgagcctgatgttgagttcatggagaaggccagagacatccaacttatgaggtctccccacttctatagtgtgctggctggtcccagtgggaatctcatcagcagagattaacagtgaggccataaaatagtttgcttaactgccaaatagccatgtggaaagtgaaagctcttccagcaattgctggtgagtgtcgccattgcactgcacaaatatacaacagagcaggggcagctcaagaagccgctcatagtgggcaacagcagatgggcagtgcagagcagcatgctcaggatgcaaaagctcatgtccgtccactctctttaatgtcacacagcgctctgaccaggtttcgccagatcacctaaacctggagagatactccagatcctctaactcaataagagttacccactttaggtggtttaaggacccccatttctaccagccatgttataagcacaactgcatatacacattcctcacttcctcaaccctagtctattagtttaccagaaaacaagtcatcatgaagacagtttttttcctgcggttggttggagttatacctcttggtggaagcaaatcaggcttctctttcctctctaatccttttgactatcaagtttatctgactttaaaacttacacatagccacatgacctataccaaaaaccaaaaaacaaatcccaacacacataaacatacatgtgcaaataatcatttcagtttatttgattgtcctacagtcctgccttaaatcccaggatggcttttccatctacataatgctagggagtgatactgatataatagagataaccttgtttccactttaatttatgtaaaatagtaaatcatttataaactagtactataaacattagaagtaacaaattactgtggcaaatcttataactactgtaattattatgtacttggtgttatagggccatggaccagaattactattattttgttttgttctgtttgttttttgagatggggtcttgctctgtcacccaggcttgagtgcagtggcatgatcacaggttcgctgtaactttgaactcctaggctcaaacaatcctcctgcaacagcttcccaagtagctgggactacagcatgagtaatcatgtctgcctattttttaaaattcttatttttagtagcgacaaggtctatgttgtccaggctggtatcaaactcctggtctcaagtgattctcatgccttggcctcccaaagtgctagcattacaggcctaagccaccatgcctggccccagtactactgtttataaagtatattgaggaagatgagatagtttacatgtctgagtaccaacagttatcttatggaatcatctaagggtgatgctgccttacatgcacttatagcggaaatttggaagatgtatattcctccctttttcaggcaaattcagcagtttactgctattggtgccttggggttgaggtggggcatatatgatccttgggttgtacatttcaagtgtggtgctcagctcttaacaactattgccaatcaagtttgcagccatagtcactacactcatgtaacacgatatggagtaggctatgttctttctcatttctctttatagtcctttaatatagaaactgcaacaacacaatctttatagttttctactgttggtaccttttcaatcactctgctactctttgtacttatttactctagcctagctgctagttaattactttttatgtgtaaatttctctagtccttaccattttgtaaagtttttgtactttcccaactattctttagatggtcttaaatgtatacatttataatcatacgagataatttttatcaaattcctatctgtgacaagggcccctaaaaacactagaaggtgggtattgataggaaaattaaggctcacaggtattgtgtactttggcaaaaattagccaataaatgagtgataaaaactggatatacatccaggtccatttggttctaagagctgtctgtcacagctctttctgtgcgtcattctcttcattctaacaataaatatagatgtagatataaaatattgatataaaatatatttctgaattttatttattattgcagagtgaaaactaaaagagtcaaagacacttcaccaatgaaatgactataacagttggaggcattcagttcccaatgtatttgcatcctattatacactatataagtctttagacaatgtacatatgatcgtctggttagagcaaagattttcttgagacaagatataccaatcccatcttcatcctccttctacatatcagtatttacttgcacttttttctattcacttaacacaaagcatgatctattctggatgaataataaagaatactgactcctattttcctttttgtgtgctttctgggaaagggactcgcacaacatgtgtatgaactggcacagttgatgtcttgcacacaacatggagaatctggaaaagctacttctctattctgcattctgagacctgtcctctcttaagaaaatgcagctgcaagcacacatttcaaccttctttaggggtgttcccaagaggtgaccatgccagggaatattaagcagagtttgctcttgtttgtctcagaacattttccatctttgagtttcagcagaaaccaaaaccttcaaaatccaaaccatatagcttacttggtgaaatgacagctcagtacagaaatggatcttgatgaactatttcagctagactagacctgtcaggccaaaaggtttagtgcaatttctctggagtgaagaatcatatatcccttcccagtaggacttcaaaatattccatttcctgactttagcttttaaacaatagccactcggtaaatgaagcagaaattctccctctgatttttttattgttattcttagatagtgaggtaggaacacagaaaatatctgttatttcatctgtaccttctccagtgtaaaataccccagagtcttgctcaaacattattgctgagggcccaggatctgttctgtttttcaatatatctggggctgggccacttaatgaccagaaagggcaggaatggacaacgtagcggtactcatggtgcttttaggcactctgatagcacgatatgccatctgcggttttctctctggcccacttcttaattctgttcaggcctgtcttccctccagtgttcatggactggtttgatatccgcttaagctcccttggtcttcggcttgacttcttagttcacatctgcatgctgattcattacatcttcaccagacaccttggttctaggcttagctgacctggacctcagttagataccaactagacggtgtgtccagcagaccccatctccaatactattcctgaccacccactaggcttctgtaaggcttaccagcagctgacgggatggagaagggcgcgccaaagtccaactctcaaacttatcattagttaaggcctaccccgtattagctgctgtccttcaaatttaatttcttcacattttccttgtctgttaaatgaggatgaaaataactagcctacaccagtttccttgtagggataccatgagttcctacatacatgaaggagcttcataaactgtgaagtcccttgtatatattaatagttaaaacaaaaacaaaacaaaactcttttaggttagttctctgctgccctctcctggctcccagtttccataactatgacttcttagtgggaattaaccctttaagtcttgaaagcttcagaaactagatcagtaattaaaggaaccatttttaaaagatacattcttgttcgtttacagagaaacataagccacataagttgactgaggttctcctaaaatctacttgcatttagagtccaactcttctgaattgtttttctacttagatttctttatctctgagttttcccagtcaatcttgttctttgggacaatcaagaacattttgaaggggccaggagcagtggctcatgcttataatcccagccctttggggagctgaagtaggaggatgggttgaggccaggtgttcaagacaagcctggacaatatagccacaccactctctctacaatttacttgttttaaagaacatttttgatggaggttttcttgaaagggtgctctactattgtcttcagaatattctttcaaaataccagtattcattcttaagttttcaagctgggttgtcttgagcatatcagaatatgtcaatgaaagttttttggacaggacaagtaggactcacattctttcctggaagcatttgttgactaattgcattgagggaattctgttgtctagccgtggcaccaggaataatattaataattgttttcataattaggcaatgacaactgcagcacaactgctgcctggctgacaagagtttaaaaaggtgtcatctattgtaagaccaaccttgacttcagagaagataaaatgtaaaaattgtgcaccctaaaattgatgaatatttcatctttttgataatttagcagctaatatctctgtaatgatagtgtaaatccatgcaatttgtcatataatgacttctagaatatgatcaaattttagcatgtctagaattcactagcatataatgccattgttcttcattctgcagacctttattggatcatgtcgtacatgccaggtacttcactaggcactgaaggtattgctatgaaagacatggcttctgtcttccagaacataacagcttgtaatatatgttcctcattagtggagagggtgttcaagtcatataccagaggaagtacatagagacttactgcagaaaaatctcatataagttagttgatccaagtcatctcaatggacagatgaaaaaacccaaagcctatagagattagtgccttatcccatgccaaacacatgcactaattaatgcattgtgtgttgatttttatgtgatattgtagaaaccaattttagtggaaaagcttaacatgggtgactttaaacttttactaaaagaagatttataatgcattagttttattttgatggttttattttatattttatatcagaataagtgataggagtggggaataaagcattgtatctttttctctttgttcttttaaagtacacaatttaatttttacttttgtattatacaatattttatacttataaaattatatttttaatgtattatatataaaatatatgaaaaatgctaataggacaaccacattcagaaatagggtgttttctacatcactgaagtttctcatgaggccattcctttctcttccactcggaagctatcagcattcagaactttttatcattccctggaattccttcatagttgtaatacatatgtatgtggcttgaaatagtgtttagttttacatattttaaaattctgtataaggagtatcaaagcataggtattattcttacatcttatttcttttctacccaacatactgtttattagattcatgctgatataagtagcttattcattccttttattgttgtttagtaatcactgaactaaaatttatgtatccatactattgttgatagaaatttgtgttacttccagtttttatgattataattaatgctgtacacttattctgttgtatatgtgaaggacttttcctagatcatatatctaggaaaagaattgctagttaattaactgtgcccattagtaactctactggtaatttatagacaccagatatgtatgcatgttctcgtttctccacaatctcatcaagatttgttaataaaattttaaaaatttccaatgttgtatgtataagacattatctcattgtggtattaatttgtatatcctagattgaacatgagactgaatatcttttcaatatttcttgttctgctgagttttctagtctatgcactgccagtttattcttttgcctgtttttttctttcaggttgcttgtcttttctaattgatttgaagaaattctttatatgttacacatactaattcctttttaattttatatgttacaaatatattctattatttcatagctgcttttctcactttttgtgttttctagtagtttataattttaaggtagaaaaatttgtccattttttcctttaatatttttgctttttgtgctgtgcattagtttgaagtaaatatgcctttttcccatatagattaacaattattctagcaatatctattgaatggctcatcttcttcctaataattgcaatattatgcctgtcatacatgctatttgtctattcctgcagcaggatatcctgtcttaattactattgttttaaaatcaatctttaaaatctggtaccacaattcaccccacattttcttcacaaattatattttcagagcctttgctcttctaaatactatcttagaactgtattgggattttaactgaaaatatgtttggttgatctttttgtttctcatttctttttatacctactggtttggtatttaaatacactagctccattctgttaattgataccattgaagcatgaacatgcatacttaataaaatctaaagttaatcagtgtctttaacttccccccaaacagtaaacatatctgaaaacattttaattctgatctcttcctagcttacattgcatagcttttttatattttacctcaagctttttttttcattttagtccaacaagttagatgttatgatgtttatttttaagaataggtttaaatctcccaacaagtatgtcttattttatttttgatcacattcctttcttcatgtcagattttctctgatgtcaattatttacttctgaaacattctctaggaagttaaggtcttttgctgataaattaaaaaaaaattctggaatggaatttatttccctctggttcttaaaaccatagttttattgggtttcaaatttttgattgtcagctatctttggagcacattaaaggtccattccactggcttctggattccacagttgttggtgaaaagttacctgtcaaactcatttctgatgctttgtaggggagccatcttttcccctctggctgcttttaggggataaaccaaggggttcattcttgaaattctaatgtctattatttcattgtttgttctggtttccaacaaaagacattggaaattgtgcagtaaggttgaaaatgggaatgcatagtgacagaagtaagtaggggtactttttaccaacattttgacgtgacttaatgaagtttgactgcacagcttactggtttctaccccatagaaaactacagtaagtgactctaaaacaaaaacattttggcgatgtgaacatgtggtcagaaaaataaaaaccagtctgaaatcacaagaaaactgacagtcaatggaccaccaagatgtgtttccactaaatggtatacatacatacaagtaccacaaaatcttagataggaagtaagagttgagtaaggcccagtaaagagatagagtttgttgagtatgatgaattatttcccagaaaatcatgaaatatattttcatctaatcaagtgagtcttacaaaaatgtgctcccattttgtatactatcttatagcaaaggatacgggttggacagcttatgaatccacatgtatacactttatatacatttgtcacattttattcactcatggattcattcattcacttaaaactattattaagtccatctgtgttctgggaacccatgttcctatttaagtaaatgcatcaaaactattatcttatttttttcatagagataacaaaaactctcaggctatgaaggcaattgcaatgcaagtatgctatttaattacttggggaagagtagtttcattaaaatgtcagctaaattgagtagaaaagatgcaaaaaaataaaaaccaaaacccactccaatgttatctagagatttttcaatggttttactttattatttgatatggttgtaaaaaaagaaagagaagaaagaagaaagaagtagaaaagaaagataagaaaaggaagaatcctcaatctaataacctcatgctcaattttcagttacttgtctttgtgaaaatgaacctactctactgcttctttgaaggaaaagagcaggcctgatttcatgattaagcgtcaactctagagaatgatgtggttgtaatctgtctgccatatgtgttatggttaagtggtggtttaacatatctttttttgtaaaacttaaagcttaacaaataaacaaataaataatggctcttgccttaaaatatgctggtaatgtattgacagagaaaaacataacccttttactcctatttatattccatcatttctgccagtgagaaggatggtcaggctagtaagaggagcagatatttgcgagaggaaattgaagcccaacaagatgagttaacactcaggaagtgtgtgtctcctgcccagatagaactgcaggcatgcagggcaactgagaggatgtgcagtttagtttgcagagttgctaccagcaatgtttgaggaatatggagagcagaataggtattaaaggactgattaggacaatatgatgatgaaaaaaactttagagaacttaaagaaatgtctaaatctgatttttaaatagactatttttttttaggatttgtgagcacatggaaaaagaatagtgatcctaggagctaccatatatgccttattgacaaattatgttatattgaccttgctttattttgggttaagatctctagactctgccgggcgtggtggctcatgcccgtaatcccagcactttgggaggctgaggcgggcggatcacctgaggtcaggagtttgagaccagcctaacatggagaaacgccgtctctattaaaaatacaaaattagctgggtgtggtagtacatgcctgtataatcccagctactcaggaggctggggcaggagaaccgcctgaacctgggaggcagaggtggcagtgagccaagatcgcgccattgcactccagcctgggcaacaagagcaaaactctgtcaaaaaaaaaaaaaatctatagactcttctactgaaatcttataggccaagtgggagcacatttcagcaagacagtttgtagaaaataatgaagataaagatgaaaatatgggtgcaatgcctttacagtttgatatatacataactggtggtacccaaagagaggtgtgatgtctaacacgagggagctccctggtaaaatggtcctcctctgattaaattctttaaattaagatttaagtgaagatatatttgttaaatttgcaggtgacaagaaacttgaaatactactattaggctttaaagcaggatcaggttttaacacaatcccaactgcctaaaaagatgaaatttaatatagataactggaaaatctagcacttgaatataaacatgatttactgagtaaaatttaacttagcaggcaaaaacaccagggttttaggagagcatacccaatatgagaaggtgatgataaaaagcaaccagccacacccaaaagactccaagaatgtcttggtgaacacgagttaaccagtctgaaggcactgtgagccgttcgtttttatttcagattttccacgctcttttcagttactctaaaataactaacaatgctctttacctttataaaactactttatcgtttgaaagcttatgctctctgtccccttcctacactttttgtttggtttagagcatagtaaataagcacaataattttttagatctcctctgctgcacttaatacttcttgtttataaaaagatacctgcaattatttttatccaggatagatgtgagctcctggaggttgaactgccacaagtttccttataagtctataaatacaggctctgcaactgatctcatttatttccaaggttttaaatgccatctgcatggtggaaacttccaaatgcacatctccatctctgatctctagcttcctttgtcctgcatccttgacatcttctgttgcatgtcacatcaaatataacataactccaaacagaccatgtgatgtttccttctaaccagcttagctgtcattatgcgacatctcagtaaataatatgagcctcaactccgttgccgaagtaaaaaatgcaggtatcactcttgatatttgtcttccctttacaccctgcccatcatcaagcctgtcagctctacctccaaagtaactcttgataacaacccagtctgtccctttccactgttatgccatagtctaagctaccaacatctctcattatttccaaggctttctatctgattctctgatttcacttatgcctcccatgggacatgttccaaatagtagccaaagttgtctcttaaaatacacatcatgttttcttatgtctttgcttaacgttattttatggcttttaattgcaataataagaatactgaaatttctaccatggcatatgacctcctacctgatcgggtctggtggagtttttccagcttcttcttctgtcgctcttttacttattcactagaatcaactcacgctggcttgctttctattctttaaacattccaaactcattcctgctttagagactgtagatttttctggtctctttggttgaaattctctgatcccagatttttaaatggttgttttcttcttgtcatttgcatcttagttcaaataatacctccttaaaaaaaattcctaccttccccagttactaccagcacatcctatttgaatgacaccaaagcaagtatcaccatgggaaaattattttgtttgtttctttattgactatctcccctcacaaggtgtagacagaataatggggtcctatctgtgattgctaccactgcacccttaaagcctggaacagagcatggcacatagtaggcaatcaataaatatttgttgaatgatggattctataattagtgaagagaggtctaaagtgtaggttcttaaattctaaaaagaatgtactcttactcagttaggacaaatgactgatagcagatactttcagctttaatgggaggaggccatgaagagaacagaaaaggcttgacgttctgaagtgaaaacggtgttagtcgttggatgacagcaaatgggatagagtatctgtggcaggagaaggtagcctggaatagaagataagttgcacttttattaattaaagtttagaacttcctttccagaggattcactaattgaaaacaacaacacaaagcagggtttctcaaccttaggactggagacatttggggctggataattctttcttgtgcgggctgttctaggcattgttgaatattcagcagtatccctggcctctacccactagatgcagtagcaccttccctgttgtggcaaataaaactatctccagacattgccaaatgtccccagggggaaggagaggcaaaatcacctctggttaagattcaatactcaaaaaaaaaaaaaaaaagttcacattcacattttattcacatctatctaatagacaaaattatttgtaataaattacctcttatgatgaaccacttaacaatcctcaagcaggaaataaaagagggaaaaaagtgcctaaattttagagcttggtaggctttcatgtggtatataatggtaatgttcatttgggcccaattgtaaaatttcaacattaaaagaagaaaggtattttattcaattacaatttatggtcactttgaatacataaacctagaaaggttttgtggaattctggatagagaacgagctatattgatggaaatctcagctctgttttaaaatctcagctctgctacttacccgctgtatgaccttggatgagttacttaatgaagctgaacatcaccttcttttgctgtaaaatgggaaatgcaatccctatattttagaggtgctgtaaagattaaatgcagtaaaattcatgcaaacagtccagctgcatgtgtagcacactctctttgaatgttagcaattgtttttttttctaaagtaaatggcctttttcttttttatgtcatataaaagtagctaatgcagatgtataccatgatacagaattaatatacagtgaaacacactaagggaatgccttcattattttcaggcaaatagcttttgacaggagtcaagtatcaattaaggtactgtcttctgattacacatgggacttcttgatcataaaaacctctattagatgtgatcctttatgcttttgacacatgctatcacactctcaactttgtttcgttgaggtctatcttcctgccagaagtaggtgggggtagtcttctgtcaccttggattttgaagcccatcaaaggcaaaacaaaacaaaacaaaaatcaccttctgaaaccttattaagacacatgaaattttaggctgtcatctttgttgattttgaaagatctcaactctaattggtaatggaaacttaagtcatctcatatgggcgcaggtatgataaccagtttgtgcctaaactcagtacaaaattttcaacatgattacaaattgtcagatttaaaaaaatcatgctgttggttgtgtgattatgggtcaaacttttaatgctatctgagcacagaaataagtcacatcttaatacaatttttttttcatttttacaaagctgtgagtatgatttctagctgtaaattatgggtataacatttgagtaggaatttgcaatgagacattttgaaagtggcagtaaacaaatggacaaatactagaggctttgaaaactttaaactgggctttcaaagccataattagtttttctaatcagagttgtattatttaatttttaaaaactacgttctattctccacttcacaatgagaaatacctcagttaaagaaagaacatgttctctctctcactgtccttccctctctggatctctttctctccctctgcgtttttctgactcatatggtttcccctctgtctggattgtcctgccatctcattatccttcagtcggtaaaatcagagccaaaacactaaatgtaattgtgcaacctttaaggcttgtgtttctggtttcaaattttccctctgttagcatcttaatgacccacactgatcattattgtcccctcctccaggtatactttggtactcccatagcactggtgtttacctctgtctttgcaccagtccatggtcctgtaactccttccttacttgcctgattctctactaaattgacggcacttctcagacttcaatacccacctctaagagtagaattatatgctgagactcacatgcattgctaaacattacctcccaaaacaagattcccagataggacctgcttttggtgagcacaaggacatccctgtgggcaggaagcctgagtgtttgctctgggaaagccctgtagggctctgtcattcctggctttggccccagctccctttttgactctagacaatcgtgcttggtcgctacaaggagtgatcagtcttctcacctggctctgcctctgggtgatggtgagaaccttcttcaataagctgcttctgttctaattttgaaaagactctcctgagtggttagattataagaacaggggtgctacttcctcccccaataggttgactattatggattacctgttaattgctatagttgccagcacattttacagtttcctctgtggcacagagggaaagccaggagttacatttctcagaatccccttctctttatggttgtaggttagatttggccacataatggttcaataaaataccacatgtgaaatgccaagcataatgcctggtacagagtaagtagctaatcaaattggagtgtctttctttctcaacttttgttaccgatgccacattaagggcatacatatcaaatttaatgaatttataaccttcagaaggccatcagatatattcattaatcaatagtattatttttttcttgagtttgttaactatagtaattgcaaaacctggaaatgacctagtgtgaagtcaaagtgaaaaaggaataaagaacagttaagaggatgtatgtgttgagaaattcaaataataagggtaattgtacactgtgtgtccacatcaagattataatctgttttttaattaactaataatgattatgctataattttactgtgttttgcatatcctcctagaccttcttggaccttagagtacaatctgatgaaatattaattaaaagaaaattaatatttctgtattaatttctgtgcattctataaagcaatggtagggaagaaggcaaccatatatacagccctcagagcatatttataccgttttaaagaatttgttatagtctagtttagggtgtttcattgttttaaaagagacaactttgttggtactaaaatcattctaattatgttctttgttttatttggcttttaaaaacaatttaaaagtatcagtcacttggtatctattatgcacctgcaggtgctgagctctcacatggtaatttgagacaggggggcaaaagataagtaaaatatttataataaatacgaattggatgagtctccattccaaagaaatacctaaattgatatcaatcacatatgctaaagtgaaggaaggaaattagcagttaacatatacctggtatacgccaggtacttatcaatattatcttaaatttaattcttcaaattaaagtattctattaaaaacctatgaggtagactttcttattcctatttactgtatgaagaagctttggctcattttgttcaagactcccagtagtaggtgaaaaagctagaatccaaacccgctgactccagatgctgttttatctgtactatggtatttacctctaaaaaaaattaaattagttttcattagttgtgtcataccaaaagtatggtcttgtacctagtagatgtttcatccagcactgctgggccttactgaggtccatgggccagaaagtctgtataaataattttcctgggaaaggagaaagccaggagttatgatggatttgaaatgggtgagggcccttggagaaggaaagtatgagaagatcttttgcaggagctggcacattggcctagttcaaaattatagctaccatgaattgctatataaggtactctatgagcattttacacataatatctaatttaatctttaaaacagtctgtggaccaatgaagcattattgacccagtattacagatgagaactcagagacagagaaagctcaaaaaacttgcctatggtcctacagagtctagctgatcctgaagttcatggtaatgaactttatactgtattttgcaattaaatattagactatattctacaatgtaaaatgctcaccaaacttaaatttgattgcattgagacataaatgtcatactgtagaaagtcttgttttatctataactcccaaaccatggtggcaattggagaagaggggcccttccacctgacccattcctgatgtcttcaaaacctttgtgatatagaagtatggagaagatgtggcttttacatataacctttaatggatctgtcctacatcttggtttcttttctgagggcctctagggtactactagagctggctttaacgtgagaaagcaagcagagtaattgtttatcactgatgaaatgcatgtctggtgtatcagaaaataaacacttgggtttgaaagtgagaagcaaagtggaccaaatggactgccttattggaaccactgctggccattctcagacctcactggaaaagctaaggcagaatatccctataatatagaaatattccagcgatcccagagaatgaggcatggaaaggagggtaggcatctcattacctcttgagagtgatcaagattgcaggacccatctgagacagataaaatctttaacatgaaaatggaaatcctcaagaatagtgtgtggttaacacatgaagggaggcaaagaaagggacgctggtgaggtattttactgggcggtatgatacttgaattcgtgagtgtctataaataaaatgaggtagttctctatgtactgacatgaaatctctaagataaatcattatgtgaaacaagtaaggtttcacttacacgaacaatgtgcatgggtagtatgtttatattaaaataagaggtgtgaacagctgtataaaaatatttacatatgcttacctgtacataggacagccctggaaggacatatcccatatgcatttggacaaggagctagcagttaacagtgggagggaaacttacttttcactgaaacacttttatgtcatactacaagcatatattgtctcttgcctgaaaatcaacatttttaactataaaaaaatccacacgtctctgagctgacaaaattaaaacatatggaaaaatgctgcactatattcaaaatgaaaagatgacgctgattcagatttaaaaaatgatacaactcagaaaccagaaagaatgggaaaagcctatatttcattgttctccattcaaagccgcaagtacagagatataatctttacaagataagtagccaatataactaactttaaatgaagtttttcctttccaaacacctgcaataagctttcctcatttgaaacaaagaatatatttctgggcatatccatgtgtgaaagttgaacctcaggagatcccaatctcatttctcctgcctaatgaaaggggaagaaaaattaaagctaatttgggcgtacttaatttcaaagttaaaagctctgaatttatatatgtcagaaaacggtcttgatggcaaatttttaaagaaaaaaaaacatgtcccaaatggtatcacacacaatgcagcaatccctggacgagtgagagtgaaaaacttgagttccaacttggccacaaacttatgagactttaacagagtcactctttttatttttcacgtcatccatctcaaggctataattttattgacatttccttcagtacaggcaaggcttaaatagcaagtattctagattgattataaaaatggctccaattctttctttccctgtatccacagcactcacaatatgactttgaagttattttcatgacaagagtctatttttccaacctttggatcagagttagacttgtgtgacaatgtgccagtttcaagcccaggcttcacatggcctggcatgcttctaatcactctctgctgtacctttggacaagtccagactagctttttgaagaaaagaaagcataaacaggagagccaagtcatgtaagctgaggccatcccagaccagttagctcctagtccacttgccagctgactacagatgcatatgatactccagcagagataagatgagattaactgagcccagactagattgttggaagtgcccagctgacccatagactcatgaggttttattgtaaattacttgctttggggttatttgttatacagcatttttgtaacaagagataaactgtataggaagaaaaagcacttttaaaacaatatgtgttttaccaatatttcattctaatcatcactattaattaacatttcccttaagggtaaaaacgaatacctctaagcagaaatataagtaaaatatattcatgagaaaattatttttcttttgagttccctaagattgaaagtttacctgtgacttagggtgagattctttcattcttcattcattcttggtcctatctggggaatcttttcctggaatgatcatgaaatagatccctatgtgtggtgttcagcacccagatacaggaatatgccacatactcaacatgcatttccattttcatgccccctctcacaactcagccagctgctttgagccaagtacaccagtggcccttacctaattcctgagacaatcttatgggaattagcatttcattggtacatatttccagatttgtgtgttcacatttccagtcctgtaacatgagtaacccatgagatagctcctagtcttcaatagccacaatttcctccatggctacctaagatactttagtaccagtaaaagaaactctttggtttcagcattcccaatcactataatataatgactcagtacagaataataggcatctgttctgataaccatactattccttgacagttcatgctatttggatgtccagtgaagcaatttaaaggaacagattttggagttcaaatcgtggctctgccattaactaatttcggataagagatttaattaatctgaacatctgttttcttatctatagtattgggataacaatacctcctgcatagggtttgaggagatgaagaaataagattatatatatataattatacacacacacacacacacacacacacacacacacatataatggtttagtacaactaatgggtacataaatggaaaaagtgatggcacctgaagttcagttacatacaaggcaacacattggacctgcttctagtatatacatttggaccatggctaagactgctatgccctttagactctggccttcattgccagactaccctgataaaagcaaaatgttaaaaccaagatcttcctttgcaaacaccatagtaatctgcattccatctgattctggttttcttccctcatccctctcccctaccttgggatccgtggatgaaatgtaggtatatcccaggtctaagtcctctgggtactgacagaaacacatattgtgcaacatatggaagaccacagaaatagagcctttagcacgggattaagaccaagcatgaagaaactgtatcaactaaagagcaaaataaccagctaacatcataatgataggatcaaattcacacataacaatattaaccttaaatgtaaatgggctaaatgctccaattaaaagacacagactgacaaactggataaagagtcaagacccatcagtgtgcttgtattcaggagacccatctcatgtgcagagacacacatagactcaaaataaagggatggaggaagatctaccaagcaaatggaaaacaaaaaaaggaaggggttccaatcctagtctctgataaaacagactttaaaccaacaaagatcaaaagagacaaagaaggccattacataatggtaaagggatcaattcaacaagaagagctaactatcctaaatatatatgcacccaatgcaggagcacccagattcataaagcaagtccttagagacctacaaagagacttagactcccacacaataataatgggagactttaacacaccattgtcaacattagacagatcaacgagacagaaagttaacaaggatatccaggaattgaactcagctctgcatcaagtggacctaatagacatctacagaactctccaccccaaatcaacagaatatacattcttctcagcaccacatcacacttattccaaaattgaccacacagttggaagtaaagtacatcttagcaaatgtaaaagaatagaaattataacaaactgtctctcagaccacagtgcaatcaaactagaactgaggattaagaaactcactcaaaactgctcaactacatggaaactgaacaacctgctcctgaatgactactgggtgcataatgaaatgaaggcagaaataaagatgttttttgaaccaatgagaacaaagacacatcataccagaatctctgggacacatttaaagcagtgtgtagagggaaatttatagcactaaaggcccacaagagaaagcaggaaagatctaaaattgacaacctaacatcacaatgaaaagaactagagaagcaagagcaaacacattcaaaagctagcagaaggcaagaaataactaagatcagaacagaactgaaggaaatagagacacaaaaagcccttcaaaaaaatcaatgaatccaggagctggttttttgaaaagatcaacaaaattgatagactgctaacagactaataaaaagaaaagagagaagaatcaaatagatgcaataaaaaatgataaaggggatatcaccatcgatcccacagaaatacaaactaccatcagagaatactataaacacctctatgcaaataaactagaaaatctacaagaaatggataaattcctggacatatacaccttccaagactaaaccaggaagaagttgaatctctgaatagaccaataacaggctctgaaattgaggcaataattaatagcttaccaaccaaaaaaagtccaggaccagatgcattcacagccaaattctaccagaggtacaagaacaagctggtaccattccttctgaaactattccaatcaatagaaaaagagggagtcctccctaactcattttatgaggccagcatcatcctaatatcaaagcctgacagaaacacaacaaaaaaagagaatttcagaccaatatccttgatgaacatcgatgcaaaaatcctcaataaaatactggcaaactgaatccagcagcacatcaaaaagcttatccaccatgatcaagtgggcttcatctctgggatgcaaggctggttcaacatacgcaaaccaataaatgtaatccaacatataaacagaaccaaagacaaaaaaccacatgattatctcaatagaagcagaaaaggcctttgacaaaattcaacagcccttcatgctaaaaacgctcaataaattacatattgatgggacgtatcacaaaataataagagctatttatgacaaacccacagtcaatatcatacttaatgggcaaaaaccggaagcattccctttgaaaactggcacaagacagggataccttctgtcaccactcctattcaacatagcgttggaagttctggccagggcaattagggaggagaaagaaataaagggtattcaattaggaaaagaggaagtcaaattgtccctgtttgcagatgacatgattgtatatcagaaaaccccatcgtcttagctcaaaatcttgttaagttgataggcaacttcagcaaagtctcaggatacaaaatcaatgtgcaaaaatcacaagcattcttatacaccaataacagacaaacagagagccaaatcatgagtgaactcccattcacaattgtttcaaagaggataaaatacctaggaatccaacttacaagggatatgaaggaccttttcaaggagaactacaaaccactgctcaacgaaataaaagaggacacaaacaaatggaagaacattccatgctcatggataggaagaatcaatatcatgaaaatggccatattgcccaaggtaatttatagattcaatgccatccccatcaagcttccaatgactttcttcacagaattggaaaaaactactttaaagttcattaggaaccaaaaaagagcctgcattgccaagtcaatgctaagccaaaagaacaaagctggaggcatcatgctacctgacttcaaactatactagaaggctacagtaaccaaaacagcatggtactggtaccaaaacagagatgtagaccaatggaacagaaataataccacacatctacaaccatctgatatttgataaacctgacaaaaacacaaaacagggaaaggattccctatttaataaatggtgctgggaaaactggctagccatatgcagaaagctgaaactggatcccttccttataccttatacaaaaattaattcaagatggattaaagcttaaatgttagacctaaaaccataaaatccctagaagaaaacctaggcaataccattcaggacatagacatgggcaaggacttcatgtctaaaacaccaaaagcaatggcaacaaaagccaatattgacaaatgggatttaattaaactaaagagcttctgcagagcaagagaaactaccatcagagtgaacaggcaacctacagaatgggagaaaatttttgcaatctactcatgtggcaaagggctaatatccagaatctacaaagaactcaaacaatttacaagaaaaaaacaaccccatcaaaaagtgggtgaaggatatgaacagacacttctcaaaagaagacatttttgcagccaaaagacacatgaaaaaatgctcatcatcactggccatcagagaaatgcaaatcaaaggcacaatgagataccatctcataccagttagaatggcgatcattaaaaagtcaggaaacaacaggtgctggagagaatgtgaagaaacaggaacacttttacaccgttggtgggactgtaaactggttcaaccactgtggaagacagtatggcgattcctcaaggatctagaactagaaataccatttgacccagccatcccattactgggtatatacccaaaggattataattcatgctgctataaagacacatgcacacgtatttttattgtggcactattcacaatagcaaagacttggaaccaacccaaatgtccatcaatgatagactggattaagaaaatgtggcacatatacaccatggaatactatgcagccataaaaaatgatgagttcatgtcctttgtagggacatggatgaagctggaaaccatcattctcagcaaactgtcgcaaggacaaaaaaccaaacaccgcatgttctcactcataggtgggaactgaacaatgagaacacttagacacagaaagaggaacatcacacaccagggcctgttgtgcggtgggggggaggggggagggatagcattaagagatatacctaatgtaaatgatgagttaatgggtgcagcacaccaacatggcacatgtatacgtatgtaacaaacctgcacgttgtgcacatgtaccctagaacttaaagtataataataataataaaagtaataataaaaaaagtaattaaaaaagaaaaaactgaaaggcagttttcactatccaaaaccaagcagcgtctttccttacttgtatgatcaataataagaatgtgacatccttaaataatagtgaacattttatgacatagtattataaaaatagttactgtttactgagcccttctcatataccagacattggactaagtgctttctatgcatcatggcttttaattcttatcacaaccttatgagttaagtgctatcaccatttccattttatggaagggatgccaagataggctaagttacttgtatagggtcacacagacttagcaagttgaacaggtaagatttaaacccaggtagtcagacctctaagtacatgttttttatctctgtgctaattaccctgggtgcaatgtgcgatgttgccagggttctgcttttcaattaactcttagactagttctaaggctctgctgcctaagagaaagaaatgtaagaagcaatttatacagtgcgtttttctccagaatgaaaggactcatttccttgtcacagagctgcagacacctctgtgaaaaaaaatccctggtcattaccaagagcattagtggcaatctctgacaaggagcaaaggtttctttgttctgataatgacaaagatgggcacttgggtgaggcagaccgtgacactgcagtgtaactcgctttcagcatagcaacacgttagtttagggtcactgcgaaacttaaaggaagtcattcatggactgtatttagtgtggcaattagtatacagtaagtactcactaaacattagttttttttttaaccgtcacttttgccaaaacttttaatatttttctaattaattattaatgtcagacacattatgacacctttttaaccgtcaagaaacccttttgttcctggaaaatggctttttaaaagcccctgcttcttctagtctgaagatgcagtgtgctgctagcctaaataatcccttgccattagagtgtctttctcacactctcaaccaggagcattagtgtggcagactgagccacgagaaagcaagggctgctaaccacactccgggaagaccttgaaatgtgtctctttcccagtagctaaacatttttttttttatttaaccattgacaaccatgcaaaattttggaaatctgaccatggccactttttaggagattgtagtgaaggtacatgcttgaggaagattattatgtctcatttattacaaattctgaatcctccaatacatcttggatctggcagctagtagaggacctggcacatgctaggcaatcaataaatgtgatctgaacaatgagctctttgaaaaggccaaatggccaaatgttacatataattagcataaaatatctcccaagaatcagaattattttcacaaaatgtggtataatgagggtaacctatttagggaagaaaatgactgtaagatgcataagttgactgccaaaggaggaatagtaacttaattaaactatctagataagatgctggagaaaattttaactcttgtcaaatgaatacctttctgctgttgcttgtatttcagcaagctatagcaagtaacaggaagtagtttgcctatatttctgtaaggtattttcctcacctctctaacccagaatgtcccaaaatgacttcggtgtatgccagcacttataagaaaggccatcttgaacaaatcttctaaatttggtaaaaatctgttgagctgtattttgcatgatgaagcaatagagagagaaaggggatatgtgtgtgtgtgtgtgagagagagagagagagagagtaaatatttcattttatttatatgttttagactaggacaatctgttcttttgataatattacaatgatagcatgcatttcatatgtgtgctaaaggtgaacatagactttttttccattgagcaaatactagtgtacttaataagctacaattagaacaagtgttcaattttcatgtctttcattaacaacatttgagatgaaatcatactgaaaagtaggactcctctgtaccatactttttttcccactcaaccagaccctcaaagctaattgtgaagttcttaaaagatagtaatagcaaaagtcctcttacttaaattaagtttgcttagaagcataatgcactctacatggcctcttagaggacctaggagataggacataggtggacactaattgcataaaatccacttcagaagtaattagatgcctcaaaacctgtaatataatattttaaaaatttagtaaccatctaattagaattccacaattaaaagtttaatatttacattatgtctgaactccaaaattttccattcagatttttgaaaacaattacatattttatttcccttgaaagacagagcaacaccttcagtgtgactcccaaaaaccattgaagaaaaatatattcattagcctaaaaatatcctacccacaggagggcctatgaccactgaaatgctctgctatcatcacagcccaattagcagtaggcacagggacagttcgccgtatcccaactactcagtcagcaaccgcagcaccaatgttgtttttccaaggaaagcaggtggtgaatgtcataataaagataagcttaaaaatggaagggagcctcagaaataacgccgcatatctacaactatctgatctttgacaaacctgaggaaaacaagcaatggggaaaggattccctatttaataaatggtgctgggaaaactggctagccatatgtagaaagctgaaactggatcccttccttacaccttatacaaaaattaattcaagatggattaaagacttaaacattagacctaaaaccataaaaaccctagaagaaaacctaggcattaccattcaggacataggcatgggcaaggacttcatgtctaaaacaccaaaagcaatggcaacaaaagccaaaattgaaaaatgggatctaattaaattaaagagcttctgcacagcaaaggaaactaccatcagactgaacaggcaacctacaaaacgggagaaaatttttgcaacctgctcatctgacaaagggctaacatcagaatctacaatgaactcaaacaaatttacaagaaaaaaacaaacaaccccatcaaaaagtgggcgaaggacatgaacagacacttctcaaaagaagacatttattcaagatcagcctgggcaacataatgagatcccatctctacaaaaagattaagacattatccaggcattgtggtgtacacctatagtcccagctacccaggatgctgaggtgggaggatcacttgagcccagaggttcaaggctgtagtgagccatgatcacatggctgcactccagcctgagtgacagagcaagatcctgtctaaaaacaaacaaacaaaaaggatagttctgttgcctacaaaatggaataatagcatctacctcacagaacagtaatagggattaaataagtgaatgtctattaagtacttaggataatatttatggtatttgaagctttcaataaatggtagtaaattactatcattaataatgcattagacacatttacactacatatgtaattttattttcatctcttactccttattcattttaatttatggtaaattttagcttatgatttcatgaacacttagcagtggaaaaagaacatggaagatctcatataaatgctccaaaatggaaattacttatgtcacttcttctcacaattccttggctagaagtggttaaatgactgtacccaatcacagggtagaaagacagaaagtattggctttgtagtgcctagacagagagacagcactaatgactaccatactcaatcagtcacttacccacccacctacctacctactcagtgctgatccggtgtcttttatatgtcaggcactgggctaggtcctggccaggcacagatgagtatatcctgaaggagttcaaattgtacttgttgaccattccaattgcatatactcaaacttatatctaaacaacatggaaaacactgaaaattttgtaatgtcttggcattcatctgactccgacacacagattgcttcaagaaatagccctgaagtgaggcgaatttttaaaatgttttcatgcttaacttgtcatcattataatagtttactgacctgttctgtatgtacattaaagcacatgataaaaaggaacttatttattgatacaatcattcagtaattaaaaataattgttttgcctatctttattataataaaagaaacaaaattgaaaaaaaaagaagacatttatgcagccaaaaaacacatgaaaaaatgctcaccatcactggccatcagagaaatgcaaatcaaaaccacaatgagataccatctcacaccaattagaatggcaatcagtaaaaagtcaggaaacaacaggtgctggaggggatgtggagaaataggaacacttttacactgttggtgggactgtaaactagttcaatcatcatggaagtcagtgcggcgattcctcagggatctagaactagaaataccatttgacccagccatcccattactgggtatatacccaaaggactacaaatcatgctgctataaagacacatgcacacgtatgtttattgcggcactattcacaatagcaaagacttggaaccaacccaaatgtccaacaatgatagactggattaagaaaatgtggcacatatacaccatggaatactatgcagccataaaaaatgatgagttcatatcctttgtagggacatggatgaaattggaaaccatcattctcagtaaactatcgcaagaacaaaaaaccaaacaccgcatattctcactcataggtgggaattgaacaatgagatcacatggacacaggaaggggaatatcacactctggggactgtggtggggtcgggggaggggggagggatagcattaggagatatacctaatgctaaatgacgagttaatgggtgcagcacacccgcatggcacatgtatacatatgtaactaacctgcacattgtgcacatgtaccctaaaacttaaaatataataataatgaaataaaaaaataaaagatacacaacctcttaaaaaaaattgaagggagcttatagggaaaggatgagatgagctggatacctagtttaaggaaagtctgccaacaggccttgcttagccaatgcttctcttcattcattctattttaataaaaagatgtttttaaaaatcgataccaaagtccaggtgcagtggctcatgcctgtaatcccaatactacgggaggccgtggagagtgcatcacttgaggtcaggaatttgagactagtctgaccaacatggtgaaactccatgtctactgaaaatacaaaaattagctgggtgtggtggcatccacctgtggtcccagctactagggaggctgaggcagaagaatcgcttgaacgcaggaggctgaggttgcagtgagctgagatcttgctactgcactccagcctgggtgacagagccgaactctgtcaaaaacaaaaaacaaaaaacaaaaagcaaaaaaaaactctataccaaaaaccattgaattttacgttttaatgggtgaattgtataatatgtgaattatatatcaataaatctataacatgtcatatttctttgtcactgtctgtttcctaaacctgcaccacaaatttggcttgctgtctgcttagcactttcacatcagattatatacttcttagcacctggcctttcctgatgtagggtagttacatccttcaggcatggatctttcttttttcgtctatatactaaatatcctctgtgttattctgatatttttatgtgtggatactggtcactggccaaggcacatgtgaattataagagtcaagaatgctaagccccatgtggagatgcttagagtaccagttggtaggtgttaagcattataaaatatcaagagttcacaaaacaatgagaatgttacacagaatatgtcaagtggagcaggcaaagcttgcacctgtcttgacaggggtccacagcttatttgagatacagaatgttttgataatggatggtgctgatatgggaggaaatggtgaatatgtttgtgttattgaaaaaaatggggtgaacatcctgtgtaaccttcagttaggctttttggctggctttgaaatgtatttcatgctacactgaagctggtgggtaagggaatgaaaacaaacccataggaacttcaggtcacattgattctgaattcaaaacattatgctaatagcatagaaagactgtatgtactagataggacagtagcaataacattagtattactagttaaattaacataatatctgaaagctccacaaggttccttacaggtgatttttttttggtatctttcatctgtacctaaaagccatagcccctattgtgtgtcctgggactgactatcagtggagcaaagcatctagtgattattttaaagtgccaattcacggatttgaataaatacaacaaaatatcagcaaacaaaaaggctttttatttttgaaaaatatttatacaatttgtctgtgctttcttgttttttgttttgttttcttataccctaatgtttgttccatgatggaagcttaaataccacgtggacaagtggagaagaagcttaggcttcatcttctcccttttttcctacatagaatcaatgaagagttctcactgacttagccattgggataaattgatactgtccaatctctccatcttagctgacaccatcctggcccaagccaccactgtatctacttggactatcacaatactgttctgtcacctcagaattatgtttgttctactctctattgaagcaagaatgatttttaaaaggcaaatatgataatattagtctttaacactcttaacacccaaactatcctcatgaaatattgattcacactgataaaatggcttttgaggccaggagaaatctggtcttaaaaaacctacttctccaacttcattctccaccactgcccccaaagttgccatgctcttgccctcctgtcctcttgttcaactcagaccctttactaatgctgctccctctgtctgaatgttctttcactcagttgattgctgcacattttacaagtgtgatcatattacttctacaaataatatgtttttacctctgaaaatctactgtgttctctgctatcatagcatcatgtacttctgctcttagcacataacaagatcatattcaaaatattattgtggaagtatttgtttcaaatctgttttcccattagattgaaagctctgggggcaaacattgtcttattcactggtatatacttcacacctagcatcgtacctaaaatatattggaagttcaaaattatttgacacataaaatcatgaataaaatcaatagagtccccatgaaagcttctctttctgtaatagcaggtgcaccacacatttcagagcaacaaaaatctcttacaatgtgagctcttagcatgtgctaggcactagatatgcagagacaaatgcaatgctccctgctttcaaacagctaactcatagtttagagggaggtaagcagagggcttaaatagataaatcagagtaaaatgtagtaaatgctaacatggagatttgaacaatgttatgtgaagtagagagaaatgaacacatgctgatgaggaactaaaaacttgccctattgtaaagatataaaatgtagtcacatttgagtccaaaaagaaaattaattcagtgttcagtatgtagaagaagacaattctagttgggcacactactatccaggcttgtttgtggccattaatgtttccttgctaacacagaaccaaagcataaagacccctgtgcaaattgaggctgtagttaccttattcatctcagggattattgcttcccatcctccactttgaattgtcttgccttccttgagttgattcaacttctatcccacaaaatccttcaatgtctgacttattagaattgatgaattgactgggaatgagctttgcgtacgattgtgtttcatctaagttctgttttcatgtttgctcttattcgccacccacgaaaactacattttggcagtgtattttagagggtcattgcatcggtcaatatatgagtaaatgaagatacacagataagggtagagttgagaggaagctgagtgagcaactgctcctttgaatatcttctaaaattacacattttttttttcaattttaggggaatatgatgttgaaatgatttctgtttttaaagaaaagataaaaagaagttatgggaggcattgtgaaactaaagctatgagacaaagagagaagacaataaaataacatttgtttttgatacatatggtctccctctccactgctggcctatttctctttatagttagaccttgactattgatggggtgtccatcctagatcaaaatcttgagtatacagctccagttttcagctttgattactgagtcctgagtttgctaaaggctatgtatttttactaacagagcaaccaaatgttagtatacaaaattaaagtaagacagcacttcaaaataaactataaacatgactttaagtaggtcacttcaaggctattgctaggggagaaaaaggcttctaatttcttgctattgtcaatgctgcacagcctaatacctcacagtgtgaagagtaaattagaacaacttttcactgacaaagattaaactttttcatcattcctaaattcctggggatttctcccactgcttctacatgttttaagcttttcaattaaatctcctgggtattggttgcaagaatgcccacggacaagggaatatttgtctctgggagagttaaactattgcaacagaagtttgtcttggttactactgtatgggctaaatctctcagcaatagtgccttatcagcccacactgctagaagccaagtgcggattacattcccctgccatcaaaactgaactaatgatacatttagtttggggaagagaaagagtttatgaaaagtcgggaagtcaagaacagtcaaccttgataactcacttgttttccctgggataatttattttgacatttaggagtcacgcaccaggaatataaaccctcatgaacatgctgccatagactggtgtgacaaatataagcttctgccttccaattttccatcagctttgcctccaactcaccttgatccctcccactgagcattttgaatgctttgttcggctgccacagagaccacgttggaatcaaaactgttttggtctgtcccagggcaggagcagtcaattaaaatcagcttagaagcagccctgggaaaggctgtattttttttttttctataaaatatttctggtgggactatgggaaaagacagctttcaattttaaacagtatatacgcttgaatgagagatcaaaacagccatgtgggaaactagtaacttggaaggctgaggtggaaataacaataatattttaaattcaagtattaattctgattgaaaaacacaaaccagagagggggatccctagctgccagaaatgaggtaaaagatgaattcatttaagagatctttattttttaaaactcaaaattgccttaagcaagaaaacatttgcaagatattacagatgggagaagagggcaaacggatcagtaattttattttaaatatgctgtatgtgtttaattagtttcaaaacaaggatcaatgtgagagactgcagctgggaagggaaaggggttattaaaaaaaaaattgagcagcttaaaaataagccaaattcagatttgacagacacttacaacccacagtatcagtgataaattgggcatcccaaaccataaagagccatacgagtttgatccctttttatcactaataagcataaaaaatgttcactagcctgttttccaagcctttattcacaatagcttgtacctactatgactatttgaaagtggaatgtgggagaaattaagtggacagacattcttccatggaagcctggcagtccagcacttagcaatgaactaagctttggaaatggaagagctgcagaactagtatatttcagagtgattattctgaatatttctgctttagaagccaggctggtatgttaactctggagaatccacagtgaattcaaaattttctttggtttgcctcactacattttctactcagcttgattcaaaacatacttatatataggtcattagcattcttccaagtttagattagcctggattctagaagacttattagtacaaatttctgttaacttaaggtgtttaaaggtaaacatatgtaacctatgaaggtgtagcttgagattctttgaatttttatggaaagttgaaaagcataattaagtgaaaattaaagaaaaatgcatctgtatttttatttacatgtgctgtgttagattacataaacggtcatgattctccatggctcttttcatttaagaggtggaatctatttctccatctcttgaactggttggtccatggcttattttgaccaacagttttggaagtgagatgatgcaacttcccaaccgaggccctaagaagctttgtctgtttctatgtactgtcttgaaactctgaaccaccatatgaacaagcccaggttagcttgctggaagatgaaagacacatggcctacttgccctcattgccccatagccaacagccagcagtcccaagaagcagaactgccacactgaccagcagcttacctcagccacataagtgagtccaacagcccagcagaactatttagcttagcctaatcaagattgctgaccaaaagacacattgacaaagaaataattgttgttttacttcactaagttgtggggtgacttgacatattgtgaaaaataatcaatacatgtacacatagagaataaatgtgacaaaactatcatttttctattgcacttagatctgccattttaactcttttgaatacccagagagttcatttaaactttaaaaagtctttttctttgctctggaaacaatgaggaagtagggtgaactattctggaactatgttgacttataccaatcattgggtaacttaaattacttttcctttgattgcagatttttattaaagggtgcttttaatagctacccactgtaacctcttttttctattacctattattttaaagggggaaaaaaactcctataaaataattctgctggacacaaaaagcatccagcacatattatgtacagaaaaagcaatgactccttgtcccctactcctctctgtccttcttgggttataataaggacaggaagggtaagtaaagaagaaaagctgccttaactgtatgagaagagtaaggagtagggatttgcttttccccagtacaagttttttgtttgttttttttttttttttttttgcttttttttccccaagcaacaatgacgaatgagaaacatgatgtataagtgtaacagttattacctatcttagtttaaccagaatagaagcaatgtgtctgcatttttcagagccaccatctagcacagagattaaaattaacttttataaataactcagattctccctctatgatctcatattttgtatgaggcgcaaacctaattctcattcctccttcagacctcccaatatagagcacactaaggacactacctctaatgaccattttgtttacatgttttttttcaattacaattccatgatcctaagatggaacaccctgactctccattattgtggtgaaaataatgtcaatccttttgtatttctgtatgttttttactaactctttctactaaaacttacacatttcttctcaaatttgccataatttaaatccgattctcccttgttaacactgatgtgctttcttctttgataatgccagtcttatcaataatcatgcaaaagaaatcaaagaaatattgttctatttttattttagaaatatttataatgagaagataaatacagtatgggaaaaatataaggtagaatccggcccccaccgacccacacacacacaaatgaatgtgctaacaagagagtttcactgctgggctcactatataacagatcacgtttccatttaaacattgatcaacctgccatatgtacctcctctgaagaacggggaccaagaatcactcatcatttcaacctgattgcaattagagttaggaagtcagattggcacactttattctctgtgtatgcagtaatagacatctagagagaaagtaagaatatgcatgaacagctgaagacaaaaatactccacttctgttttccctctcaacaactgttctgaaacaccagggggtggtttttcttgtactgatgagaagtcacgttattaggaagtgttcagaaaatgtgctctccagtgaagctctcacagaatataagctcttctcttcataagcaaatgttttctggtgtcctgtttgtgctaggcactgttctaggctctgggagtatcatgatgaacaagaaacaatagtggtctaatggagtttgcattctactctggggagataaatcatgatagtgaaaactaaacagataaatacacgagtaagaaaaatatccagcagtgataactgctattcagaaaattcaataaggtgattaaatgtaggaaaaaaataaaatgaagtgctatggactgaactgtgttccccccaaattcatacattgaagccctaacccctgtgtgactactgggagatggggtctgtgggaggtaattaagattaactgagctcatacaggtggagtcctaattaaattgcattggtcactttataacaagaggaacctgtctcactctctctctctctctctctttctctccccacacacatgcactgaagaaaggccacgtgaggacacagagagaaggtggctgtctacaagccaggaggagagccctcacaagaaaccaaattgaccagaaacttgatctcggatttctggcctatggaactgtgagaaaataaatttctcttgtttaaatcaggggtccccagtacccaagtcatagcctggtaatggtctgtgggctgcacagtaggaagtgagggctggctagcaagcattaccaacagagctctgcctcctgtcagatcagcagcagcatcagattctcataggagccccaaccctgttgtgaactgctcatgtgagggatataggttacatgctccttatgagaatctaattcctgatgatctgaggtggaacagtttcattctgaaaacacccccttacccctccgagtccgtggaaaaactgttttccatgaaatcagtccctggtgccaaaaagattggggactgctggtttaaatcacccagtctgtggcattttgttatggcagcatgagcagactaaggcaaaaggaagacccacacaatttaaagaagaatcttcagaaaatttttctcattttcttccatgttggacacagagacagaaataattcaagcctgacaactgttcttattacaaatttcaaattttttgattgccttctctcccctctccgtgccccacccctaggggataccatgcaagaatgaaaaagtcgaagaggaaaacttcttatttaatctcatgcctgactgagaaatttactattgaggctacgtggctttagagccatatacatatcctcaattcacatacacattccaagtttactgctctagtcttacctgtttcttccttcagcatctcttcacagcctcctcatcccaccacccaccattttcttgcccagaagtaccacagtgttttaaaatcctacagtctgacagttctgttcactagcagtgaagccttctcaaattctttaaacttttcaaactttggttactttatctgtaaactgggggaaaaatagctatatcacagagcttttgggagaattacataaaatagcacaaataaaagtatcttgtttatggcaaaatgaatgttgttttatttacatactttttccttcgccttcttactcctgtctctcatgctcatgtgattacttaccacacaagaaaaacattctgagctttctcatgaagtttccatggtgtttctttacctagaatgctccatgcacctctcccccattccttaattcctcctcctggctaattccttggcttctttgtttttcggatctcacttccctcctccagatggtttccttgtcttcccaatgctgccttctattatacgttctcatagcactacacaactctcttgcacaacatttaacagaagtatgtctttagatttattttgtatgattgtttggggtctttcccccactagccaaacgtctatgagggcagaaatcatatttgttttggtcaatattatattcctagcaccttttacaatgcttagtgtgtaaaatgtacaaaaatattgaataatttctaaatctttattttgtccatttttctttggtattgccatttgaaatttcatattttgggatacattctgactttgggacaattactttctcttgtagctcaattattggttaatctataaatcattgagttgggttagagacactctaaggtttcttctacctctaaaaatctatgactctctctactatgcatatttctgagccactccatttcatctatttgtttcagtaattactgctgctttagttccaatagttgtacatttacctctattagttataggacagagtatttcttaagagtaattagaaaagcgtataaggtaaacctttctcaagcaacatagaggacaaagcaaaaagggccagtggtaattcaccaatacaatttcaaatggaaacctcagttggatgtttgctcaacctcataaatgattcatttctaaggggagtctgtgcattttttgagatataaaacacctcatatgcttggctacttttgaaaataggtaagtcatcaaagtctaaaattcatagctactgcaacctcccttacatgtatcccttctaagaaaaaggcagtcattttagagacccacttcacttttcaggacatagaattgcagtctaaagtagaatccacaggagttgttataaaaggaacacagatatgaaaataatagcagtgcaagttcactgatgctcagacacaaatggaagcaaaaagctagcagcactgccagaacctcattcaaatgggagtacatataggtcttagagctttccctgaatgagtcttgcctttgcactcgattccgaaagctctctcgcagctacaatacccagtgactcaataccaaatgctatctttgaaagggaacacagactatgaggtccctttaaagtcgcaattaggttgtttcccctatgaaaagactggaggaaagaggtgtgagctaactctttcttctcagataaaattacctttgaagagtcttcaggcagccaagtgtgctacaactattaaacagcatgtcacactcgatgtgatgatttgatgctctggtactcttccatgtaaggaagatgcagtgtgaaatttcttttgccttacactggccatcgatcttttatactcactccatggcaccttcatctcacttagaaaagtctgagagtaacatcaaatccaagaaggagatagggaagggaaagaaaaaatatattctcaggagtgtaactttctgagctagaggcctcttagtacttccctctttacttttcctgttaggtttgttcagagtaaaaaaggcaatagtacagaatgcaacctggaactattagttcctggtaaaaagagtcccaaaggatggaaaccaacagtccttgaatacttattaagtatcaggcaccattctgaacacttagttctttccttctatttaatacatctaccctgagagataaatattttatccatgttttgtagatgaggaaactcagtctcagaaaggtataacaatgtgctgaatttcatacatggagattagactcaaagccattccaaaattatctgagacataagcctgtgctttgtcttctacttcatgctataaaaaaaaggaaaaccctgatgaacatcaatgagaaaatcctcaagaaaatactggcaagccaaatccagcagcacatcaaaaagcttatccaccacgatcaagtcagcttcatctctggtatacaaggctggttcaacatatgcaaatcaataaacataatccatcacataatcagaaccaatgacaaaaaccacatgatcatctcaatagatgcagaaaactccttcaataaaattcaacatcccttcatgttaaaaacactcaataaattaggcattgatggaacatatctcaaaatagtaagagctatttatgtcaaacccacagacaatatcatactgactggacaaaagctggaagcattccctttgaaaaccagccaagacaaggatgccctctctcaccactcctgttcaacatagtattggaagttctggccaggacaatcaggcaatagaatgaaataatgggtattcaaataggaagaggtgaagtcaaattgtctctgtttgcagttgacatgattctatatttagaaaacctaatccactcacccccaaaactccttaagctgataagcaacttcagcaaagtctcaggatacaaaatcaatgtgcaaaaatcacaagcattcctatacaccaacaatggacaagcagagagccaaatcaggaatgaactcacattcacaattgcttcaaagagaataaaatacataggaatacaactgacaagggacatgaaggatctcttcaagaactacaaacctctgctcaaggaaataagagaggacacaaacaaatggaaaaacatttcatgctcatggataggaagaatcaatattgtgaaaatgaccataatgccaaagtaatttatagattcaatgctattcccatcaagctactgttgactttattcacagcattagaaaaaaaaactactttaaatttcatatggaaccaaaacagagcccaaatagccaagacaattctaagcataaagaacaaaactggaggcatcatgctacctgtttccaaactatactacaagactacagtaaccaaaaccgcatggtactggtaccaaaacagatatctaggacaatggaacagaatagagacctcagaaataacaccacacatctacaataatctgatcttcaacaaacttgacaaaaacaagcaatggggaaaaatttccctatttaataaatggtgccaggaaaactggctagccatatgcagaaaactgaaactggaccccttccttacaccttatataaaaattatctcaagatgtattaaagacttcaatgtaaaactccaaaccataaaaaccctagaagaaaacttagcaataccattcagaacataggcatgggcaaagatttcatgactaaaacaccaaaagcatttgcaacaaaagccaaaattgacaaatgggatctaattaaactaaagagcttctgcacagcaaaagaaaagtagcatcagagtgaacaggcaacctacagaatgggataaaagttttgcaatctacccatctgacaaaggtctaatatccagaatctacaaagaacctaaacaaatttacaagaaaataaaaccatcgaaaagtgggctaagtatatgcatggacccttctcaaaagaagacattcatgcagccaactaacgtatgaaaaactcatcatcactgaccatcagagaaatgcaaatcaaaaacacaatgagataccatctcaaaccagtcagaatggtgagtattaaaaagtcaggaaacagcaaatggtggcaaggctgtggagaaataagaatgtttttacactgttagtgggagtgtaaattagttcatccattttggaagacagtatggcgattcctcaaggatctagaagcagaaataccatttgacctagcaatctcattactgggtatatacacaaaggattataaatcattctactataaagatacatgcacatgtatgcttattgcagcactatttacactagcaaagacttggaaccaacccaaatgcccatcaatgatagactggataaagaaaatgtggcacatatatatcatggaatactatggagccataaaaaataatgagttcatgtcctttgcatggacatggatgaagctggaagccatcattctcagcaaactaacacaggtacagaaaaccaaacatcacatgttctcactcataagtgggagtcgaataatgagaacacatgcacacagggaggggaacatcacacacccgggcctatcgggggcttgggggctacaggaggtatagcattaggagaaatacctaacacatgtggggcctaaactctagataatggattgataggtggagcaaaccactatgacgcatgtatacctatgtaacaaacctgcacattctgcacatgtatcccagaagttaaagtaaaataaaaattaaaaaaaaaaggaaaacgaagaggctgacatcatgcgttcctcctatgtgagtttactggaattgtacagaaaaaaaggctctaggaaacttttaactcgggccagctgttttgttgacttataatcatgttttaggaagggaataatccaagtgaatgtggctagttcagagtaatcattcttctaattattcattccttcaacaaaaatgtgctccccctttctgcaaggatcttaaaatcaggaaaggggagattggaaaaagataattgtagtacaataaatgtaatgcaaagggcttcacccatattaattgatcaatgaagtatagttatcttcctttattaaaaccaggaaagaatgctgcaacagagatatacaagggcttttagagtcacacaggggagagtgatgcattatttctggagcactcactatatatgaaggtgatattcaaaccatatcttagatgatagaataaatgtttatttatttatttatttattttttattatactctaagttttagggtacatgtgcacattgtgcaggttagttacatatgtatacatgtgccatgctggtgcgctgcacccactaatgtgtcatctagcattaggtatatctcccaatgctatccctcccccctcccccgaccccaccacagtccccagagtgtgatattccccttcctgtgtccatgtgatctcattgttcaattcccacctatgagtgagaatatgcggtgtttggttttttgttcttgcgacagtttactgagaatgatggtttccaatttcatccatgtccctacaaaggatatgaactcatcattttttatggctgcatagtattccatggtgtatatgtgccacattttcttaatccagtctatcattgttggacatttgggttggttccaagtctttgctattgtgaatagtgccgcaataaacatacgtgtgcatgtgtctttatagcagcatgatttatagtcctttgggtatatacccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgattgccattctaactggtgtgagatgatatctcatagtggttttgatttgcatttctctgatggccagtgatgatgagcatttcttcatgtgttttttggctgcataaatgtcttcttttgagaagtgtctgttcatgtccttcgcccactttttgatggggttgtttgtttttttcttgtaaatttgtttgagttcattgtagattctggatattagccctttgtcagatgagtaggttgcgaaaattttctcccatgttgtaggttgcctgttcactctgatggtagtttcttttgctgtgcagaagctctttagtttaattagatcccatttgtcaattttggcttttgttgccattgcttttggtgttttggacatgaagtccttgcccacgcctatgtcctgaatggtaatgcctaggttttcttctagggtttttatggttttaggtctaacgtttaaatctttaatccatcttgaattgatttttgtataaggtgtaaggaagggatccagtttcagctttctacatatggctagccagttttcccagcaccatttattaaatagggaatcctttccccattgcttgtttttctcaggtttgtcaaagatcagatagttgtggatatgcggcattatttctgagggctctgttctgttccattgatctatatctctgttttggtaccagtaccatgctgttttggttactgtagccttgtagtatagtttgaagtcaggtagtgtgatgcctccagctttgctcttttggcttaggattgacttggtgatgcgggctcttttttggttccatatgaactttaaagtagttttttccaattctgtgaagaaagtcattggtagcttgatggggatggcattgaatctgtaaattaccttgggcagtatggccattttcacgatattgattcttcctacccatgagcatggaatgttcttccatttgtttgtgtcctcttttatttccttgagcagtggtttgtagttctccttgaagaggtccttcacatcccttgtaagttggattcctaggtattttattctctttgaagcaattgtgaatgggagttcacccatgatttggctctctgtttgtctgttgttggtgtataagaatgcttgtgatttttgtacattgattttgtatcctgagactttgctgaagttgcttatcagcttaaggagattttgggctgagacaatggggttttctagataaacaatcatgtcatctgcaaacagggacaatttgacttcctcttttcctaattgaataccctttatttccttctcctgcctgattgccctggccagaacttccaacgctatgttgaataggagcggtgagagagggcatccctgtcttgtgccagttttcaaagggaatgcttccagtttttgcccattcagtatgatattggctgtgggtttgtcatagatagctcttattattttgaaatatgtcccatcaatacctaatttactgacagtttttagcatgaagggttgttgaattttgtcaaaggctttttctgcatgtattgagataatcatgtggtttttgtctttggctctgtttatatgctggattacatttattgatttgcgtatattgaaccagccttgcatcccagggatgaagcccacttgatcatggtggataagctttttgatgtgctgttggattcggtttgccagtattttattgaggatttttgcatcaatgttcatcaaggatattggtctaaaattctcttttttggttgtgtctctgcccggctttggtatcagaatgatgctggcctcataaaatgagttagggaggattccctctttttctattgattggaatagtttcagaaggaatggtaccagctcctccttgtacctctggtagaattcggctgtgaatccatctggtcctggactctttttggttggtaaactattgattattgccacaatttcagagcctgttattggtctattcagagattcaacttcttcctggtttagtcttgggagagtgtatgtgtcgaggaatgtatccatttcttctagattttctattttatttgcgtagaggtgtttgtagtattctctgatggtagtttgtatttctgtgggatcggtggtgatatcccctttatcattttttattgtgtctatttgattcttctctctttttttctctattagtcttgctagcggtctatcaattttgttgatcctttcaaaaaaccagctcctggattcattgattttttgaagggttttttgtgtctctatttccttcagttctgctctgatcttagttatttcttgccttctgctagcttttgaatgtgtttgctcttgcttttctagttcttttaattgtgatgttagggtgtcaattttggatccttcctgctttctcttgtgggcatttagtgctataaatttccctctacatactgctttgaatgcgtcccagagattctggtatgtggtgtctttgttctcgttggtttcaaagaacatctttatttctgccttcatttcgttatgaacccagtagtcattcaggagcaggttgttcagtttccatgtagttgagcggctttgagtgagattcttaatcctgagttctagtttgattgcactgtggtctgagagatagtttgttataatttctgttcttttacatttgctgaggagagctttacttccaagtatgtggtcaattttggaataggtgtggtgtggtgctgaaaaaaatgtatattctgttgatttggggtggagagttctgtagatgtctattaggtctgcttggtgcagagctgagttcaattcctgggtatccttgttgactttctgtctcgttgatctgtctaatgttgacagtggggtgttaaagtctcccattattaatgtgtgggagtctaagtctctttgtaggtcactgaggacttgctttatgaatctgggtgctcctgtattgggtgcataaatatttaggatagttagctcctcttgttgaattgatccctttaccattatgtaatggccttctttgtctcttttgatctttgttggtttaaagtctgttttatcagagactaggattgcaacccctgcctttttttgttttccattggcttggtagatcttcctccatccttttattttgagcctatgtgtgtctctgcacgtgagatgggtttcctgaatacagcacactgatgggtcttgactctttatccaacttgccagtctgtgtcttttaattgcagaatttagtccatttatatttaaagttaatattgttatgtgtgaatttgatcctgtcattatgatgttagctggtgattttgctcgttagttgatgcagtttcttcctagtctcgatggtctttacattttggcatgattttgcagcggctggtaccggttgttcctttccatgtttagcgcttccttcaggagctcttttagggcaggcctggtggtgacaaaatctctcagcatttgcttgtctataaagtattttatttctccttcacttatgaagcttagtttggctggatatgaaattctgggttgaaaattcttttctttaagaatgttgaatattggcccccactgtcttctggcttgtagggtttctgccgagagatccgctgttagtctgatgggctttcctttgagggtaacccgacctttctctctggctgcccttaacattttttccttcatttcaactttggtgaatctgacaattatgtgtcttggagttgctcttctcgaggagtatctttgtggcgttctctgtatttcctgaatctgaacgttggcctgccttgctagattggggaagttctcctggataatatcctgcagagtgttttccaacttggttccattctccacatcactttcaggtacaccaatcagacgtaggtttggtcttttcacatagtaccatatttcttggaggctttgctcatttctttttattcttttttctctaaacttcccttctcgcttcatttcattcatttcatcttccatcactgataccctttcttccagttgatcgcatcggctcctgaggcttctgcattcttcacgtagttctcgagccttggttttcagctccatcagctcctttaagcacttctctgtattggttattctagttatacattcttctaaatttttttcaaagttttcaacttctttgcctttggtttgaatgtcctcccgtagctcagagtaatttgatcgtctgaagccttctctcagctcatcaaaatcattctccatccagctttgttctgttgctggtgaggaactgcgttcctttggaggaggagaggcgctctgcgttttagagtttccagtttttctgttctgttttttccccatctttgtggttttatctacttttggtctttgatgatggtgatgtacagatgggttttcggtgtagatgtcctttctggttgttagttttccttctaacagacaggaccctcagctgcaggtctgttggaatactctgccatgtgaggtgtcagtgtgcccctggtggggggtgcctcccagttaggctgcccggggttcaggggtcagggacccacttgaggaggcagtctgcccgttctcagatctccggctgcgtgctgggagaaccactgctctcttcaaagctgtcagacagggacatttaagtctgcagaggttactgctgtctttttgtttgtctgtgccctgcccccagaggtggagcctacagaggcaggcaggcctccttgagctgtggtgggctccacccagttcgagcttcccggctgctttgtttacctaagcaagcctgggcaatggcgggcgcccctcccccagcctcgttgccgccttgcagtttgatctcagactgctgtgctagcaaccagcgagattccgtgggcgtaggaccctctgagccaggtgtgggatatagtctcgtggtgcgccgtttcttaagccggtctgaaaagcgcaatattcgggtgggagtgacccgattttccaggtgcgtccgtcacccctttctttgactcggaaagggaactccctgaccccttgcgcttcccaggtgaggcaatgccttgccctgcttcggctcgcggacggtgcgcacacacactggcctgcgcccactgtctggcactccctagtgagatgaacccggtacctcagatggaaatgcagatatcacccccagaataaatgtttattaaaaagaccaggcttaatagcacaagacatgggggcagcaagaataaaggcatgaagtgtaaaagagtccagagataggaatgtaaattaattcaaccattgtggaaaacagtgtaagtgtcttacttataagtgggagctgaaaaataagaacacatggacatagggaggggaacaacacacagtggggcctgttggggggtggagtaggggagggagagtattagaaagaatagctaacacatgctgggcttaatacttagatgatggattgataggtgcagcaaaccactatggcacatgtttacctgtgtagcaaacctacacatcctgcacatggacccccaaaattaaaataaaaattagagtccagagaatgcaggagtgtgtgaattgagtatggagaactgagaggaaaacactgcctgtcttacttctaaatgaatagcaggtattatttagattgatttgaacttacttataataagccatatccagttgtctccagattttcaaaaataatgccaggttttcatcaacattagctaataagtacgcttgttagtttaataaggagaaggcagtgcttctaacagtgcaataacttattcagtaagctatctaactttggagtggcaagtagaaaatccgtgcatatgaggaatgagaaagcttgagagtgggcattatgagaagatagttcagtgtgatttttgggagagtagtaactaatatgtgatcttcacaaaataacaaactaggaataaattataattgcagcattcatatacaattatatgtacattcaatattactgtaaaattaacttatgcttcataagtgctaattatttgtgctgttttggagatttgctaatacatattatcttactagtatatgaagtctacatctagtaaaggacaaaatactaatagacaataaatatcctgcaagatagaaaatgatccttgccatgaataatgcaacaaagaagtctgtgggtttaatagcaaaagagccctcttctgacatcttatatagaagttgatgctacatatttatcataagggcttggaaattaattgtataatttacctgtggtccctggatcattgctagagcctgggttaaatataattttcgttaaaacattttacctttggcagtcaagtaaaaaaaaaatgtgtttttaaaaaagaagctcactacttctcttagactgctataatggaagtgcacagtgtgaataaattctagcaaaatctgagtctcgaaaaggcatcataggtgggtcaatggattttagcatgtaggtcagtaaccagcaaacccaataaccttgtgagggttcccaacctagaaacctcagcctcctgagtagctgggattacaggtgcccatgcccagctaatttttgtattttagtagaggtggggtttcaccacgttctccagaaatacatgattttaagctgtaatgaagtagttagaagcatggggtctagaaccagagggcatggaattgaattacagctttactgcttaacaaacatatatacttgggcaggttaatacagtcttagtcttgatttatctttaaaatgggcacaataataataatacataattcagggggatgtgctgattcaggcatctaagtaaagcttttagcagtgtggctggcacaaagtaaacattcagtgactaacagctcttattaattttatcaaaccttttgcctgatatctcattctacgatctaacaagatgtaagttactcccctctccagatttataattttagaggcctactgtatgaagtctggccctcttttggcaaatattacagagggcttggttaattaaaagcctaataaaatgtatcaatctgtctctagtaaaatttaaaaccagtcacctgtgttacccttaccttagaactataggtaaatgcactatgaaaaataaacaagcacaaaaacacccttcaagatttcaagtcaaatttgaaataatcccactataattaatttatttcacaggtcagaccacaggttaaaatactagagtttctttattcccaacatacctattgtggagaagatagagaaaagatagaataaaaaatgcacctttattttgaaagctatgagctatacttaaatttcaattgggaacggctctttaaaaggtaatacggcaacttaacaagtaaatttcctctaaaacaaactggaaagaaataggattgatgctaatggaactaaggaggaaactacatagaccataaaagcctcggctgctatcccaggcacaaaaagattgggaaaaccaatctaaggtaattcagttcatcacaaaaacacactgtccaattggaggtactgtgaataataccttaacgcctgtcacaatagatggggacggtctttcttttattcttttattctgaggcaatctctttgtggaactttatttgtatagctaacaatctgaatgaaggagctcctgtgaggacttgtgcatctttattgttgccagggaaactgggtcttaatttctagtggctgaatgccaaagaaaacaggctatacagaaagggaagaaacttggtaacactgcatttgttggaaatattcagtgttaaagggtccttttctgggacccacaattttagtaggtctacaaatacccgcctccctttcttcaccccactgctttcaaatgaactaccaaatatcagtttggtttttacttgatgcagcaatatggtaattattattcacagaatttctagatgtaaaatggaaaaaaattaataatgagtgtagttccttgttaaattccggttgaagcaacacataattatccttctgacagttcaagccagcttatgaggaaaagcctactgtttcagtttacaaggttctccttgcccagaccaggaagctttacgtaccttttgtggtattgcttaatagttcacgacagtgttgctttaagtgaaataggaaaaaaaagtaagaaacaaaactgcctggatttaaaaacaacaaaacaaaaagacaaaacaaactcttatcatacacaaaaacatctgttacatattgatttatttaaaatctgtctgcttcaacttgagaattttgggggctatgtttccctcaaaattatattttagatacactgatagaagatttttgggtctccagaacacaattattcatagactgtaaatttgtggcagaaaaataccataaaacaaactagaaagaaataagaataaaggggaaataaaagtggtgaaaaaatgctagagagcaattgtatatatgctgtttctcagtgcagaggttttttttactaacggcacatggattcctcagcaaatccgcttttctgtaactaaactaaaaatcatttttaaatattggtaaaggactttggtggttttactttacctatgcaatgtaggaataatccatctatgttcttttagagtttttgttcttgctttattgttacacaggaattttatctcgttaaaatttaaattctttatctttgattatccttacttccttccacattcttttttctttcttgttgttggacttggtagcactcccatggaaccttcaggaaaacaaagggacatagtcctttttgtgcttggagctactgcagccaatagataggcaatctaaatgaaatcagccgggtctcttggcagagagccataaaagacaataggacaatacagtctaaaatgtgtcccttacaagaacattcctcagagaaatacccaaagatttatgaactataactttggaaagattgttttacttaaggaaaaaagctcttccaaagaccggtgaataaagaaaacctgcacacttaaaaatccaatttcttgtcattactccactagaatatgaatcagtgaaaataagcaggaagacttcagaaccgatgaattatatattcaagcttggtgctattaaaaataaatatcttgcaaaaatgcaatatttaatgctcttttaaattcctaggaattgaaaatttcataacattgccaaaaataaatgccaccatctctattttatatatgggagaaaataagataaaagatgaattgacttacatggaaaaatcagagctgggagaggacttaattcctggtgttcacaaaactagcgcatgatactactttttacttaatttcctaattttaatgtgtccaactgtcttgagacagtacataggaaagcttaaaacgaaacattcaatagtgtatgctttctcagtgtccagtttgggaatagattactagtatcaaaagccattaaaaataattttcaggaaagatagactcaagctatatgatgttattatcagcagcacactttttaaaatattatttaaatgttttaacaattcatagtgaaatagggctatgtatataaacacacggattagaagaaggaaaataacaagtgcttagggcttcactacattccaaataaatgaaaaatcttattgaaactcacatcttacaggatacctatcagcattattgttttgtctataagaaaatagagaatcagaaagttttgctaacctgtccagaatcacacaggtccaaatggaatgagaaccacagatgtttgtttcctaaacccttatttttcccaccatgttacagaagagtcgctctgtgggtttcagtatgaaagttgtacaatcgttcctcctcctggacttcttcctgggaattaaaagcaacctatcccaggatgatggtgacttagacttttccttgtctttttccatttccaagccactatcacagcatcaaaagaaccacaagttatgtttttcaattcatttcatataagagttcaattacattaagagaattttgagagctttatgtttttaagtattgtaattatttactggtctaaaatgtgctgagaaattgggtgacgcctatagcaggcaacatgcctactgctgactgatttattgtgctaggattacaaatggccaatttgtcaaaatatatttatgatatctaaattgtctcttttctatttcttttatgtttttgtttatttgttggttttctatctttggaccaaattctcagcatttgaaaaatactaagttatgtgtcaacattttcttctcattcttgtgcttatctattttttgttgagatcaaagttgaaccaaaaatttgagaggattgaataacggtgaatggagaaaaggggccacttcgtatttcccaggcttttacaaaaacaaaactaagaataataacatttcttctagttttaattatctcctaaaatcatagtcaggtttcaaaaaggaaatctaattaataaaatatgaagaaagaagaaccttaaaaatagagcatatacttagatttacttggctatgtgaaaggtaggagcaatctggacttgattccagcactgagtctattcatctacctggtcagcagtgtcttcctgtttctttccttttctctcagttgtaagtgtgtccttctcaaggctgcactctcaggaatgaaggacacattttctagataggaatctgccttcagtcaagagacactggtgtatatagtcctcatggcacagaatattgcttctggaactcatctggcattcaaaaatgcttctgtaattggccttctgactaaaattaaacaaaatgtgaacccttctataaaaaaggaacaggtggacatttaaaaaatatttgatttttttttttttgacggagtctcattctgtcgcccaggctggagtgcagcggcgtgatctcggctcactgcaagctctgcctcctgggttcacactattttcctgcctcagcctcctgagtagctgggactacaggcacccgccaccactcctggctaattttttgtatttttttcagtagagatggggtttcaccgtgttagccaggatggtcttgatttcctgacctcatgatccactcaccttggcctcccaaagtgctgggattacaggtgtgagccaccgcacccagcctatttaattcttatatggaaaaagcacaataatgttatataatatcctaggacttttttcagcctatttttgataatagaaaacacaactcccacaacaatggagatgtcatttcaagctcacttattactgtggattctctcaaggagtggctttaaagacaattggtctattcattgaagcatttgcttggtggtagtctgaaggataccatatgacttggcactcattaaccctgctcacagtttagagtttgaatcccatctagattcaagaaatctgattctaccttatttcgttaagaagaatgtttgaagttaacatgttaaaatcatgcacttaagtttaggaacaacatctaagataagactttgggaggactaaactacttctctttacaggaacagaagattacacttcaatttttttccactggcaatttcaaaatcaaacaggtgaaaagaaaggaagttttccctcaatcacagacatatcacatttataatgatgcatattataccatctgtacactcctattaaagcaagaaaatacctcagagacaaactatgtttatcttgttctttgtttcttttttgaatagtttatggatgcacatataattttttatttacctctgagtaaacagagatcaacttatttttcccagtgaaacattaaaatattgcactcatcagaaattccccattggcttcctgagaaatgggatcactatcaaggcagctgctagcattcattagtaatgttctgggacatagactagctgttggggagagatggaataaatacaggaaaagaaaaacaggaagaaaaggaaagctcatgcctttcttcagtgattcttgctgtggcctttcattgaatcaagtaaatctctagcgaacaaaaataaatactaccagtaataatataagggaagactgtttagaagataatgacatgtgccataaaagagaaggctgtgtattattcacactaaacacatagaatgagatagatacccatatagaaagaaggttggcaaccagcagtatcctaaatgccatttcaaatctcttgatgtcaaaaggaattgtgcttctggtaggacattcagaactctggagccagaaaacacaaagtgaagagaacatatattcttcagcaaaacactggggatagtgtaaggaagaagaaaaatgtgtgtgcattggctatttggctaaagcttctcagtaccagagggaagctgtggctataaatttctttagacctttcagaagcccaagcagcataacaatccattggcttaaagagaaataaaagacatgtagtttcttctgtaattaaagatcactgttgatctaagtacatctgtttattttagcagtctatatttaatacgtatatttgtttcagaggatactaaaaacaaaactgcttatatgcagcatacataaaaacttcttttagcacattaatttatggaatattttagtggcactctggacataaagtatggtagaattttctgcccaaatgctgaagctagactgttatggttctcctagtatttttctgcagccaaattagacccaaccttatgaacatatgctgttgactgcagggctctcttagagtctcatccctggaataggagaggtttcagttccagatcattaaggcccacgtagatttccaagaccagaactcaggggaaataagaaggacagtgaaaaaaaattgagtgaccttcttttctgtgggagccaaagggtgagctgagcccatgaaactaactggtgacattaatgaaatactataatactgcctaaggctgatcaatcactaagaacagaacagctactttcaaatccaattccagaggttcagtttttacatttcccaaatgtctctaattgccagcatatttatcccatcatttgtgataaacactctctggtgaaaattgagtaccaaccaaactgcacctgttatactccatatcaataggatctcaaattcaaatcattcaaattaatcttaacaaggctgatttaaataaagggccttaaatactaagcagctctgtcatgttaaaaagaaaatttttgataaaaggccatagaatttgcctcctctaaagtagtctgtgatattaattcctcaacataatttttgtagtcaaggaatgtgatatcatattctgtgctgtattttcatgacgtggcttatagtaaaatttcatatctaaagggtgaaagttccagataactgtattttataggctttggctactacaaaaacataaaacctagaataagtactgaatcattccagctgcaagggtatttttcgaaggttcatttagaagactagtcaaagataatggctttaagtggaaggggaataaaaagacatcctcactgaccaccgagaccaatataattcattagataacaaagagttgtatatggaactctaccatcttgtagggaatctcccaaacgaactgatgttgctgtccctttcagaccacatccttgtgaaagctgctgcatgacattcccaaatgtgtctgacatgtttgagatggcatgacttaaaactacaggccattaggcaaaggtgaagttcactttggggcacctaggggtccctcaaagaaacaggcaatcatacaattagaggcttatgactctcagttggtagagacttgcaatatgcattaacaagccagagacacaacaaataaatatcaactttacatacatgacaaatcaaaagtcccagcccatggcattcctattttcaggtgttacatttgtttatatggttaatagctcttcaactggggatgctcagcagtgagcagaaggatattattctccttcagagaaacagtactctctaaacttacttcaatttgttcttcttcatgaaagcattacagaaaaagaaaaggaaataaatgtatacctaacattttttataaataaagaattttgttagacacattacatgcaccatttatatgagtacacacaatcttaaaatcagctattttaaagatgagaaaattgagattcacagaagtcccttaggtattaggtagatgaaatttcgctggaactcagttctgcctgtctacaagatagcccctggcaatttcttccttctctgtacttgccacacctttcatctagaagtagaaacgtaagtcctttcacttgaatctggtatggctttatgactggtttggtgaatagaatgtagtataaacgatgtccagggattttgatgcttatgccttcggggccttggagtgtttgctttcactcttggaagacagccacatgtaaagtacaactatactgttgaagagaggcaggccctggaggatgagagactacatcagcctcagtcaagatgccctcccaatactgcatgaagcagagatgagcatttccatcaaaactgtaatgcttaatttgaaaaacctgtactacatactaccctaaagaactttccttgaggagtagatgtagacagtaaacaagcaagtgcatccttcttggaatgtcacaaatatgggattgctgaatagaggatgcttcccatggaatcggacaaggaacctatgaatagggaatgcaagcctaacaagtggcaaaatgtcctctctatggtggaaatgtcctctctatggtggaaatgttctctctatggtggaaatgtcctctctatggtagattcttcacatattcttcaccgttatgaacagcaattcccaggtaggaaaataaaactagcatcttcacctttgatgccgtttttgctacgatttttctgattcagtgtagagtttgatgtcagaaagacctgggtttgagtaggggcttgccacttacaaactctatgactttagaaacttactttatctcttgtctctgcttatattaagaaaatggaaattcttcaaaatacaagagaggaaattcagtcatgcagccttttcattaagtgtctctatttaaaaaatcaaagcagttatttttctgtcccaaatctccacatgtggaatctgttagttaggtacctgttctggaaagctctggttaaaagtcaggcttgcttaatggagtcacaggaaggtaagttaaaaatatacccatagagatcatctgtctagctcaatccctttatttcacagaagaagaaagatctagagaggaaaagtgagttgtacaaagaatccagcttgtgagccacagaaaaagtacaagaaccattgtttcctgactcctcaatcagtgctctttccatcataactggagcttcccctgggtgaggaaaatgtaactagaaatagccctaattgtcattatgaaaatcatcattcccagattaaaaattgtcatgaaaaggccaaacaggtacaaataaatcaaacatcttagcattcctcttatatatgtaggtgaaaaataccagccccatctaattctccctgcctctgtttctcttaatttcccacgcatgataccacatggttctaagtctggacatgatttaaggagaaaatatttctaaagtctcagctaaagttggataagggctgcagttaaattgaatttaactgcagttcattctccctcaatgcagtgctgctccaaggctgaccactggtcttttggactcaacttctctacggttctgacctggggctgaaccagtgctgataatgctctggtgaggtccagccctggtaacacaaaacagataacagagctgcctttgttccccattgtgatggttaatatcaagtgtcaacttgattggattgaaggatgcaaagtattgtttctgactgtgtatgtgagggtgttgctagaggagatgaacatttgagtcagtggactgggaaaggcagacccaccctcagtctgcgtgggcaccatccaattggctgcaagtgccgctaggaaaagcaagcaggaggtagaaggagctaacttgctgagtcttctggccttcatctttctcccatgctctatgcttcctggcctgaaacatcagactccaagttctttgactttcggagtcttggacttaacaccagaggtttgccagaggctctcaggcctttgaccatagaatgaagcctgcactgtcaacttccctacttttgaggctttgggactcgggctgatctaccactggcttccttgctcctcagcttgcaggcagcctatcgtgggacttcacctggtaatcgtgggagtcaattctccttaataaactccttttggtatatacatatatcctattagttgtatccctctggagaaccctgactaatacacccatgtttggttcttgttttgttgtgtaactgtgtacttccatagctcctgagaagctgaggccctgactcatttttctagcatggcatttgggtactcttcacccaaaaagagattcctaagtataactcttggccggcctggatgtctcatcacagaaacagcctatccagtcgtacctcttcagtcctcagactgggtcctgcccatgtgaatggatctaggattacttccctgactcttcccaactcacttgacctatctgcctgtacgtaagtagctaaaactcatcaatcacctgaactaaggcagtaagtgggggagaaaatctttgaaaaatccaaattagtttttattagtggtcccattgtaaatttgaaaatttcattgctcaaatgtacagaaatttggtatagacatattgctggtgatttgaaaacaataacctagtcataagcttttattttttatattgtttatttttggtttaagaaggtgaaaacattcatagcagaacacttggaaaataaagaaacatgcatagaaaaaatatgttgttctttttatagaatgagaaataactaagatccgtgttttgagccagaacatgtgaatctttgtggtataacaacttatgttccagtaacttctattttagtagacttttttcctctaaaattcaagaagccacagagtaacctcttcagactacttcatatgtttcagcgtctcatgaatatagttattgatcttcaggtaaactcttggggattttgtcaattctgacattgattcccatgtggaacagaggacttttctagatttagagttgtgccttcattttaaccactggtttgaactctagaccctctaaaatagaccttaacacacttcatcagattttgaaacttgctgcttattttctgattcaattgtatttgttctgctatgactgtattagttttggattcaaaaaggttagccactgataagtcttatattcaactctccctctagctatgagactgtagaaggtatttaaacattcacaaggacagagctatgttgggagacagtgccagactgctaaactttaagttctttttcttcccaatttaaatttaagtcaaatttttgtgaatctctcaccatgttaccactgacagtcatttaatctctgttagaaatacctgtagaaataggacattgctcctatgtcaaggagtttacaatatagctggagaaacagaacacctacatgtaaagatataaccaatgttatcagaaagcacatcataaaagtcattaataaatataataatagtgtcatggtatggaagccagagggtcagagagtgaccttagggctaggatggccagagtttcagataatagagaagagtaggacactgttcttattatattatcagatattctgggccaaatgtgcagaaatggaaaaagattagattctgagaagtagtacagtttggctacagaaggaagtttatgtacatatgttcccatgaatgcgtttgaggcctttcaaaatagggcctcacatctatatttgtttcagttttctgtctccaaatatatagcctgtatgatagacaaactggaaaactttggatttcccaacaatgtatacgccttcccatctctgcctttacttatgtttcttccttaacttctaccatgctcccagcctccctccccttatctcctcataatgaaggttttttaaaaataagttttttctctgctttcaactctgataaactggcaaggtttcctgagagtgatatgagggaaaaattccaaaatcatttcatcttaaaaaaaaaaaaaaacatgagtgattagtgatgtctaacaaggtacgacttttggagcagtgttataaatgtcatgtattttgtattttgcaaacaccattcaaggcctagaaaaagtatccccctgagtcatatggatctttggggtctgttaatcaaatgaactccttcttccttaaaatcctactgcattttctatttcttttatgtcacttaacttattccactttatgtttgcacttggcttatcactggcaataaacttaatctcttttaacagtaaaaaatgtatctcactcatcttttttatctccccaaaatgcctagcataataaatatatgcttaataaatatttcatgaattgaatataatggagggaagaagaaggatctaaggctggaaaagtaaattgcagatagattatagaaacctaaatagtagagtttagctggtaatttttttacaatagtttcatgtaatgtggctgtatgcccataataatcagatgcttccaggtagaagcccttaatacattctcactcacaaactccaataataaaaggttgctgacccaccacctagggattgagttcttcagctggaacaaatcaaaggtaacaaaatttatcaatgcatcacacctcttaggtgatttcagggaaatttacattttgaaagaagaaggctcaatatagaaggaaagatatgcctagggtgaaacctgacttaaaaagaaataatgaaaactgctcagcacattgtggtagaaataacatagatttgggggatcaaggcttgacattcaagatcagatctcaactctaccactctccagctatgctcttgggtggattaagtaacttctctgaacttccatctctttctttgtaaaagtagtataattatacttgtgccaaaaagttcaaagctaaatatgcagcccagttttagtaactagttttagtaaactgatagatatgtaaagcttgcttatgtactacaaaatcttttgcatattatgttctatgtcgtctatgtttctactgaccctgacttttctttctagtttattatattggctaaattattgtaagccacctctaattgttttgtgtaagtatatgggctataaatatataaattgagttatacccatgtgtagagctattgaaagataaaataggataatgtctagataaaaaccttttacgtagcttaatgtggtttctcccaactcaattgcatctgcccatcaaaaacatgacttaaagagactttccaaggcaagagggcagataccaggagttatagctgtcagaattataaccattgcaggtacttcagttagatagcttttagctccatggccagttatttagatttcctgaggttgcatagtttgaacaggtaaaaattttgaggtagaacgttaacaaaatctagtaactgctttatacatttttaccactttctgtcaaagccccttattttaataaatcaggttcaaatgtaataaaactacagctgcttctggttttcatatgttgattcaacgaaaagactgagttttaatctgttgttccactttgtgttattaaggtcccagagcattttatgctctttctttagatgctacactttccaaggggaaaacaaagctgaccttgacctgtttgctttcagtgggcacttacgtgaatagtgacagcagtcactgtgtcctaaactgagacctcacatcattttgagcagaccccccttttcatcaaaaggtaatgtccatattcatgaagaaaactcagtgagctgtgggtaaggctttcagcccgtacatttttaacataaataccctaagaataagcaagttaaatgtcacaaaaatacaggaaggcagaaaaagcctttgcctattatatcaaaccacaaagcagctgacatttcttaagaacaggattatttgaacaaaattgctgaagaaagctgagactgtcctattcacaagtaaactttgaaatattaagaagataaaataacaaaaaaagaatatattttcctgactatattattaaataagtaccaaatacatgaataatatattacatattatgcaattatgattatttacatattaaaagttttgggtgatctattactgtagttgtcatcagaaaatataatttcacaaatgtctgcttcatatttataattatggacatatatatttgggatcctattagacattcatgtagagctgtcaattagaaggatgatatatgagctctggaaaaaagtctggactagagatataaagttaaagttaatgacatacagatagtatttaagattcaattgatactattaaaatattactcactgggtaaactttcacactaagagtgaaattttgaagtattatcttaaatcactgagctgaagagcaatgtgttgagagacaggctcagaaagcactgatgggcagcttggaggcggggttcatagaactcagatttcttttaagtgaaatgaggcattctgtatacctcaatgtcatccctcttcaatcttctttcctggctccttaatttctcttattgtaaatgttggtgtcctttaagatttggtcttgggatctttattttcattaaactctctccaaatctgatttcctccaattccatgttttaaatgccatccatcatttactaatgcccaaatttatatcttcagtccagatttggcatttccttacagatgtcttacaatattatccaatatctaacatgatatgtccaaaaagaactctcaataaataataccatcatctaccctattctccaaatctaaacatatagtatccttcctgaattgctttttctcccttatatacaactcccaattcactaatttctatccactctacctttgaaatatatctcaaatacattgacttatctcttctgccatactacaatcttggccacaatcattgtagcatggactactgaagttgctccaaattcttctgcttatatatattcttgtccccaaacaacccatttttcacttagcagccacagtgatcattaaaaatatagagaaagagagacagagaaagaaatcaataagaacatggttgtagttcttttatatggttattgtttacctaagaacaactcgctattcctcttagaaaccattaagcatcaggaaaacaaagaaacaaacaaacatatataaaatgtcaaaaattgcctgacttcaatttgcagaaacgttagcatatagaaagaagctgtaactccaatgataagttagtgctaccaagtgccactacgatctgggcagagccacctgggaggaagggagggcacctggctggtaagtgcttggagacccagaggtagccgattccggagagcacaacacagatacactctctaagagtaaggaatcccctgaaatgtgaaagttaaagctgctgctggagatgtagtaaacatggctgagttctgagaatgctgccatcagagagcagttgccaaggtgatgaatctaatagccatgtcagattaaagacaatgccagtgaaaacaagttctacagtgatttgaaataaatattgccttggacaacagagccgtttccgtttatgacaacggcagtgaagaaatagggaacgtggcatgcagggctggcagcagaaactactggatatcttaaagatagctgattacacagataagctcagacgctctatacaggaagagaacaatctaaatccaagaagactaagagagacccttgagctgcaaagcctagaaggctgcataggcccacaccaggaacctctttcaaattaacacctgttccagtaaaatcttctacattcaaccacgagtaacaaaacagtagaagaaatagcatggttgtactctatgaagaaggtgttatgtcataccaatgaataaaaaacaatctcaagaaaaaaatcacaatgagcatataaaatcgtaaccaaatatttcatcataggcttaaataaatacatgaagtgattgctatgaaagaagaccctaaagaggaaatataagaactcaaggaagagatgtctggatgaaagaagatgaaatgaaagaaaaaagagatgaaatacaagctgctagaattcaagaaagagaagagaaaataaaatgagtaaagaaggcaagattaaaaggaatacttgggagaacagacaggataagaaaacatggaaactgactcagacaacagaaatgagaaaaattaacaaaacaataccatctattgttttatttataaaacctgttgatctagtatctactcaataataaaattcaaaacagaaaaaatcctccccatatcattttcattcttttaaacctttcaatggcctctgatgaattctaaaatgaaagtcaaaccttgtatcacggtctgttctgtattactcccactcctttacaaatttcaagtcttgctgatccctcactcagccacgttaatcttttatttacattgctattccccttcaagctcaaacagtccccagaacttcctgcagctgatgagtctgaatgtattgtcataaaatgccttccctctaccctctccctggcttctaaggtatttaccagtgattttctcttccattatcctgtttacttccttcacagcccttatctcaaacacaactatctcattatttatattgtttactgagattttgtttttttcccttcactgcaatgtaatctccctatgaacagaggtctgtatagtccagcatctatctagcacagtcagcagtgataaagtctgatggctagaggaaggtgaaatatattatttctaaggtttcttcaattctaatgtcctggttatatctagtaattcactttgtagagtctgacagactccattaagagcatttaaccaactttaagtctttgtataccttgatttatcaagcttataatcacataattaattatagaatttttacaaagttactgtgaggctaatggtggtagtggtggtggtgtacgatactactagttgataatcaaggctgttgctggcccagagggcgatattgcatgaattagaaaaaggcattcccttcctgcattcagatgcagctctcagcagctctactcaggctctatacaggacactatccaggttcccacacagggtcttcagttgtcatctggtagaacacaaatctgtgtatcactgatgaagcttgactgagaatcactccactttttgtacagttaagatttatggatttgctaattctgcctagcagggatgctcaggatttcagggtcacttttctgttttcccactctaatcagcactttttctctttttttgtggtgattaacataaacatgacctggctagggtaagctttagagagaattcctccagtgctttcttaaaaccttcatcaatgttagactttcttatgtccagatgttcctctcttatatcacattagaatataccatatcccataatgtagtgtggtaaattttgtgtgtcaactggactgggccatggagttctcagataaacatatggttaagcattattctgggtgtgttcgtgagggtgtttctggatgagattaacatttgaactggtaaagtgagtaaagcagattgctctccccagtgtgggtggccctcattccatctgctgaagtcctgaatgaacaaaaaggctgagtaagggagaattagatttttccgcctaatggttttggagattgggatgttggtcttctcctgccttcagacatggactcggactggaatttatgccttcatctctcctgtttcttaggttttcagacttgatctggcactataccactggctgccctgggtctccagcttgccaactgcaggggagttgggacatctcagcctttataatcttgtgagccaataccttatgataaatatttttatatattcatacatatatagaaaatccctgacacacacacacacacacacacacacacaaattggttttctctagagaaccctggcaaatatatacatttaacacaatgtaaaatgattgtatacaagttgaatgtcagttgtaatatctaattaaatatttattaatttaacttcttgttaagacttaattctgtgcagcaagagtgcttgacagttaaagtactcctgaacacctctacaacaaacctgctctagagaaattaaagtaaagccaggcctaggaaattaatctggcaagctagtttattgttcttgcgtccttcacactcatatttagggcctagaatattgggttcaagtgggtcatagttctaaaaatttcctggaaacatgaaccttgtaatgactttatatatattttatatatttttattgattttcttactggaattttttaacatgaaaaagtgaatatgtatttgatagaaaagattttttctgaagtctgatgtattcttatgataaatgaaaagccagattttcataatgataggcatattacctttgaagattttgatcacttaaagatagacataatcaaactttttataataaaaaatagatttttcccattatttaaacatgtattttggtatacctttagttctatgaggtaagaggaagaatttcccaagctcagcacataaaagtttatgtgagaatatttttgattgttccatgagttatacattttcaggaaatagaataaaattcctccaagatacatagctgccataagcaactgagtgccaaattctttgctgctaaatgctctacatgcattatcaagtttgttcttataaaaactctggaaggtagatatcattcctattttatagaataaaaaaatctgcctcagaaaagttaataaatttgctcaagatcaccttgacacttaaaagtaatcggtggccaaggtttgagccaaggtttgatcttagctccatctatctcaagactctggtctgcactatcagactcccccaaagattaaaggcaaaacagttttcaatttacctaaaacactgttcagtaattctctctggactctgatttttttcctttgctttacttcaacctatctctagtaagagaagtagctgaagactataaaatgtgctttgtctacatgtatggaatacgggaggaaaagaaaaatgccttcataagacaacaagtcgatgacaaagctgggaattaaaagttttaattttgcccagctcatcaaatgcagaattgacacatcttttttttgtgaggccacttttcatatttgaatctaagataagtgatgtagtgagataatgtaattttccttcattgcctccagtctttgattaaagaattatagccttgctttgaaaagtaggcatttttcagtgactcattaaactaatcatgaattttattccacttccttttgtagtggaactcttgtccttaggcctcctttaagaacatcatataaaaccttactaatgctaatattaacaagcacataaactgttataataaccactcctaaagaatttacatagactaatgcattcatgcttattttcaacgactatacatcaagtatgtacaagattgaagttccacaacgcaagaccttcccctacacagatgaaaagtcaagggacaaagaaggagagagaagtatcaacccagttccaatatgtaaggactgttatttgtctaagaaaaaaaatgggttatttctcgctaatggtcagtttcactaagagtttctccctccactatcagtaagtctcaaaaaggcctggcttctaggaggcagtggtctgttcagtcatgcctgaagctatttttcaggttagttaagtatcaaaaaacttagagcagtgctgctgagtgcatcattatctgccagtgaagagagagagccacagttgtgcagctaagtgatgcagggtatggaccttagcagtaactctaccagcatctcagttattactaaaaaagtcaccagagacataaccctggccattggcattttgcttttggcaaaaccttggcttccaacagctttctacagctgtttaaaacacagtttacatataccttatttatatagtatagacaaatagtggatacatgtgcatgtggaataaagtatccttaactcaaattgtgtgggtagaatatacctttctttttaatttattcctttttctattcatccacttatgacaacagcctggtatatcagctacattcctggatattcactggggcacaaatgtagaaagaaaactgataagagaaatgtagattttaattaaagagcataaagtaaagcatttttccatggctaacaatagaaatgcttagattcttcagttggtccttttcattgaatttatttcttcctactgtgagatttaatttaaaatataaaggaattctacagctagaaaggtttacaaaaattgcttatgaaatacgttgagatgttcatatggaatattaagaaaggtatcacgaaataaaaaaaataagggaaaatacaatgaatactacaaatataagcatagagaaaactatgttttgagtttgaggggaaaaaaagcaaaattaaggtaattcagaagcatccaaaagaaccattgaactcccttactaatcctcttggataacatttagttttgtgattattagttgaaaatatttatgctataccattcacctcaccttacaagcacgccttttaattaaaaaaagtgcctttaccgtcaaaagtatttttgtatgagaatgatgtgcatacagacatatacaattaaacaattacaaggtaacctttgtccctccagcaaaacaaaaccttaatgtcccatctaagccaggctaaatcttaaagacctaaatagttggacttaaacactaacagacatcacaagacaaaagaaaatacaacttctgggttactgtgaaaagcttcttcatgtactctgtagacagtgaggattgaggaagccagggcaatctaccagtggcaactagaaacatctttccccccaaatttccgtaaaatggtaagtttaatttgcaacacaaaggcagagatgtttactgagtgaaccagataggaaatgtatatgattgacattcacgaactaaatcatttgttactatcacctatacattttcatcagacttcctatgacccaaaggagagtagccatacttcttatcacttatttcttcaagtgcacacacatcatttaaacctaatttcctaccatttcttcctagtccagcctcactgaactactgttatttaatactcctgtgtctttgcccatgaagttttctctcactgaaggctatcttcatctggcaaattcctacgcatgccttaaaatccaagtgaaatgaaatatctcctgtgaagctctctttaaacccatagatggagttatcactaccacctggattttcccatggcattttgtacactcattttctgtatctcttagcaaaccatatgctaattacttggttaatattctgtcttctttactaagttatacactccacaaagacaggatcattcttttatgtatctctaatgtcctgtacaggtcttggcacaagatactaatcatgattattttcttaaatgaaaagtattccttgttaatttctttattccgtaatatacttaatataatctttacttaatataatataaataatatatacttaatattatcattaatcatcaacaatataaaattacagttcatattgaaaatagcaaactatcttaagtccaaaccagtgatgttcaaattaacatttggttgagtatcctgatgcagaaaattgcctcagttattcaatatagatgagaaaagaaattcttaatagcttattagagaaaggttaacttatttctgtcatgatattagctggagttggggaatagaacagtccttcatgtactaatatttctaaagttatgggtctggccctcactttggaatttttagaaatgtgtcctttaccaaatactacactcatgctttccttcagtgggcagaattgccagccacaggaggaatatttgcaaatgtggtgtgggaacgttggtgtgtttgtaacaagactggcagatgctagtggcatttagtagtcagaagctagggacgctcagtgttcagcaatgcttgggaagcctcacataaaaaagaaatgtttacctaaaaccataatagcacctcattgcttatacccaataatttaagggattcaagaatcatcttgtattgatttttattactaacttctgcagcctgggttacactttggaaaacattacagtctcctcattagtctatgcctgtaatggaatttcactattaaacacaaattcttggctgggtgcggtggctcatgcatgtaatcccagcactttgggaggctgaggcgggcggatcacgaggtcaggagttcaagaccagcttgggcaacatcatgaaacaccgtctctagtgagatacaaaaaaattagctggggtgacccatgcctgtaatcccagctactcaggaagctgaggcaggagaatcacttgaacccgggaagcggagggtgcagtgagccgagatcgcgccattgcactccagcctgggtgacagggcgagactccatctcaaaaaacacaaaattcttagctagaattgttaactaaatggaactcatgttggaaaacataacgggaaaaatgcatcaattttctgcattacttcagcacgttttctggttaccatgtgaccaagtagaatttcattgatggattactaatagaaagtgtatttgttgcccaacttccttccttttctgtgtacttcatgaaaaccagctgttttctttggaactgattgggttactttctttgtctttttttttttttttttgtggcaagtaagttaaatactatgcattagtaatatatataggtaaagtaataaggtgtttccagaattccttagtaagtttatcctctaagagaaaagcaataaaaccaacacacgaaattagttgtatgtcatgtttccttaaagtaagtatttttaagtagagaaaaaaaattagtaaaggattttgttactgctagatctggatttgaatcctagttgcaagttatgtagcaatgggtaagattctgatgtcacttttctataaaaacttcataggattttttgttgttgttcaggattaaataacatatttcatgtccatagcaaagggtctggctcagaaaaaaaatggtagataattgttttcaaagaaattaattacctcattaattgtatttacatatctgaagaaagactaggttaactaatgaaaagattgaaagagaatctcagtgtatattagtaattggctatcattgacttaaggagataattccctgattcctttattgtggggattttgagttgattgacagaactatcccaactcttgatgattccatcgggtaggttaaggatgctagccctttatgtcccattaatttcattgatctggctccctgtttgccaagtaaacctctactattatttttgtttgtttgttttgcctgtttatgatcatttccctagctggagtgggtatactgactagataacttaacagttggtttagttggcagtcaattctcattataaatcaacttcctatgctggtctatggggagttttgttattgaaaagtctatatcagtagatttcaatctgatcaattgcagatgcattgacaaaaattaaatttctggaactgtaaagctaagggtgggactctaagctaactatttgtccacatcttacctgcagaggctctaaataagtggtaagctagtcctacttaggaatcaccatcattttctataactgctacaaaagcattaaatttgaagaaatgccaaaattcgatatctacattagatcctttgacttcatgtcctagtggaatagttaaacagtctgaatttgctgcatttattgaatagtcctggagagtcaaagaaagcacaaatggtaagtcaaatgtcaattctaaggactggaattggattccaattctaagagtcattggattgctttatatggagaaaggattagtgctattttggatttgcacagataatttgcatcttgaaattgataatctcttttgtatgaaagcctgataaaatcacatctgtctgtttcaagtagcacaggatcagaacagtacaataaattgaaaggagcaggaaaatgggcaaatgggcttaaagtagttaagaaaatagagagatgaactagtgaatcaaattgctcaacctttttaatatggactggataatgactaagaagatggttttcagttggtttttgtgtatgaaacataaacaccaagggaaaagaggtgtttaacatagaacaaacatgtataaatagaagacctggtgatgaaaatgagaaaaggaaactttagtgtcaatatcaagtaaatttttccaagcataagaactgcctattagattacttaaattgctcataaaaaaggaaaccaataactcaagtctcaagaaatattttaatccagagaaaaaattcagtgaaacaagaggtaattattagatctttttggttatatttatttttataaaaacttttgttgtgacttcttgcagtaagcatatgcttaacttagaagcataaactacttgtgcaggagcaccgagagtcctttttggaataaggttaataatggatatattgaatggtagatattgaaacaggtaggtacgtaggcagacagattgagatagataaatggttgaacagacagaaaaataaatagataaaatagtttgtatttcttaaaaaattaattgatctttaaagtcctttaataattgcataaaggttattgttttttggaaatgtatgctattcttgtgagcttgggggtaaatggcatatataatttcaaatgagaaaaatatacctttttccagaacatctcaaatgtaggtttgtcaggcctattacagtatttctcaaacctagctacaaactacaatcccttaggattcttgttaaaaatacaaattaccaagatctatactaacccattgaataaaaatctttaaagagaaaggcctgtgaataggaagttttaaaaagtactagtgaggtgcttatataagatttcttgaatgtaactacatccacagacaacattcataatgccatccataattccagggttaagagtttcaatctgtaagctttttctgacttaattttggtctttggaaaataactggtatacttgatctcctggagtgtattttcagttcagttccctaagaaagagttgaaagtctactatgtttaagtctttgctgagtgctggaagatggggacagagttagaggaggtagtaacaacaagagacaatgacaacaaaaaacgggactcctgcctacaaggagtttactgtctggtttggtaaaccaaaataacaaagactaattgaagcctatgcaagacagtatatgtggctattaaagaagtacaacaaggatgtaaagaagattgagatcagtgattgagttgcatcccagttacaaaaactggatggacttctgcatctcatttagtctagtggggtggatattttgcagtggaaacttttgaaaggtgagattttaatacccagtattaaatcctctgaaagaaatgaatgcaatagaggcaggaatgtgcatgaggtgctttctggccatcaaggagaccatctaagcagagcaaaatgtcaccttttctcttttctccatccatcactgcattgtcacagtgttctctgaaccaagattatgcagaaaattaggccacagtaagaaatgttctgctcttatgtgggttcaaaaggtagggacatgaggaagctttaagggttactagaagctcaaagtgtgcgaggaaggcaagcgttgcacatagtgggggttgaatacagtgatacatgcagggagtttctgacacatgggataatttgtagtctaaactatgaggtactatgaatttatttgcatactttgggtattttaggcaattctctaatgttgcaaaacgggaagtagcctataaaataatatgtttatatagtattttctaagaacatcaaattgtttcctcaagactaccacattatcatctatttttaaaagatgaattttgatttatagttagagtcaggactggctgtctgtactctaattcagttctgagatgcgcttctgacctatttttgtgaacacttggaaaacatctgctccagatttgagaaaaccatgtgttaatttttttcttctctctctccttctctccctccctcacttctcttcctccctccttctccctctctctctcatcttgctggatgtgaaatttgaaccaagagtcattaagcttcctgtcttacccattctttacacagtttttatacaattttaaacattaaaaggtcttctttttttctttcacaaatagcttcagcaaaagtggcagaaactaattgataatcttacccaggctcaatactccaggattacttgatcgaaattcttccccttaagaccgcttctcttccccaggctacccaggcctcaggctctttggctgatttgctctgtgctaagggaaacccagatctccatgtctttggtgagcagacagatgggaagggccacagttgtacagcattgtcaaaaatgatatcataaagttctacttttgatttttaaatagaatctcaagagaaagtattttcccactcagccttgtgtgatgtcattcacagcagaagcacacagccctcattcgttatgaactgctagctgtaccacaatcagcccccttcagatgtaactgcccacaggtcaagagaaagcagtcagtcttaaacttggcttgaatagtcaactgagtttttgctgtccctgggccctcaaatccctgctttcatgctgtgtcagaactaggaaggagaagagccagcaaaaaattaataatttcagaataaaaactatagagttatttatcctaaaagaaactaataaaataaatacacactagttagactaatctagcaaaagacagagaaagtacaaatattgattgtggtttggtaaagaggaaagaattgcagctatagaggaaattaaatatttgaaaacctagataaagtaatcgattttttagaaaaacataaactaccaaaatttacttaagtggtaaaaatctttttttttttaacttcttgccttttaataatatctttgaatatagatggtttcaattctccaataacaagatgtagagtgcccaaatggtttttcatacatgtttccctagtccagacacccaagagtatgtccctctcttgggcataagaaaacctagagttatatttagggcatcatgtgtggtgaatagttgaccgagctgtcatgctcacaatgaccaaattatgtttgtcatattttaatccaatacattgatctactatgaacttgtaaataatgtatttgctttctagacacattccaggaagaccagagaaactgacttttatccatatggaataatccactggcaaatttcttttaggacagaccaaagctgatctagaacataatctttacatacttggatccttcccatcagacaagaaagaacatctggggtgaaagactccattagaagagcaatgtgggatggtgctgtgctgacaactggtaattcctgccctacatctttgtagaggactggagcccagagcatgccatggtcaacttgtatgttgaagtgaagacctccttcgaggtgttcatgtgcttattacagatatgccatggtgctaagtaccccaggactacaggaaaaaataagaatagatgttgtatccatgatcatgaggcacacaggccagagcgccagctgtggaatcgcacagcctgggttcaaagcctggctgggccatgaccacctgaatgacctgaggaatggtctcaggcaaatttgtaaaaagtggagaccctgcctgccagggaggcatgtggtaagaggcgcatccagtcaggtcagggcaccgcgttctctctttggaaacctgtggagcgaggctggtggcccttgaggccacggcagccatggagaaggcgggcctggctccaggcagcacagaggcactggagaggccccgggggagcctggcgggatctggctggtcctgtgctctgcttccaggttctggccctgtaacccgggggacagggccggccaagacagggccactgggtgccagccagcacctgggcgaggtgccaggtggaagggctctggcggatcagccccgcacccccaacagccccacgggggggcccgtccagggccacacaactgcccccaggagcaggacgtccctgaggctagagtccagctggaccggtggaagggtctcaccctttgccctttgactcctcttgtaggcaccctcgctgggctcctaagcactcctccacaccctggctctgtcaccagccccatagtgatgtcataaactcccagatgcccagtgtgcacccggccacagagaagtgggtgacttaggagtatcctctccgcttctgacccttggtttcgtctgtgcacaactcactcaaaatgggcaactcattaagcatattttgttcctggttccgccacaggtcctggccatgccattggcaacctgctcgtcttgtccatgaggccttcccagctggccgggctaaccccgcggctcctgcacctgtgcctgcccggggaatcgtgggccgtttcccactcctcttcaaccctcagcgacatcttgggccttcttttccagtcagttgggacggcgcccctatgaggctgtgtcttatccctcggaacatgggcaccccacagagggtcctgtctcctgtggtctggagccccgcctcaaggaagaaacccatgctgtctgctcacaactccaggatgtttggacacctcagccccgtgaggattcctcatctcagaggcaagtttaaccttcaacttccttcattagatgagcaggtgatcccagccaggctcccgaagatggaggtgagggcagaagagcccagagaagcaacggaggtgacagaccaggtagagacccaggggcaggaggacaataaaaggggcccctgtagcaatggggaagcagcttccacctctaggcccctggagactcagggaaacttcacttcctcctggtacaatcccaggcccttggagggaaatgtccacctcaagagcttgacagaaaacaaccagactgacaaggcccaggtgcctgcagtgagtttctactccaacggccatggagtcgccagttcacacagccctgctggaggcatccttccctttgggaagcctgacccacttccaacagtgctccctgccccagttccaggctgctccctgtggccagagaaggcggccttgaaggtgctgggtaaagaccacctgcccagctctccaggcttgctgatggtgggggaggacatgcagcccaaggatcctgcagctcttgggtcaagtaggtcttctccacacagagctgccggccacagttcccacaaaagaaaactgtcggggccaccgctgcagctgcaaccgacccctcccctgcaactgaggtgggatagagacgaggggcccccaccggctaagcttccatgtctatctcctgaggcactgttggtgggtcaggcttcccaaagagaaggacgcctccagcagggcaacatgtgtaagaacatgagggtgttaagtagaacatcaaaattcaggagagtaagagagctgcttaggaggagaaagaagagatggtagggcaggcgtggtggcccacgcctgtaatcaagcactttgggaggcccaggcgggcggatcaggaggtcaagagattgagacctgaggagcatctctgcctgcaccatctgggaagtgaggagcgcctctgcccggctgctccaccgtctgggaagtgaggagcgcctctgccaggctgctccaccgtctgggaagtaaggagcacctctgcccagctgccccaccatctgggcagtgaggagcgcctctgcccggcccccgccctctctgggaagtgacgagcgcctctgcccagccgcctcacagtctgggaagtgaggagcgcctctgcccgggccctgccccgtctgggcagtgaggagtgcctgtggagtccgccgccctgtctgggaagtgaggagtgcctgtgcccggctgccatcctgtctgcaaagtgaggagtgcctctgcccggcccccttacactctgggaagtgaggaacgcttctgcctggccactgccctgtcttggaagtgaggagcgcctctgcccagctgcccaccgtctgggaattgaggaggagcactgcctctgcccggcctccatcccatctgggaagtgacgagcacctctgcccggccgcctcacggtatgggaagtgaggagcgcctctgcccagccgccgccctgtctgggaagtaaggagcgcctatgcctcgccgccgtcctgtctgcgaagtgaggagtgcctctgcctggcctcctcaccgtctgggaaatgaggagcgcctctgccttgccgctgtcctgtctgcgaagtgaggagtgcctctgcccggcctcctcaccatctgggaaatgaggagcgcctctgcctggccaccatcccatctgggaagtgaggagtgcttctgcccagccaccgccctgtctggaaagtgaggagcacctctgcctggccccctcaccgtttgtaagggagaagcgcctctgcccagcccctgcaccgtctgggaaatgaggagcgcctctgcccggccccctcaccatctgggaagtgaggagcatctctgcccggctgctgtgcaaccttccaagtgtgaagtgacagccttgtgtgtgatctttctgccctccccaagtttgcattttcgacattgaagtttactttttaattaaaaaaaaggagattgagatcattctggccaacatggtgaaactccgtctctactgaaaatacaagaattaggccggcatggcggtttgtgcctgtggtcccagctactcgggaggctgaggcaggagaatggcttgaacccgggaggtggaggttgcagtgagccgagatcgcaccactgcactccagcctggtgacagagcaagattccgtcctgaaacgatgttgtagttgagagcaggatggtcttttgggacaggaggaacaagaggttctggttgccactcttcaatcagttcttctttttcctcgactgtaagatcagatcattcttgtaatttgtaagtcttagagaaaagaagtctgatttatccagagtatcagaatcccttccaaaataagatagtaagcaggagcctcgtaaagcgcctgtaccatctccacgagaacccactgctccgtggcggtcgccatagttagtcgcttcctaagtggtaaaaatcttaaacaggtcaataatcatagaggatattaagaatgtcagagagctacttcctgaaatattgccaaacttaatttcaaagttaaattcttttatccttaaagaaacacacaattgcaaagccttttagagtatttcagaataaaacaaaattaaggacaattcctgattattttgaaagccagagtaacactaataacaaatcctgagaaagtaaatactcgagagaaaactgtacaagttcacttactatgatgagttaaagaaaaacctaaataagacccaacagtacattgcaataataacatattatgaccaagagtggttcattcttgaatagcaaagatgttttcatattaggaaatcaataactataattcattatagtaagagattgatagaaaaaagactaaaatctcctttaatatatgcataagaggaatttaataaaatccaacattctttcctaataaaaatcttgaataagtatggattatgttatgctttcttaactaaatgtgaatttatatttatacatacacacatatatacaaattatatacacatatcaaaagatcaatataaaataataaaggtcatatgatatttagattgaatggtaatattttagaagtactgcaaatcaagtcaagatcaacttaagattatcttttatcaccagtgctatgtaatataattcaagatgtgctgacgaatataattagaaaatagtattatgactatttaaataaagaaggaaatattgtaatcatttgaagttgataggattttgttactagaaaactcaaaacaatgaaataaaattaaaattaataaaacttttaagagtttttttatattctaaatgatgactcagaaaaatttactgaaataatcccaattatggcaataagactataaaattcttgagactaaatttaataagaactataaagtttgtaaaaagtataaattaatgaagaattgaatagatggatattttcaatcttggactagatgatttaacattttaaagacaccaatatttcctacattcatatagaaacgaaatgcaattccacataaaataccaacaaaattatttttagactgatttagaagaaagtgtcatgagggcttaataaccctaccaaatataagatatactaatattgattaataaagtatagaactggcaaaagaataggcagattaatagatgctatagtttggatatttaaccttcaaatcccatgttgaaatttgatccccagtgttggagttgggacctagttgtttgggtcatgggagtggatccctcattaatagattcatgccctctctgggttcagggtttggggaggcagtgagggatttctcactgtgttagctcctaagaaagctagttgttaaaaagagcctggcaactcttgtctctctctctctctcttgctttctttctcgccatgtgacctctgcacacattggctcctcttccgtttctgcctgagaggaagcacactgaggctctcctcagttgcagatgccagcgcgccatggttctttcacagacagcagaactgtggggcagccaacaaacctcttttctttataaattacccagtctcaattatttctttatagcaacacaaacaggataagcccaagtggaatgaaacaaaaagagagaacctcacaataaactcaaatatatacaagaatgcaacatgtataaaaatgacattttggattagtggaaaaatagctatttgctaaatgtcaataggacaactggaagctttttgaaacaagtaaaactggagctttacttcattccctactcaaaattcagagtggatcaaataattaaatgtaaaaaaataaaaatgcaacatactaggagcaaacttaaatcaatatttttgaaacttggggacagaaaatgcttgaaacatgacaacatgtgaaagacataaagaaaataactgataaatctaaataataaaaatcaaaatcacctgtcagtcttccttaaacaacataaactgatgggcaacaactttggaagaaaagaatacaatataattagaaactccaggactaattgcttgatatacaaaatgcctaaatatcaatgaagaaaagataaataacccccgatgctcaatattattaataaagttatgaaaatttaatcagagagttcactattcatctatcagagaagcaaaatgtttgtgtcctataagacatttgttgttcctgggagtgtaaatttgcacaatttcccaaaaggcaatttggcatatctagtaaaataaatatcaataattttgacctgttaattttatttaattaacatttgcataagtgcagaaacgtgtatactgaaaaatccttgttactttttttgtctaattgtgaagtattggaaattgcctgaatccccactagtgaagtttgcacatatatgttatgctgaatgtgtatatatggagatagatctctatatgcagcaataaaaataattctaatatatacagaccttgtctagattatttattgctgtaacccagagcctagaacattacctacttattgatgttcagtacacttcttccacatggaatgagcaaaagtcttgttgttacatgccaaaagtaaattttaaaatagaatgcaacccaaaatcacatatttataaaaagtctgtctcttcaacatttgaccaaagtgattccagtggtctttacttcagaaatttcccatttcgagttcgtcaatttttaaacgttttctaattgttaaaataaccatgcaattatgtgattaaaatattgaaatatgaaaagaagagagcactcctctattcctttataccagagctatgctatttggtgttacctaaacttacattccttgtgattaaattaataattaaacagtaagatattacagtacagatgggggggatactatatcctaggaaggaaaaaagatgagcatgattaaatttcattaaggaaagcaaatacaattgggacaaggcttacctcaacttcatgaattaaggtttataatcacttttacatacacatttgttaaattattacattatttgccccacagagatgagatgaataatgcttagaaagactcatcatttttaatggagaatcaagacttgaacttgctttaatactccattcatttgctatagctctgacaaccatccccataaagcaggtgcctctagctgaggagactatctttttgggtgatagagaagacagaggtaaaggaagtgggttggatgagggaatccacatttctatcaaagacataattgtatagcctgctatttattactatgagattttatgcgcttgtcatatttttttacccataaagaaaattggagacattgggtcataatattaagacgttttcctactcaaaataaagttcacccccttctctgttgggccacaattcaatggaaaatattataaatcaaagatgaacacatgcagaaccaaatggacataaatatgctatttccatttctgtactgtttggtctgcttggatacatgcctatgagtaggtttttatttatgaaggcacaggacagattgcatattattttcctgtaatggaggaaatgagggtttattcacagagtactgtgtttctgggcatcaaaattactttccacctattaaatctcagtgtttccacaacgaagagaaaacttctgtgctctaaagaatgacagtgtgcaatttataatcaaaggttatgaatttccactttgcagcatccccttttcagacacctatggactttcaatatgtgttgcaactacgcttactgagataataatatcatcctagtaatgccctaataggattacaaggcagaatacaatgtcaggttagaatgagatacagtttttcttgaatgaagacatcttttaaaaactcaaactagttgttttatttcttatttttaggagaacatttagaaataatttgctttatgttttaaaaatcatgaatcactagctgttagaaggcagaagtgaaaatcattggtatattgcaactgctgttgaattttaattttcacttgtgaattctagtcagaaattcttgttattgaaacttgatgtattggtagtttattgcagacaaatctttctgagagcattaagactcattaaagaaaagataaggaaaatatgcaagcaactggcacatggtgctttccacctttgggaaaacaaggttatcttgataatacactcaatttactgtaagaatccaattcttttatgcttagacttccagcaaattcaacaactctggaacccagccaggaatctagaagtcatggcaaacaaggtcacatgctgtgaccatgtgagaagccacatgctgtgtgaaacagtcagtcatgaaaagttatgcttagaagaaagtcctatatcatctctttaaggtctgttggctttttcattacacacaatcctagaaagtcctatttccttatgtctactcctgctttcctccacattctctagacaatagtcaaaatgatctttttaaaacacaaaactgatcatgctacttcctgcttgaaagctttgaacataagatatgcccaagatacgtttgtggaaatgaagttttttctaaaatatgttccatgaacatggcagaataaacattaagtcatatctaactgtttacaattatgagacaaaatcagccctggatttaggaaatagttggtgtaagactaatgctatagactaaatgtgtcttcccaaaattcctgttaaaattctaactctggaggtgacggtattaggaaataatgcctttgggaagtgattatctcacaaagtcacagtcctcatgaatgggattcctttcattataaaatagaccataggaagtgctttcatcctttccaccatgtgaggacatggcaagaaagtgcattctatgaaccaggaaatgtgccttctccagacactgaatcatcaggcaacttgatcttggacttcccagcctcagaactgtgagaaataaatttctgttgtccacgagacactcagcctatggtattttgttatagtaacccaaacaaaccaagacaacttgttactactgattttaatcctttctttttaatgaattattcactgcaatagaaaagatcattattgagacaagtatctaagaagtttgggggattctatctttgttttctggatctaaatgatttttctcatttcgtcttatgtactgaatagttatattttgagaataataatagcagacatgcatgattagaaggtccagcatatcctccctaaacgtgaataagatcagaaaatgttgctcctttcaacagaaatgtgacataattctgtgagagtaaccccattctaaggaatggtttgtaaaaatgcagtagatccaattagaattgttaaagaacctactatgcaccaggcagtgtggtagacattttaaagtattgactctcattctatcactgaatatctacatccaatcttatgacacagggatttttaatcccagttttgcaaatgaagtacagagaggtttaacgtttactgggaaaataagatgtctctaaaatctcaggtagatggaaacaataattgatgtatgcttttctgtgtcccccaaagtcttaactcatttcagcattaactcaaaagtccacagtcaaaagtctcatccgagacaagacaaatcccttccacctatgagcctgtaaaatcaaaagcaagttagttacttcatagatacaatgtgggtaaaggtattggttaaatacagccattctaaatgggagaaattggccaaaacaaaggggccacaggccccatggcagtctgaaatccagcagggcagtcacatcttaaagctctgaaatgatctcctttgactccatgctttatatccaggtcatgctgaagcaagaggtgagtttccatggtcttgggcagctccacccctgtggctttgtagggtacaagctccccttggctgcctttgtgggctggtgttgagtgtggcttttccaggtgcgtggtgcaaactgtcagtggatctaccattctgggttctggaggacagtggccctctccttatagctccactaggtggtgccccaatagggaatctgtgtggggtcttcaaccccacatttcccttctgcactgccctagcagaggttctccatgagggcccgctcctgcagcaaacttctgcctggacatccaggcatttccatacatctgaaaactaggcagaggttcccaaaccccaattcttgacttctgtgcacccacacgctcaacaccatgtggaagctgccaaggcttggggcttccaccctctgaagccatggtccaagctctacattgacccctttcagccacagctggagcagctgagatgtagggcaccaagtccctaggctccttgatccagcacaaggacactgggcctggcccacaaaaccactttttccttttaggtctctgggcctgtgatgcaaagggctgccatgaaggcctctgacgtgccctggagacattttccccattgtattggggattaacatttggctccttgttacttatgcagatttctgcagctggcttgaatttctcctcagaaaatgatttttttcttttctatcatctcgtgaggctgcaaattttctgaacttttatgttctgctatccttataaaactgactgactttaacagcacccaagtcacctcttgaatgctttgctgcttagaaatttcttccaagagataccctaaatcatctctctcaagttcaagttccacaactctccagggcaggggcaaaatgccaccggtctcagggaagagtcacctttgcttcagttcccaataagttcctcatctccatctgagactacctcagcctggatttcattgttgatatcaatatcagcattttggtcaaagccattcaacatgtctctagggagttccaaacttccctacattttcctgtcttcttctgagtcctccaaactgttccaacctctgcctggtacccagtgtgaaagttgcttccacattttcgggtatcttttcatcagtgccttactctaatgttaccaatttactatattagtccattttcatgctgctaataaagacatgcccagtccttccacatggctggggagacctcacaatcacggcagaaggtgaaaggcacatctcacatggtggtagataggagaagagagcttgcgcagggaaattcccctttttaaaaccatcagatctcatgagacttattcgctgtcacgagaacagcacgggaaaggcttgcccctatgactcaattacctcccactgggtccctcccacaacacgtgggaattcaagatgagatttgggtgggtcgcagccaaaccatatcaagtgccaataaagagttctcaggtaagagagaaagttactaaaggaaggtcagagaaaggtgggctcttaaagttggttggggagtttgaagacaaaagaaaagcagacttcctctctccctagccttttctttcctcagcatctcacatgtctttccttcagagtgtcccctcctctctcaaaattggattaaaactcaatcagggttcagtggagcacatctaatagacaaggatgtgggtgggagggaggcttgtgttatgatatccctagggtaacaatgaagagccaccctggcacagacaagagggggttgcctttccaattgctatttccacttagtgctcccctgcatgggtgcacagcagcttccaaggataccctaaggatgagtttcacaggggaagaatctgactgtgcattcacaatacagctgaaaaactatccttcacgaagtatgtaccaaggaggaattcgttagctcaaatttttacttccattgtaaacactgaaaaaggactattttgaaaaacatggctttatttatttaggttttcctcattcctttattctgtttcagagcaaagagaaaacttagagtagaacaataaaagccaaaaggaagttacacacagacctgtatacaaaaaggctagatatgaatgactgctagattcttagacaactcaccattttcatgcctgatttgagtggatgacagactgctttataaggtataaaaatggtgattatgaatattttcttattttgttacctgacttgttaattggtttaaaacataagaattttagtttgtttttatgaattactttaaaagatgagctagatactattttccgcaagtatcataatacttgaggtgaatgaacagagaattaaaatgctgaaactgtcacagaatattttaatattagttaaaatctccttagctaaaaaatgtaactagttctttgtttcaaattttaattagcacatgtgcagcttttattttttctctttttaaaaaaccatttaataagcatgtataattttctgtttttcaattttcatttttcattgacaaataatacttatatatatttgtggagtacaatatgatgttttgatatgtacttacattgtagaatgattaaaccaagctaattaacaagtccatttttatcttagataattgctttacaacccagttttctgatacgaaattttcttgaatttcatactgaatagttatgaaaaaaaaacaaagactagtgtagaaatccaaatgaaaatttaaattcctttatagtcttctgagatttcctgacattatctggaactctgataaacaagagccaaatggcatgttttctgttttaccagattgcttaactaactataaacgataaacattatttcaaatacagttcacatatttttatgattgaatatagttcctttgccttctcttataaggcaacctattacccacaggtagagagtaattgagacttttttaactaaaaaaagttgatagatgtctgttcaacagagataactgatttggaaatcctaacccaaactcattatacatgagtttcttatttctatgtttctatgagttatacatgagttcattgtttctgtgattgccaagatgatgttgtgactgccaaattattagtaaatgtgctaccttatggaaaggaatctatagcaactatgaaaaaaaaatcaatgactctagaacattaaggttaatataggcattgtctaatgttctgctagataagagagatctgttgaactaagcaggtcagtgaatctcttgtactaattggagtcaactggactccagtagaaataagaccatcttgtgtgatatcttgagaaagagcctgagcttgcactgatatctgtgagatgtctccctcattaaacagagtaatgacccttggactcatcatatttaaaaaataaaagaaaggggagaaactgaaaaaagaattcttcgctgtcaaattatttattgcctctcctgtgtggaatgaaatggacaaaatttcatcctaattatctgctacctttctgttccttttatatcagtctatacccatcaactcacatgtccagactgtcccataaaagacaaaattcagaatctctgtcctttctgttcccctcctgccccccttctgctcttgctcttcatctctgtgatttctctaacaatgtgcattgttaactacttcattcttctacagccattcatttattcactatttaataatagcttctaaagaacagtaattttttccctattttttgttattctatcctcagtgctgggaacagtgtctggtaacagcagacaataaatagtttctagataaatgaataaataaacgaactgagtatcaggtactacactgatttctgcctcttggctccatatctcaatttattagctccatatctcaatttcttagctactcttgcccaccaggatttcattattctctcaattcccttcttagcatttgggacacccatgctcctgaacagtgtttggtgttacccagccttccaattttgacctctccagtggtttctggtggagacttcccaaagtggcctcggctccatagaatctctgccattgcatcattaaccagaccaaactcctgccaaaggttgaagagcagggagggcaaaattcaaagaataatatgaacacatactgcatttatagggtgaaattattcctaatagctttaagttgtataaattaactttgctattaattgttgataccggtggtcagtaagatttctcaagaagatccagttgggtcctaggcctctaggactacttgggaaaaagcaggggggcagtaggagataaagatatttggatgtataatgccaagaatataattaagaggaaaataatggttggcaatgaaattttagtatctttttttagtatcattatttcattgttattttgcctttgaaagtgcaaaagatataagtgtaatgacaataattttttcattcagtaataagtgaaataagtatataatttaaacacaaccttattaaaaattatttagtataagtgtaagctaaaagatagtattagcctcatttttattgatggaaaaaataagaaagagaaactgagtgagcctcttaagggtaaaaaatagtataattctccatctcgatgtatattgaaaatagaacgagaaggattcatgtgtaaaggaaaccagctagcatgttgtatgtcttatgttatcaagtaagatgcagaattcagtcacctataatctagtatctatgatccaatcagaagattctatgagaacattatcaaatcatacttcagaaattttgctcttcaggtattttcgccatttcatttcatctcggtagacgctaactcacaacattttctaattaatttaataatgctagtaaataattcttttatgtaatcactggccaacaaaaaacattaacaaattttccaatgtttcaatgctgtccttaaaatatttcattaatatatttttaatagcaaaggagaagtcatagtctgagacatccaggaggcactgaacagtttgcagtgatttcaaaatttctttgaaattttatcttatattctaaaaatacaagcacaatttcaattaatttccatgatatatccatatattgcctgcattctttcaggcaaatgccagaaaccagtaccaaattaggcagaaagaaacttatgagaaaatgcagacaaacgaaagactcagtcagaggacatttctatcaggcaaatgaaggactcagtcaggggccatttcagtcacgaacttgaatgatattgtttgtccaataaacattcaatcttttaagtttgcttatttacataactgttagttcccatatctcacatcttctgtttttggcataaagaagatagtttttcatgtcagactctgggtgaaaaatcacagggaaaggctttgattcatctagcttggttcagatttgcactagatcagtcaactagagctaaggaggcagagatgtgatgtaatatggaagccctctcagaatcatatggtgtcaagaggaataagtctctccaatgaaggataaaatgcttgagagatcaaacaacagcaatagctattctactacattgataactttaatataaaaggtaataatttacttactatggattcaaatttgtgttttaaggaagatgctttatattttgtactaattatttgtatatccttgtgtactacttcctattctgggagatggttgcatgatgacaatcttggtggggtgctgagatcctactatgtggctgtagaagttatcacttacatgggacttaacttggacatgattgttcatgtatgccagtgcaacaaaaacatggtatagcatagtgaagattgatgtagagatatgtagggtaagaaatttccagacagaatgaaatgcttgagcaaaggagcagaagtctgatactaactttttaagtgcattgttaaaacatggtgagaatgaactggagagagttgcttgcaggaagctatgtgctggaaaactctaagtaacagattgagaagtgtggattttatcttttggcaagaaaggtaaattagaaatttaaaagctagagaaggttatattcatatttgtgttttggaaaacaactccagcaggagtgtgtgaagttaatcagaggagcaagaaactagaggcagaaaacaattgtataagtcaactatatatattccagaaaaaggggttagttatttctagatttgaggaggcattgaaagaaggtatcaatcgaatctgcagtaaaatgagagttaagaaagtgggaatagccaaaactgaggcagacgttgagtgtgtgagtatgaacagcatgccaagaggttagtaataactagacactgataacttgaaagcaatgtaatgtgaatgcaaagtctttgttatttttagaatatatattaaaaatacttgaaacaatccaatagtttaaaatttttcaaaggataaaaatacctaaaatgcatacaaaaataatctatagaacttagaaaggaagtaagataggaagaattgagtcacatggcctaggagtaatgagtagatagatactaccatatgctgctcctttcaatgacttttttagttgctcttaaacaaaggcaaaaataaataaaaataagaatacatggtcaaagactcaccaaccaaatcaaaagtacagattatgacgccaagttactttttcttttttgcagatgacacggtctgtttgattcaataagcatcaccacacaccccacatctacagcccaattttctgcctaaacgagatccaacttgcctatttacagttcactggacttagttaaagctctaataacaattgttcaaatgatttaacttcatgatgtaaccagaaactcttctgcaatagcccagaattaaaatatcttttggccctggcttgtaacattgatcaagatgtaaataagtcacagcttgtacttgttcaggaaatgattctgtctgcaattttatctaaagtcaaaaatataaattaatcaggagtaaattttctctaaatattggaaactatttttggcttacatgtaatgaaaataaattaataataaactgtaatagaatggcatcactttgacaatttttaagaagtgtctgttacctatctatgttgttcatttcatcctaactagaggtgattattttgacatctgaaggtacagctaaacccaggattcatgttcttttattcagtaacttattggatatttacagatcactgacagtgtgctatactagacactgtggtaaaatataagatgattataacaactatattaacaaaatataaatttgtcgaatgttactacttgccagaagctatcctaagatttttccatttatttactcatttactttttgtaaagatgttatgagatctggaaacttttatctccatcttagagataaaaatacagaaagagagcaattaaataattttcccaagaatacacagctagaaaggtaatccaggttatctgtcaccagagcccatctatggtcaaagatgaaaaataatgaactatattggagcagtacagataaatgtcttgagagtacaaaggaagcaaaggtcaccttgatatcaggcaatctgaaaagtcaccagggaaggtgctatttgcaatacatctggtctgctttatgcctttgagctggccggttcacccctatatatgtggctagcactatgtcatcagggtaagttattggtgtcttcccggttggttccagcccccattcttgaactgctcccttagcccccttgcactttcctcctgacaggttccacatgtcctttgcttcctatgtcttactttgcacaccgataaagggttcccactcatcatatcgaattattattggatatcactgctccattaaaatttttggcttttccacttgagcatgactacaaggcctttgggcaagtttttctttgagtcacttgaactctgatgcagtgaagcaccaacctcatctctgggcaatacctacattagactgttcttcctgccaattagtttctaaaacaaaaactagacatacagacctcttaatctttcattgttactgcttccattttaggacactttaagtgcaaacccagatgcctaaaataaggacaaatgcagtcacaacatttacaattcctttaaagaacattgtttttaatgaatcatttgttcaaagcagaagtgaatcaatagtgtgctttggtctctttcatgctaaacctttgttgatggtacactgaattttgtttcttcactgaactcagagaccctgtgacatgctggggagatccagggatttagggaggtgaagaataaaaggatgggaggtaattcatcactgtccttccactaatcactcccaggttttacataaaagatgcctagttttctttgttcaaaccatatagtaacttaacagaaaaaattgtcctcgtggattgcaatctcaaattcattattaccatgccatttcccattcatttttagttttaaaggaaggaaaagaagagcaagaaaatgcattctgaaataaaaaattattgaacctgtaaagcttgtggttttcgtcataattgttttcccttttttcctgattccttttgagctggtatatttccctctagagaagctaagggaggcttccttccgctcaattattttagttagtttcccttctcaatttaccaaatcttaccctactaaaggaatttcatatttaaagattagaatatcgatcactaaatttgctagctgtgaaaacacaatctgttttacataccaataagaatattttgcttcagaatcctaggataggaacacaaagcaaagagaaaaggggagctaaaagaaaaaattctcaaaaggaattcaacaaaactcgtatttaccaaacacaaaaccactcaacacatcaataatataccctctactgtgtagacatcacagtatatctgggtatgactcataacagagtggcctttcaaaagacacttaaacaattttcattaatgcatgtatttactcattcattatatatctgccaataactaagtacctgtataggcaaaacactatgctaggtacagagcatataaggatgaaagaaacaaacaaactaaccaacaaacaaacaaaaacccatagcctttgtctacaagaacacctaatccaaaacaactacaacacaatctatcataagtcatagatggtagagctgaacttgttttctggagccagattgcttgtgttcaactccagacttgtccggtgctacttaccagcactctaagcctcagattcctcagtgggaggtacctaccggatgcatttgttatggttaaatgagataatgtgcacagctatgagacattcaaatgacatcattcactggagggatgatctttttgtttagtgttagaaggaagcttgagaatgctttatggtatttatgttggacagtgaaggaagaatatgattttaacttactgagatggggctggaaagagtgtacaaatcaaatgcacaaaaagatttttttaatttaaagaagagaagaagtcttctcttgacattgtagaacttgtacaaatgtctataatttgacattgtacaaacatgtattggggctttctttaaccaataacattattgatgatatttccttttttttttcctggaattccaaagttgggtctttatttctcggcaaaaaacaaaaaacaaacaaacaaaaaaatcagagtgaatttatggattctatcaattcctcttgtctactattactcttactcccattactctgtgctatttcatgtacctactaaagtatgactcttctggggtttctatgaatgccacagacagtcaatgagaactctcatcaatgtgcagccagaactcaaacctctcgaagttctgtgtgactctgggaatttttaagcatactagttcctagatggcatttttccagcctgtagaatcccagtctatgggtacatggtttattactgaggaagagcctcaagggaatgtatatgcagattcctggagcttttacttaatatagcaccccccccccccacttttcttttctccagctttcttgtcctgcaaattccagcaactttagaaagctgaaaatctgcttctactcaactttgtaagattcccatgctctgttagggatccccatttctgtgccatgatcagtaaagtgccttgaggcataaattctacgtgatcctccttgggcttaccttgctcatttcccttccctaagagagcccagtctttctctgttgtctaatatttttgtttgtttccttttgagacagagtctccctctgttgccccagctatagtgcagtggcacgatcacagatcactgcaacctccacctccaggattcaagcgattctcatgcctcaacctcctgagtagctgtgattataagcatgtgccaccacgcccagctaattctttttttgttatttttagtagaggtggggttttgccacgttggccaggctggcctggaacccctgtgctcaagtagtatgccccctttggcctcccagagtattgggattacaggtgtgagccactgcaccccacctattgtctaatttttaaagcagttgttttctatttttgtccagttttctagtgattatggtaggataataattcttgttctaggttactgcattatggctgaagcagaagttgctcaaattggcatcctacagataaaagagcccaccaggtgattctaacagaaagccagatttgcaaacaattcgattgggcacagtagtcatctccttctccacacattgggaggcttcttcatagaagtgaggagatgtggttttgccagccagtatctcctcagcccttttttggtaaccattcccaatttttccctgagtggtcatgtttatactccttcatccctgaaaagacaatttctctggccacagtgacttgattctctaaaacttaatgcttgtacttctgggaggaaactccccttcttgttacctggatgagaaattggtgtgcagtgggtttgagcagggagtgtggtgataacatcatttgtgccctgactcctgctgagcctaaagccagatctactcccggatattttaggtccattagccaatacagtttttgattaagccatggtttctattttattttacttgtaataactgaagcaggaattatgtcttatttcaaacattatgaagtcctgatgcctaccgtagggctctgcacatctggggtagtgtgaaaatagcaacaggaaggcttcttcaggaaaaataatctagaaactagaaaaaattgtttcctttgccctccaatctctagagtcaaattttctaaatttaagagtaccaacttcatgtgtttgttaaggagctaaagtacctttcataacaggtgttattgtttcatttattcttaatttacattgctaatagcctgcttttcaaaggcacatacttggttctaaatggctataaattagttttcaaaatgggcaagtaacgtttgtgcagagccatgtgtataggacagacatatgacgcatattgctctaaaggtacatgcaaatgattatatggatggctgatgccgaggcctacagatttgtggaacctaaattgtattagggtccttgtaacacgcatgtattacaattgggacaataaaaatagctgataaatgcagctgtcacctccattttcacacaatgggagttgtattcacaaaaggcactggaattactatgtgtggctttgccacccagcattccttcatacatctttcagtaagtcaatgaatgaatgaatgaataacaagcacttactgaacagctggtctgtgccaggtactatgttaactgcttgatatatcttatttacaaatgagccaaacatctgcacccatgaattcaactctttcaagcttttgataggcacacacacacaaaagccaccaaaaacaatgttctgattaatatacggactaaatattttgtagaaaatgttaaaaggtgtggagacttttattattttaatttttaatttgtatactttaacaactcaattcactctcccacatagttgaggcagcagcatgcagaacaaaaacacatgatcaaactcaaaccattattcatatactgactttgttttttgctaaaattgaaatattctttaaaatgagtagaactgaggaaagtaggtaaaaaaatttttataggataatattcatttttactgtatttaaagtacagtagtccagaatttccaatcagaataagaatgaggcttttagaaatcaatactttacaaaagcaaaaccggaagaaaacatattcagtaataacctatcaataaggataggaagtctaactttattctttaaaaatattcactaacgtatccattcaacaaatagttatcaagtgcctattatgtgcccagacactgttctgggttctgatgttacgtagtgaataaaatggacaaaatcaatatcttcatggagattaacatttattgaatggacacgagaggcaaataaacaaataaatatagtgcataatcatgagcatagaaaacatacagcatgggagccagaattgagaaatggaaaggtagctggaagggacagtggggtaaagaatatgctgttttatgtatttcccagatgagagaaagagtagcttaaactttgcacctggaattttccctgtctggattgcttccttcccaaatatctgcaatctagctctttcatatgttctgtttgaatgtcatctttccaacgaggccttctctagtcatggtatttaaggttacatcccttttgacccaccagcactccctatttcatctatatttttaaaattatcactgttgcttttgtttattatctgcctgagcccgacaacaatggaagttccaaggaggcaagaataactttctgttgtattcactgctaagtttctatcacttggaacagtgccaggaccatacctggtattgaatatgtatatttgaatgaatgtttgaataaataaatatgtgagctaggagagggcttgacacattttgaggcacggaaagaaggttggttggatgaatacaatgaacagacactacatgacattgttccaagtagccttatgtaaatatattacttaaattaatacaaaaagttcacaaggtagttattattatccaaaagaaatagaaacagcttccaccggcatgtaagaggattatagtggctatccactgaggctatttcagtggcaggaaaacagctagaaaatgtaaagtaagaagtccctaaattttgagaagctacttttgatttctctgaggtcttgagattataagggtggtggctggctgcaatgtcctttggaaactgcctctacttctggaatcaatggtatatcagcttcctagtgctgtggtaacaaattatcacatatttaatggcttaaaacagaacaaatttattatagctgtggaggtcaaaagtgtaaaatgggtctcagggctgcattccttcttgaggccataggggagaatccatttccttgctttttccagcttcaagaggcttcctgtattccacggctcagggcccagcaccactccaaactctgcttttatcatcgcatttccttctctgactttgattcttctgcctctctcttccctttactaacaccctgggagcaaacccagaaaatccaggataatcttcccatctcaagatccttatcttaatgacatctgcaaagtcccttggttacataagctaacatatttagaggttctaaggattaggatatggacaactttgttgggccattattctgcctatcacagatggttatgggcaccatcatccccaacccaaaaccactttctagatgtgtgagtagatattcaatgtaagttcggccaaccatcttttattttccaaaaatttagtatttggttcttgaagcactggtggtagctgtgggacaatgagttgaatgttattacagcagcatgaccataatctctaccacaataaatgaaaaccgactgcaacatgaaattggaaggagaggtgggtgtagagaatatgaagaaactgaaaaacccagtctgcagggaaggacatggaacaaacttgcagagggaagcagagtattagggtacccttcatttacaatctattcattactaaacctagctttaatgtccttgtcctggcaaccagaacagttttaattacaacaatgcttgatcagggtagggctgtacctgaaagggtcacttccacaaggtccttcatcaatactaaaaccccatcaaactggggagagaagttgttagcatcacagagggcttgggaagctctcaagaacactaaaaaaatgaagcaccttaagggcatggacagaagtccccaaatctagcaccatgggatttacatactatataaatatgtattgggactttagctaccaatgtatctttttttcaccaaaattccaacatctaaaccttttattgtggtcaaaatgtgggcctctggatcctggctgaaactcaataaaaacagcatctctgccgggtgtggtggctcgcgcctgtaatcccagcactttgggaggccgaggcaggcggatcacgaggtcaggagatggacaccatgctggctaacacggtgaaaccccgtctctactgaaaaaaaaaacaaaaaaccaaaaaaatttagccaggcgtggtggcgggcccctgtagttccagctacttgggaggctgaggcaggagaatggcgttcaggaggcagagcttgcagtgagccgagatcacgccactgcactccagcctggtgacagagcaagactccgtctcaaaaaaaaaaaaaaaaacaaaaaaaaaaacccagcatctcctaccactttcctgctgtggctactgccataaatgacataattaagaattcacggcccggcgcggtggctcacgcctgtaatcccagcactttgggaggccgaggcgggcggatcacgaggtcaggagatcgagaccatcccggctaaaacggtgaaaccccgtctctactaaaaatacaaaaaattagccgggcgtagtggcgggcgcctgtagtcccagctacttgggaggctgaggcaggagaatggcgtgaacccgggaggcggagcttgcagtgagccgagatcccgccactgcactccagcctgggcgacagagcgagactccgtctcaaaaaaaaaaaaaagaattcaccaggcactaaactagagcactttccatacattatctcactgaatccacctaagaaccctacatagaagaaaatatcgttattgtcattttaaacatctcaaaactagggtaatcttgacttaaagtttggatatttttgtgattaaaaacacattaattcctgagtgataaatccttaatcaaacctataaatttacacatgaagaagtagctttggagggaaaccttcagggaaagatggagaaaggagtttcaggagatcacaaagctgagcctgtgtggtcttgcttcagtgcattgtccttaagtaaaattttctcaattttttttttctggaagctcattcttctagttctcttctcgttttttgtctttgacagactctcttgctttttaatcttctacaaatgaatgttagggaacagaatgctggttgaaatactgcttttgcctatggcctattgcttatatacatgcacaactcttatcttttcatcattgatggactggagtaatgggatgccaacctactggagtccagtatatgtaattacaaacttgttgaaactattctctctgactgtgcctattaggttcagctcctaggtgcataactgtcttaaaattgtgtaatctgaaggctccaattcagcagaggcagttttccccttcaaaatactctcattgattgtagttttaaagacagcttaaagatttcaaggtctgttatatatatatacacatacaaatgagatgctttaggacatactgaagtgtatcagtgtattacactaaacaacaacaattaagcatccaataataccctgcttaaatttttgcttcattttcctcatattcttcatcctctattccaaaagacctggcagctcactctctttaaaatggtatttatatctgctgttttctcttttatactgaaggacttgatactgtgagatggatagctgaactctaaggaaatggaaaattggaaggtgagatataacaggaggaaaaaattcaaagaataaaactcttctttttattgagtctttaagggataggaccaattttttgaattatatatagagaccaatagaccataagatgagcaactcatctaccaccaggaaaaggagaaagtgcatctccatgggagaagtgtcacaatggggataggatcattgccatttgaacttttggtaaatactctcttgtaagaggcatgagccagcattactagtgctctgccacactgtctttgtgaccaagaatggaacggttataagaatgtttgtttcactgtgtgtataattagtgaggaaattatttttcattaatgcctttagcatagcatgtaaatattaagagactgatatgtactgtgcctgttaggttttatcttattgagccactggaattttcccatgtcttttagggatataaattaatcatttaaagtcaggaaccctcaactggacacaatattaggagtagctggttatagcaatctctgctttaaaattgtattctttatagtccaccaagctcagtgaggttatatccaaactgaaaaaaatctatgttatataaagttgaggtcttttcactacaaataaaggactgtaaaagcaatattttctaagatatcaatgtggatgcactaagttttttgcagaacagaataatgggaaaatgcatacaccatatttctgttaagctattccaaagacttctcagcagaggatttggcttagtgtgggtgacaactgctcagtatgagctgcgacatttctaaaatgagaatccactcagaattataagcttctatttctgcattaattgtaaaggtttaataaaataaatgttctcttctttaagattaagaagcaagctatggaatcaaagcatactgggtcagaacactgctatgtaaaattacttgctttcagtttacaaaatgccacttgctcatgagtctttgcacatgctcttctttcctcctctctcttttctttgtacccttactcttcttaagtctctccctctctctccctctgtctcacacaaacagacatacaggtacacacacacaaacacacacacatatatttcacataagcatgtgcacttctaactaattcttgcctaaccatcacatttccttttagacataaccacatatagggagatgactctgattgaggtctatattttgcatgattttctttggctctctcattgtaccctgtactaccattgtgatatacatcacaccgtatggtgaatgcatgaacacttttttatatctcccagtagactgaaagctctgtagagtgggaaccatatatattatacatcgaatccagtgcctgctctatgaaaggtactcaataaatgtttatgaaacatatatctttgggatgaattcctaaaagtcagatttcttagagatgggggagagagagaaagagaatttgtgtctctgtgtgtgtgtgtgtgtgtgtgtgagagagagagagagagagagagagagacagacagagagaaagagacagagacccattagcaggcttcattctactggccaagtattgtataagggtaactgcctgcccataccagcatcaggcagatttcgtgtttagtaagaagaatttaatctactctcttcatttcatgtatagcagttgttatcataggaactggaagcttacacaatcattagaagggccaagaaagcaaagttgtggaagactgccaccccaaataccagcctgcaacagcaaagcctgttcagtagctcacctgaggccactgtgaacctcaacaacctctggaggcacccacaaactttctcaggcaaatgcaggtgatcttcaagatgctttccaggaaagcattttgaaccctacacttgctcatgtgtctgaccgcaactctctccagagaagaccagcccctctttctttttctccttccaaagctctcacaacttcctctcattggcagacagtggcatgaaaccataggggagggaggttctcagaactgtagttttacctcttcgtgattcagacaattgaatacaacatcctcaatgagacattgccaacttcaggagtgatttatcactattatagtaattttgttattattcatgtaatatagattatatgccaatattgggaactctgttccaaaatgtaatgactacgagatatgatcctttgctcaggaacagtctcactgggaccctatccaggaatatgcttttgcaacacatgtggtaagtcattagggaaaatactgagttagtgttacctgctctgtaagataaggaagatttcaagtcctgttcactcttattacaatgttaattctagaatctctccagcgctcttaggtgtttgatttatgtatcaactgtatgagctccaataactcaagacaactctggatgaagctcgttctctgatcttggcctaaattcttattctgatggtggaggtcaaggaggcaacatgcctttgtttatactgatatgacctcatcagaagataaacacctgaaggtaggaatgattaccacctttgctcttacttttatctaataaaatctgtgttgctccctgctgaaaatattttcatgactttccatagtatttaggataaaacgcttaagtattatgctcaaaattattcacatacaatcttcaaacctaccttgtaagctctactatttcttcaggcaccttccacagcccagtcacaggaggctactctgttattcttttatattgatgctcacaaaatcccttccatgtacgatgtttcttacgtagaatcttttcttcctgaaaaactcccatctcagttttcagagctagttcaatatatcattcccacctgatcgacaaaggacctttttgccctgaattaaatgcagcccttatttctatagcaccatggtactttgtctatacatctatagtagcagttttcatctgaattttaattgtttagataagacacatattttctccattagatggttatatcattgggggtaaaataacctgtatttcagtgtttggatttccattaccaagtagattatgctcaataaagattaatggcctgaatttaatacaatatctgacattaatataacacttcagagagtacaaaatgcttgcacatatattctttcacctaatctttacaacaagccaatgaggcagatatttttattatttctatattgaagataaggaaattaaaactcaagaatatttaggatctgctcagcacaccaaagactcatcataaatacttcttgattgatggtttgatatagacaattgccctcagctctttttgctattacagaaaatgtaagcacgtgtagtgtacttaacttggcatcagcagcctgtgtctcatactgttactcaatcatttaaaactcaagaatcatattttcaatctttcctgacaacttcctatacgaacatgacttaaggtatggctttgatgtcatcttagttacaaaattaacacaataatacttcctcatttgtcaagcttcccagactctgatttgattgcgatagcatttaccaagtcttaggaatccctgaaaatttagggagtgtatacatgcaaatgttattatagaaagatgtggatgcatctatagaattaacatttcttttcaacatgaaggatctcttctgttatcctctgataggattttcctactatgctgtacatttggataaaatcatagatggctattgtaaaggatggtttttttgagtaaatgtatgaatagaaatatgctagaaagctttagatataactagcttgtccaacagggcttacaaaaatgggtctcatttggaactggccaaagttctgaaagatttttctctttgcagcccagccattttccaaaactcctagggaaatccgaatttacgccttctgatttctgaaggtcatatggtacaaatgtgttaggaacttctgagttcatagatacatgtgcaaatctgcaatccaccactaacctgcatgaacctctctgatccccattatgttccccagttaaatgaaaataaaagaagtacctacctcatagggttaatttgtctattacatgtgataaggaatgtaaagcttggcatagtgcttgacacattaaatgttccaacaaatattgttatgattgctatggtggaaatataaaaaggagcaacaaataaataaataaaaagaaagaaaggaagaaaaaggaatggattcagaactccagagaccaggcatcttgctggccatttcctctcattcttaacaaaaattccatgaaataaatttcagtagcatccccattttatagatgaggaaactgacccaaatagtggatgatttagaggtctaattcatgtactattacctgttaaaagtgacgctgctgaaatttattctacagcctatcaaatactctttacattttctttctttttctttagcaggggcttttgttttagaccttccaacctccaccaagtgttttgaagtcatacatgaatctatgcaaatagagatgtgtcttccttttactgccctctgcacagatgctaaagtcctaggagctatgaagcctactatcggcctcccatcactttatctctgccttgcccctgagttttaacaggctgaaactgactggcaaaacattgtctatctgcctgacacctcagggcataaaacatggagtgaaatcaagctacagatacccgcagctcccacagtgttgtgataaaatttaaattgtgacttagagacggtagcgtatacattatattaaaatgtctgggctctcacatgtaggaagaggaagcttgaaaccgtagtttacaatctcagtaaacttggaacatgaaatgacttatataaatgaaatatacattcaaaatatacatcaacatggcaatagatgcttctgcagaaactttctaagtgttaaatatggttaaaaaaaaagtcagttaatttagacaccagaagacttttggttttagaatgctataagcattaatattcattacaaaaataagatttgataaccacagaaggaacaggaacaaagctttggtgataacaggaaattatcttctcaatgttcacggaacattttgttctccatcttcagaagttaaagttgacactgaaagttacggtttctttagactgtgcattttcttccataaatgtgctattttcatagctgagttctcatgtttttattctggtgattacaacataattgattctagccaaatgcatatcgtgaatattattattggcagctggaagatttccaatccatgaaactttctatcaggaaagggaagacaagaagtgaatagtccagtgtagcaaaataacttctattagcttctttctaagtgggaaacgatacgcactccattttcaatttttctgaatctatgctccattgggttatatcaggtttcacctctaacatcagccaaatagacttgaagagagacaaattgagactcaaaggataatatagtttttgcagacctaataaaatgtacaaaagtgaattgaaccgcagcatggagcaagtgttaaactttttttaatacatggaattggcatctgctagttccacttatttaaagttcctcctatattttattggaaacttgatacttcaaaatatttatagcatagctaatagcatctctaagagctgatctaatgtgtgtggaagcatttagtttcaactcattttctttaatactatatagatactatatataaaaatactatatatataccatatatagtattttatactatatatactatactatatgtatatatatactatactttatgtatatactatatgtatgtatattatgctatatatagtatatatatactatagtatatagtatactatatgtatgtatactatactatatatagtatacatatactatagtgtatatatactatatatagtttatagtatatatactatatatgtactatatatagtttatatatataaactatatatagttttttactatatatactatagagtatgtatacgatatgtagtattttatactatatatactatagtgtatatatactatatatagtattttatactatatatactgtagtgtatatatactatatatagtattttatactatatatactatagtatatatatattctctatatatagagtatatatatagtattttcccttaaataatcatttacaaaaacaggcaaaaatctagatttgcaacatgttactcattttgttttctctttctcacttttttcctcatgaaaagaaaactgtagtttctgagtgcctgttaagcaggtttgtgcagctaaaactctggtatgttaaattagagaaacaaaatagtcaaataattcttcagataaacctctgaagtgaattatctgttttcctctttgaatgtagactataagcacaatttaggtaaccactgcctcaaaagtctgtaatgacatttagccttcatacttatattttctgtcctgtatgtcattaatctgccactcaatatatgacctggggcaaggagctgtcttttgtgcttcagtgtggattagggaaataaaaccagatagctttcctgtaaaccatagcaagaaagcaaaaccgtctgctttatctgtcaccactgggctgcctccatgccatgtgctatctccctcaggtgaacttcttttccatggctatgtggccaggggtatcttcaagcgataaggaaggtccccagtaaactcagcagtactgtactagagcatttgttgtattgcttcatgtaaagttttctatcttgtggattttaaaagaaatttccaagtgtctattttataaatgaaagctacaagtgtgtgaatgacattacatattctatcttctgttttgcattaacatactgatcactacggtcattatttggcaaaaggaagagtgaggcaagtttctttgcttcctcccccaattctgttgtctttgtcttgcttcattctcagtcctcatgttttctatccagtttcatcttcactttatcctcactcagggatgaatgactgctaacagcttaaagaccagcttttccagataaaacaatatagttcaaaagatagacttgaggcattagccagtgagtagaacaggagtttgggaaggagaaggaaggttgccagtttatccaataaatatcatttttaaaaatgtcctctcccaagtaagagaaccccaagaaagagaaccccaagagtgtcacatacatcaaacattcacacatagacacacacacacacacagaaagaaatgtgcagcatttgcctaaaagagggaaaaacaatggattgttcactactctagttcacatagtcaaattgataaccatttgccaatgtagccttctatgtactttcacagaaacaaaaccacatgataagaattgaggttgcatcaacgtgagaaaatgtactgtttgatttttattagatttaggtaaaaattcatttccctaaagcgtcactctagatgccagggtaagctgttacagctggccaaaagagatgaatggggctgaagggagacagcaagtacaggaagcctgctagtctggggttcctttgcaaaatcacgtgcagctcttaccaccaaccagcatatccactgattttagattatgcttactgggctgcttccagtaggcacctacattgccaataggagggatgtattcattgactgagcagaaatattgtgtaaaaagtttcctatgaacaatgtttggaggattaaccaatttcattgttgcttgaataatgttgcctcattatcatctcagattttctaggcaaaggctcaggccagtggatctcaaagtgtgatatctcggccagcagcatccacatcccctggaagcttgttagaaatgcaaattctcaggtcccatcctaggtacagtgaattagacatgccagtggtagggccagcaatggtgtgttaataaacccttccaatgattaggatgcacattcaagtttgagaaccactggtatagtcaactttgggaagcctaatgaaatgttttcaaattgacagcaaagaccctgcttacagctcattgaaagactgtttagatttctctgacagtgtcagcagcagggttcattctcttgtgtcccagcctctagcatcccttgtgagttagtgtgtatagaaatatagtttttacatttgtttgtgtcctctcttatttcctcaagcagtggtttgtagttctccttgaagaggtccttctatcctcatggataagaagaatcaacatcatgaaaatggccataccacccaaagtaatttataaattcaatgctatttccatgaaactaccattgacattcttcacagaattagaaacaaactactttaaatttcatatggaatcaaagtagaccctgtatagccaagacaaccctaaaaaaaaagaacaaagctggaggcatcatgctacctgacttcaaactatactacaaggctacagtaaccaaaacagcatggtactggtaccaaaacagacatatagaccaatggaacagaatagagacctcagaaacaacaccgcacctctacaaccatctgatcttcgacaaacctggcaaaaacaagcaatggggtaaggatctcctgttcaataaatggtgctgggaaaactgactagccatatgcagaaaactgaaactgaactccttccttacactttatacaaaaattaactcaagatggatgaaacacttaaatgtaaaacccaaaaccataaaaaccctagaagaaaatctaggcaataccattcaggacataggcatgggcaaacacttcatgatgaaaatgccaaaagcaattgcaacacaagccaaaattgataaatgggatctaattaaactaaagagcttctgcacagcaaaagaaactatcatcatagtgaacaggcaacctacagaatgggagaatatttttgcaatctacccatctgacaaaggtctaacatccagaatttacaaggaacttaaacaaatttacaagaaaaaaaccctaaccaaaagtgggcaaaggatatgaacagacacttctcaaaagaagacatttacatggccaacaaacatgaaaaaaagctcaacattgctggtcattagagaaatgcaaatcaaaaccaaaatgagataccattctcaagccagtcagaatggcgattattaaaaagtcaggaaacaacagatgctggcgaggctgtgaagaaatatgaacacttttacactgttggtgggagtgtaaattagttcaaccattgtagaagacagtgtggcgattcctcaaggatctagaatcagaaataccatttgactcagcaatcccattacagggtatatacccaaaggaatataaatcattctgctataaagacacatgcactcgtatgtttatcacagcactatttacaatagcaaagacatggaagccacccaaatgtccattaatgatagactggataaagaaaatgtacatacacaccatagaatactgtgcagccataaaaaggaatgagatcatgtcctttgcagggacatggatgaagctggaagccatcatcctcatcaaactaacacaggaacagaaaaccaaacaccacatgttctcactcataagtgggagttgaacaatgagaacacatggacacaggaaggtgagcaacacacaccagggcctgttgaggggtggggggcgaggggagggaacttagaggtcaggtcaataggtgcagcaaaccaccatggcacaggtacacctatgtaacatacctgcacattatgcacgtttcccagaaattaatttttttttaagaaaagaaatgtagtttttatgcaggggtcacacaactatcatgtgtgaatgagatctagttcactgcctttttttgtaaataaagttttattagaatacagcctcactcattcatttacttattgtctattattgctttaacaccacaatggcagagttaagtagtggcagagccctcatagggggtcatgagagttatacaatgtgactacagaaaactgttgcaaggacattgcatgaaattccactcttatttttagatgtagcctgtatacatgtaagtgtctctgaaaggaattatacaggctaccatcagcccaaattaagacatctgtaggcatgagcttgtgtaaacatatgctattttggaaggccatagctaaggcccaagaagacaaggtcagcatggtaaaatttggtttggaaactaaagagaggaataggtttggaataagattgaaaaattcatatgttgcagcctccttctcatgcaaatgacagacattaccaatcaatcatgaggcttgtattctcaaagccctacctgggcctcacagcccttctcaacaaactttctaggcagccattactaatcttctgcaattggttcattggaggaaaattattgaccatcttgttgctggattaaagaaaaagatcaacaaggaatgccaggaaatgctctctagaacctgtatggggaagttctaaggaacacaggagggtaaaatagaaggggaggtcttaatgggaaaaggggaggtaggtggaaataaaagtccaacaatgctcataaatgctgtatacttcttttgtatacttccacaagttagctactaccctctttcgtttcttttgaaaataaagaagtggtacccattctcttaagtaccttgctagaggtaatgcagacaacaagtgatactatgaggcacatctggtctaacattaaagcctatatttttctgctaccttttgtaccattatattgttttgtctaaggctgcactatgtctaaattttacctttgaaactgaacttcttaaggttcgacttaaaaaatcctactggacaagtatggttaataaaggaggaagggagagagagagaaaaagaaagatgtaaagggggaggaaggagggtaagaggggggagagaaaaaagagagagagatgggggaaagagaaagaatgagtaagagagactgactctgagtctgatagactgagacagaaagagacagagagagacaggctggagacataattcagaaagtatacagacatttattctaaaaggagaaagtaaacaacaacacactttaacataaaactttcagtaagaaagcaaattggaaaaggcctaaaataactgcacccctatacatggtacaagaaaacatctgctgctttttctgacccaggagccaaatattcagtacaaattcttcattctctggagagcatactaatgatacggtggctgttgaaagaaaggggaaattaaaacaaaacacaacaaaacaaaacaaaaaaaaatcttcttccaaaacttcagagcaacaagaaacagagctggatttatgggcaggtgaagtaggtgattgctttgagaaatgccagaaaggcccagctacactgaaattgcacatatttcaggtaccagcttccccaaaatagtgtcttcagaacattattactttggtttaagcattgccctctttggacctcattttaaaggtaaataaacttggtagtgctaacacagtcaatcacagttcaccagtgtgcagacattaaagagtaagcaataatttcttgccacatccattttaattttttcaattttacataatgcaaggtgtttaaagtgtccttatgttactttactattgtaataaattctctcttataaataccataacactatgttagtattaatcaaatatgtttcctagaatattcattctgcataatcataacccatgattaacaggtaaatggtaaaaaaaaaactttagaaaatgtggcctagtttatgcccttcatgatatatcacactcagtacatgtcataaatggctctgagaaaccccacggtaattctatttcatcaatttttgtctaaatgcatttctccaagaaagtcttcactcccacttttcactatttgtattctttagaaaactgaaacacaattgtagaaataggactgcaaaaatatagttcttagctacacttctttctcctcatagattttgtttttcttgggcacatctgaaattttgatggctacagatactcctagggatttacagtccaggagaatgatatggaaaaatttttaaaaacgtatctgacattattctgaaccagttattctagggaatggtcagaaatctgcatcttttatactttatagtctgacaaatgacttacaggagtcatttctaagattatactttgaaatgtaaaggggataaaaggcttctgcttttaggaagcataagttttcatcactaaaaaatcttgtctaggtggatctgataaaacccgagaacagaggcttattatgagagacgctcaatcatttgggacatgtcctcagccaaccgtcttcttccattctccttttacctggtcaaaacctcttttcactccctagttccttgtcctgtcatactactgtgacccagcttcatgtccttgccttttggtacaatttgacttttgacattaacctcatcctatagggggattggaaaagtcgagagggagactcctacacaaactggtatttctttaaatgaagaggctcatattgcatgtaggaaaatttctaaagaggcgctgattctattcaatgatactacgaggtacaaaaagtagatcgattggcccagggtctgtttaagttaaagtaattataaatgggaaatgtgcctcattcagcagatacttacagaaggtcttttgcgagccaagtactgctctagggccagaggattcagcagtgaacaaaagagcaaagatctctgttttcacaaggctaatgttctagacagatgagacaatgaacaaaataaatgcaaaaatataagagtgtttataatggagaaaaataaatcatagaaagtgagtagggagtgttggagagagaggggacgtgtggagttggaattttataaagagtagtccaggaagatttagataagttaagaatcaaaaaatgtgaagacttcaatgagtagagaatcaataaaagtgaaaggtcatatagacatctggagataaaagaattccaggcagaggaaagaacagatgcgaaggccctgaggtaggagcaggcctagcatatttgacaagcagcaagaggaccagggtgccggagcagatcagcaaggagaagtgtagtagcatatatgatcagagaaataactggggacaaatccaccaaacttcacagggcacggggatttactttgccttttacttggagtgagattcaacatcatcagggttttggtgccaaaaagtgacatgatctcacttatatttaaacaagacacctctgactacagtagtggggacagattgaaggaaatcgatggtagacacaggcagaccagttaggagactatagcagtcttctgggaaataagtgatgctggctgaaatcagaatagacatactaaaggaagtaagaaaatgtgggtatattttaaagatagggttatcagcatttcctgatagaagatcaagagaagattcactaaggccaggcgcagtggctcacacatgtaatctcagcactttgggaggctgaggcaggcagatcacttgaggtcaggagttcgagtccagcctggccaacatggtgaaaccccatctctgttaaaatacaaaaatcacctgagcatggtcgcaagggcctgtattcaaagctacttgagaggctgaggcaggagaatcagttgagcctgggagacggaggttgcagtgagctgagatggcgccactgtactccaacctgagtgacagagcgagactctgtctcagaaaaaaaaaaaaaaaagacagaggattcacagattactccaaagttttgggcttcactactggatggatagaattgtcatcaatgaagaagaagactgtaggaggagaaaattaatcagtaaagaggagagattaatttccgatattttaggtttgcaatgcttatttcaagctgtgagttcaagataaggggggcagacataaacatttaaacttgagaaggacagagttatatatcttttgtgttaggcaaatgcatgcatacttactaacttagactatagtgcataattgttacttcttaacatacatatgataacgtgatctctaaggcttttccatagtctaaacttctatgatttaattgtatactatgagttgaatataattttttaaagcctcagagcccctaataactaggtaattgccttttaattccaaactatgatttgcttctttatctttctcccttgttctcgtcacctcagacattttcatagctcctggtctcagctatccaagcttgtaattagttgctctttagaataggctcgttaatcctttttaatatttccctgctatttgctccggactctaaatgtttctacttggcccttctttaggccaaaccatttcttctgctgtctagagctcaaaacctttgtgtggactaaacagctgacaggcttttcaaatgagtctaactcatagctaatttctacttattcactcagggcttcttctgagtgaatgaacattaccttggactacctgtttctctcatagtccacataataattgcttctgataacaaaataagcattttttctttaaaaaataactaaattgttttcttctttcagatgcagcagctcctgacttgcacatttataaatagctcctatttattaatggccatcctctcttcaaccacctgctaaagttgaaccacctgcacggcaattacaaagatgactgggccagagggtatgggaagacgcctgagatgactatctttcctgcaattttgcctgggaaaagctctgcttccggaaaaaaaattactgttatcttctctatcaccaaaaattgggacaatcaaattttttctaacccttttggatataagaggcagttaaaaaaaagtgacggagatttcctagacattcttatgttttctatagacaatgtttggagtatggtgacaagccaaggaaaatgcagaaatggtcactataactatagcacctgcttctatattcccataattaataaataatgctattcctactgtcatgggtcaaagaggtcttataggctgctgtgacaacatcatcatttacgtgtaattaccatgacacaatatgctccaagtttaaaacaaaggactttaaaactgattttgtgaacataatccatccttaattgcctataagggaaaagcatctcttcagaaactgcttaagattggagagagaggtgggaaggaaaaaacagaagacaagtctaaaagtttacatcaattaagaagataatctgggcagctgttggaggatatatcccagaaaagttcacattgtgaggccaacttttgtcttaggtacagggctatcctgcaaattcagaacaaagttcctgaggttagctttatacacctttccaaaccactcagaaatgaaaacaaagatagccagagcagtgatcttttttttctaccatattaggaaggaaagaaggaaggaaaaaaggaagggaggaagggaggaaggaagggagggaggaagggagggagggagggaggaaggaaggaagggaggaaggaaggaaggaagggagggaggaaggaaggaagggaggaaggaagggagggagggaggaagggagggaggaaggaagggagggaggaaggaagggagggaggaaggaaggaagggagggaggaaggaagggagggaggaaggaaggaagggagggaggaaggaagggagggaggaaggaaggaagggaggaaggaaggaagggagggaggaaggaagggagggagggagggagggaggaaggaaggaagggaggaaggaaggaaggaagggagggaggaaggaaggaagggaggaaggaagggagggagggaggaagggagggaggaaggaagggagggaggaaggaaggaaggaagggaggaaggaaggaagggaggaaggaagggagggaggaaggaaggaaggaaggaaggttggttcaaaagatgatgaaaagttcactgctttactagtgcctgatattccctggagaaccaaaagcttgaagcagttgtgatcaagggcttaaggcagccactctggttctgtgtgtactgcacatgtgcgtgtgcaaacatgtggtgtgtgtataaggggtggtgggtactgatggagaagagagagaagaggggactagaaagggggacagcaaaaaacaagggaaagaaattaagtgaaacataagaacaggaatacttagacaggttgccattaactgaggcctcttaatcttgggtccatgaatctaggcagaattgtagtgttgtaagttctttaaacgtttcacaaacatggatattttgacgtggtatggccaagacagccacattttcaagtttccttagctccatagtaattctgatgccaggctgtcttgtccataccttcagaattcctgagctgttttgtccataaatgggctttaagggttgataaacttccccaattgtaaaatttgggagtgtatctgtttttatttttttctcggaagaagttagtagcttgtgcagagttgcacagtattttactacctctccagtatgctaaaaaatactgcatcaaaagaagtcagtttctggttgcaatgaaccgaatatttttgttccccacaaaaatttacatgttgaaatcctaacccctagtgtaatggtattaggaggtggggccattgagatgtgattatgtcctgagagcagagcccaaatgaatgagattcgtgcccttataaaagaaaccccagagagttctctcgtttcttctgcaatgtgaggacacagcaagaggacagtcatctatgaatcacaaagagggtctgcaccaggcacagaatttactgatgccttgatcttggacttcccagcctttagaattgtgagaattaaatttctattgtttataagccacccagtctatggtattttgttaaaccagcccggacattctttgtggttttctgttcatccaatctgcaggtacaaaggtagctattcattaggaggagttggggaaggtcaagccactagtccaaactaactgataatagatactcttgctgaagaaacatctaaattttaaagatgatattaatgaattatgagaatttaacaactaatataccagacagatgtcagctctctttttgttttacactacagtgaccaaataatttgcaattgtgtaagtggagaaacaattatttgctctttgccagccaggtgccagttagcattttgaaggcagtatgtcttaaggattaaagcagctgcttagtcattgtttcttaatttctttaaaataaacaaccagtcccaaatcatattttcctagagagaatttaagagaaagcatgagaaaggtcccatggttaaattggctctaggcaggcaagctgggctttctgacaagaaacatttttgtgtaaaaataaatgaataaaataacttcgcttcacagcggtgaagacttctactattttcttgacatttgactatttatagtaggcctgtataaaactgtttcatcatatatagtatctatagttcatagaggtaaagtatagctctgcccaaaacttgggaacccccaaatctgcagctgagagtctagatcctattcctgctgcctgtgatttcattttctaaccagcatctcacacaatcaactttcattttttgtctaggcaggaagaataaaataaaatcacttggctcatttatctagcgatccttctcttatttttctccttcttgaaggcctccctccctccctcttaaccccctttcttccatcttctttgcttccttcctctttaaaaatatttaatgagcatctattatgtacatgctcaatgccaggaacatgacatgtgctcagaacaagtgtaaatgtcatcagtaacctcaatgataaacccgatggtgatgtctctatccacatcttccttgacctctcagcagaacctaaagttttaacctctccttctttcttgaaacattatcttttcccatattcagtaaaatgacagtaacctggttttcttctgattcaccagctactttctaattgattttgccaggtcttattctcttacttgaccactaaatctgcccagtgcatgtctttttctatttagttatttcctctagtcttagggcttaaaataacatctatattctgtcgactcccagatgtttatatccgtccttggcctctccacttgaaagcccgacttgtatttccaactgcatacttgatatctaaatatgtacatttcaaaggaaactcagatttaatatagacaaacctaaactcttacagcctcttcatgactctgccacatttcaatatagcaccacagtcttctcattgctcaaacctaagatacctgcatcatctctcaaatgtgtatgtgtgtatacatatttacatacatacatgctcatagtcacaaatatatatacatgttatatatatacattttatatacatatgtataaacagagtaaatattttagtggcttttcatatttttcaactgcataaaataggaacccagtaaatgttcactgaattaattaatttaattaattatttaagaagtatttagcataagcaactttcttcagaataaatttcaaatcactgatgccgtgcctacctagatatttggctatataacccttggttatcagtgattgcaattctttcctattccttggtggcctcctctcctttctttgtgtgtctctgattgtgatatgctataacccacacataacccactggcctggctctgtggtgatgtatttcttcattgtgtagacaacttaatgcaaagtcaatctgtttctatgtacttttaaatggtaacaccgcaatgttctacgggtcataatttttttatcactacatgtttagacactttatgcaaaatgctggttttatttctgattaatcagtttatccgagtggccaatctgggttctctttgacacagtactatatgtacataaagaaaaaatatttgatgtaggtgttagggtctatatttttgaaaatacatttttctatgtgaaaattttgtcttttaggcttctgcctccttcccaaggggcacaagataaaataatttcaacaatacccactgagtcacattctaaagacattaagagaagagataattggggagacttagaaggcctaacttgtatgtcataacgtatagtgctgaatagctcacatttgatggttactgacatagtacaaatttaatttattcctagaggaatcaagatgaaaagatagattacactgatgttctcaaagatttatgctgggagttcaaatgatttctgaatttttttatgttatagctaatgatattattataaataggagttcaaccccaatgcttttcctttgaatagtccccttccttcttagatctaggaactagactcacatttaccaaggctgcttttcattttccatgttattttactacaaagtaagattcattagaaatttttgcataaaattcacatatatcttgctggtggctttattaactgacaagtgaaattaatttttattttttaacttttaattaaaaatttaaggatttggaaaggtataaaattaagcactaagtataaatatatcacatgccaaaattggacagtaaaggaagattatcctaactacatcaagactcataaagagctaatagatacattctcagaaaatagaagattaaacacattatataaagctattgatagaaaggtaaccactactatgttttaggggaaaaaaggtaaccactagaacaaaaatacaaacttttgttctacttagcgattgctgtataagtcacctccaaactcggtggcttacaacagcaacagtggcgttagtatctctcaacagttctgtgggtcacaaactgagaaagaacttttgacagttctggttcagagtccctcgtgtgagtccattcatgtggaggctgcagtggaaacaatcagagactggagtaactaggagctgcccaggcatctctctctatgtagtcttagagtctctctaggctagtttggtctcctttacagagggacagtctccaggcagtcatactgctcatacggcagctgatttgccccagagtgagcagtcaaagaaagaaaagtggaattgtatggcatttttatgacttgttttggaagtcacatagcatttcttctactttaatctgttggtcaaggcagtcacaaatgccagtccagtttcaaagggagaggacacaggctccacctttccaaaaggggattgttgaagtcaaatagtaagaacaaatgaaatgagagatactgtcgtggccatctttggaaaatacaatctactatatcttccatggtatcagaagaaatacataacaaaacaatagaaactgaatgtagacaatatagtgaaaagtaaaataaaatatatgccacaaaatataataatagtaacaaacctatgggccaagcactttttaaagtcttttaccaatactaacctaattaatcctccctgtaattctgagaaaggtaccagtttacagatgtggaaattaaggcaaaagaagtgaagtaaattgccaaagtctctgcaactaatcaattgtggatctgagatttgaagagcagtctgactccagagtacattatctcaatcacttcatcatattcctttcacaagaacagagctaagacctaaactctctatcctaaaaaaaaaaaaaaaaaaatggctaaattcactaataacaaggaaaagctttcaaaatgcataaaaaagaaaactcaaaattaatactatcttagaaatgtatggaaaacaatgtgacatagaaatcaggaaaagaaagaaaaaaataaaaacacacctgccaatgcaaacaactacaaagcactcttagcttaattaattaaattaattaagctaaaaataatttaacttaagtttatttcagggaaaaaagcaacagacaagaaaaagactttcttacgatgaaggtgcaatgtacaaagatctaacaattactcatttctatgtaccaaataatataacatcaacatttataaagcaaaactactaaatatatagagtaattactgaaacatattagtagtagaggatttaagtcacctctttctagccttaacagaataagtggacaaaaacaaaacaaaacaaaaaggattagtaataaaacctaggaaaaacaaacaacagaaatgtaaacatttgttttttgaaattaaggggaaaatactctattaagtaacttttagaacaaaatataagtcaaagcagaattacagactatttagacagtaacagtggacacctacatgttggaatgtataggaaccagctacaatatatttgacaggaaaaggcataaaatgtgatagttattaattagacctacctgaaatagtcatggggattaggtcctctctaccctcatttatattttgccatctcactatgttatggaactcattaaaaaaattcaagaaagttgcctttaaataacaagatggtgagcgacaaaaagcgaaatagaaaaatgtataattatatgaaagataaggaatgataataaaaaatagaaacatgggatatggagaggcacttaaaagatgctttttcactctgataaacaagaatttggtaaaaataaatatcataattataataataattaaataaatattaaaagattgatttttttcacaaccctatataaacaaatttgggaacttggatgaaacagatgattttctaagaaaataatattaccagaacagataaattatagccagaaaagatctgaaaaacttccatcaacaaacatctccccattccaataaataagtaaatctcctatttattcatacatagtttatagcaaagatgcttttatgaaaagaattataccattttcagtaacagaaaactctgtttaaatgtcttcacagcatggaaaaaaagatgtacacatacacaaaactataaaccatgctcatttattgtatcaatgtaaaggttctatataagttatcagcaaatcaaattagtcagcactataaaataacaataatccatgaaaaactggtgtattccatgaatacaagaatgctttaacataaataaatatatttatataatcaactatattaataaatcaatataaaaaccgtttgattatttctactgatgcagataagtgtgtgataaatatacaaatatgctaacatcctttttgacaaaatctcttaaaatcaaaatatatggatacttctcaagatactgaaatatacacatacatggatttacattgttaaaacacacattaaattgaagattaaagaaagaatgtcttttatcatcaaactatttaatattgacctagtggtactggacaagagaagaaaaattaaaattttaaaaatctgaaaataaataatgtaattatcagaatttccagacctatgtttatattcttggaagagcccagaaaatcaattaaaactgtagaaagtaataagagactcatgaaaggtagttgctcaaaattagcatattggaattaatagacattatatgtacaagcagtacccattaacaaggtaaattagaggaaaataccccatttacaatggaaacaaaaaggtataatatctcagaaaaagcttgacaaaaatatgaataattgaaatggatagaagtcttaatttttactaagaaacagaaagaggtccttacaaatgcaaaattgtgccattttttagataggaagattcaagattatcagggtatcagttctcttaaatcaatttagaaaacttatggtatcataataaaaatacccaaagattatttttaaaatttagtcaatttatatctaaaggttacctggaactggacaatgttatgttaaacaaaataagtcaggtatagaaatacaaatatcacatgttctcactcatatgtaggagccaaaaaaatattcaaatggagataaagggtagaatgatggcttccagaggccaggatgggaagtggggattggaggataaagtggagatgattaatgggtacaaaactacagtcagaaggaataagatctactgtctggtagcacaatagggtggctatagttaacaataatttactgtatatttcaaagtaactaaaagagtggaattggaatgctcctaacacaaggaaatgataaatccttgaggagatagataatttcttccaattaccctgatttgatcattacaccttgcatacttatatcaaagcatcacatgtagcccatgaatacatacaactagtatgtatccattataattaaaactttgtttttaatttaaaagattaaaatgataaaaataaagtttacatgaaaaatatatgcaaggattcctggaaaattctaaggaaaacaaatagaatattatgggaagctagtctacacaacattaaaatatgttataaggctaaaatatcttaaacagtgtagtaaagatttaaaaaaaacagattaaaacaaccagaaataaaaatttagtttatagtaaagtgaatataataaagatggcatttcaattcactagggaaggcataaattgcttaataaaatgttaatagtcattagtaattgggaaaaataataaagttgtatttcttcgttgtatttttattaatatatgttccagatgggtcaaagattttaacacaaataaaagcagtaaaaagtggaagaaaacctgaatgaattttctttaggaactgcagagttgtaaaggtttttctaagtataatactttgaaactattaaaaggaaagagtaaatgaaatttagaaaaattcaagaaaatttgcatagcataaaaatgatcaaatcaaaagataaatggcaaactggagaaacatgcttgtgattcataccacaaaggttaattatcttaaagaactctgacaagtcaacaagaaatagaaaatttgcattaaaaaaaaagactatgaatcatccttactcattataagagaaatgtaagttacaactactgtaaagtgccatttttttgacacacaggaaaaatgagtaaaatttaataatgtaccatagtaataaatgtgtgtgtaaacacattacataaatgggagggaaaattggttaaaactctattggtggcaattgagcacagcaatcaaaattacattcactttttttttttactcagtttactcgtaggaatttatcctacagatatatatttgaggaacaacattgagaaatttcaggaaaaaaaaactaaatgtccatcaataagttgactctaagttacaatgttttattaaaaaatgatgtgccatttctctgtggacaaatatgaaaaaaaaaaacaaactctaaaagcctgttacagaatgctgtgtatacagttttaccactagtattctgtataaatgtgcatggacctacatataccacatgcttggatatgcacagatactctctggataaatatactgtataggaaactgtagcaagagtttgtgtcaagggagaatggcaacagaagccaatttacttttcaacaatcatacttttgcttttcaatttctttcctttgcatatgaatactgatgcaaaaatgacaaaatattttcatttagaacttattttgctattccttttcattttaaatatgccaagtgagttttaaaaatggaagtgtcttgaggaacttccagctgctgagaggtcacaaccatcacttaacaaaaatcatcattttttttccactatactttttggtttctcatttttgaagaaaacagtcaaaaagatcctttacactcctggcagacagcagctaagaaaaatgatgaccctatcttttagggcatttctagtattcagctcagtaaagtttaggacaagtttgcctttatttgcacatacaatctcacggaaatttaggatctcagagtcaaaatggaccttaaatgtcccatccgttgctagcttttgaatgatttcctgacaagtgctctggcttgtcttctgttgaaagatgtgaaagtctggcaattcttttcattgtaattaaagtaaaaacattattggaagatttgcttagaatgttattacgaagatttcctagataatttcttttccatgtacatcttgaaaaagtcaccatctgtaataccatttctcaacaattccccgtaaatacatgtatcatagttcttattacccagcattgcaaacttcaacttatttatctgactcctggtatttgggttgttatttatctttattcccattgcctccttagcacattgcctggtgcatagtaggcaattaataaatgctttatgatgaaggcatgcatttcattaaatccaagggttattttttctctaatgtactcataaagttgaaagactacgggctatcttcttcttcttcttcttcttctttttttttttttgagacggagtctcgctctgtcgccaggctggagtgcagtggcgcgatcttggctcactgcaagctccgcctcccgggttcacgccattctcctgcctcagcctcccgagtagctgggactacaggcgcccgccaccacgctcggctaattttttgtattttaagtagagacgaggtttcaccgtgttagccaggatggcctcgatctcctgatcttgtgatccgcctgcctcggccccccaaagtgttgggattacaggcgtgagccactgcgcctggccccttcttcatttttaggtggctcagcttgcttctcatattttaaacgaacatctccctcccaatgtttatctctgctaagctgaattaacattttttcacatattaattttctattctgatactgatattatatcaataattaagagaagtagtacatatcattctagtgaatataatacatgaccaatacattgaaagataattcttcaaaaacaatattaccatccgataataaccttttaaagtattagtatagggctccaaaactacaggtcataaagataaccaaacaaagaacttcgtggttattttctgttagctgaaattcaatttgaaataccagttgaacttcatttaggaaaaaaaaaaaaaaaaaagacttcctggaaaaatggaagctaattaaaaaactaaacaagcaaacaacaattacaacaaaacactttcttcacaacagggaatttttaaaagaaaaaggagctctgtgttcacaaataacagagtattgtgtgatttacaaagcaataaacatttaagctaatgcagttcctgccaataagggttttaaactgcacaacagtgactaagataggtaaccttgcctctggagttattttaagcaaaagatagtgttggtgtctaggtctgatttagacttaatgacttttcaaacttccttccagttttatcattttattacgtttaggggaaaaaaaagcctccaaatttggaagaataaataagaccacgttaagatcacacaggctttatccaaggtagcatctcatcccataaagaaagaactgggtcatgtaggttaggttagagcaatcctttgggtaaagcaggtatagttctcttaaggaaaaaaaaaaataaccatttacatatggctttaagaatacttctaaattacttctgaacatttagtatttaatcaggacatactggctgcaaaggtatgactctcattatggaagatattattgataaagatctgtatgtgagtttagttgttttgtaaagttgaatattttaattgtaatagggctgtttaataaataaagaatagaagtaacacataaataagtaccctccagtcatctatgtcttaccacaaatttctatatgcagaataatatcagcatttttaaagtccagtgataaaaatgttagagaataaggcaaaggccatgcaaaatgactttggttaaaaacagtggatccctttatatgtatttaaatactcaggtgaatctacaaagaaaagattaaaaataaatcaataaatcaataaatcaccgtacaagactcctgacctggttactaactttaattactgggctgacagattcagctttttttttttttcttctattgcctccttaattcaaaatcatactgctctccttgagacttgatttcttgatatcttttttctttttttttttattatactttaagttttagggtacatgtgcacattgtgcaggttagttacctatgtatacatgtgccatgctggtgcgctgcacccactaactcgtcatctagcattaggtatatctcccaatgctatccctcccccctccccccaaccccaccacagtccccagagtttgatattccccttcctgtgtccatgtgatctcattgttcaattcccacctatgagtgagaatatgcggtgtttggttttttgttcttgcgatagtttactgagaatgatgatttccaatttcatccatgtccctacaaaggacatgaactcatcattttttatggctgcatagtattccatggtgtatatgtgccacattttcttaatccagtctatcattgttgggcatttgggttggttccaagtctttgctattgtgaataatgctgcaataaacatacgtgtgcatgtgtctttatagcagcaagatttatagtcctttgggtatatacccagtaatgggatggctgggtcaaatggtatttctagttctagatccctgaggaatcgccacactgacttccacaatggttgaaccagtttacagtcccaccaacagtgtaaaagtgttataatgccatttcagttagcttgccttctcatatttagttcttcctttccccccacatcctttctcccctctcttttcctcctcctgctctttctcctccccttcctcctccccctatttaaattcctctacaaccttcataagagaactcagaataaatgagcccaccgctctagcagttgatgctacacttgcgatctcccttcctctttctcatgaagttcaaaatcaaggtgttagcaaggttggttccttctgggggctgtgttccttctgggccctattctatgcctcccacagtttggaggtttgctggcaatctttggtgttccttagcttgtagacatctgccttcatcttcacgtggcattttttctgtgcatttacctgtgtccaaatttcccctttttataagaacaccagtcatattataatacagtcctccactccagtatgactttattttagcttacctaattacattttaaatcagcctatttctaaggaaagtcacattttagggtatcaggatgagggcttcaatatattaatttccagggggtcacaattcaacccataaccctctctttgaaagtttgactccataggtctgatatggcatctaacagacaccatttgtaacaaatacacctgcacattttgatgcagagggccatcagctatccactctttgaaaaccactgaaaagagtttaccagccatacctccctgaatgtgcctgatgtcttctgaaaaccactgaaaagacttggaaacaaaagctcactaattagtttttagggtgacaattctttcctggaggtggctgtaattctgttccctcaccccgtcccccccgccagaaaggatttgcactaacatttcctttattgtcatatatattgtttagaaaaacaaaactggaggggctatcaatgcagaaaaaccctggctcaaatcatgtgactttgttaacatatcaccttggacctttgtgagcctctattttcacaaatgtaaaatgggataatgtacctcattaggctgagaatgtaggaatgtgcctggcaagatatgaagtgctcaatgtatgttctctttcccgagcttgagtcatggcacaaactgacattctcaaacttccagtaaacaagtaggggatggaaagatacatgaaaataattcttagctatttttcatttcacaagtgacacaggcttattgtgaatagaatgtaaactctgtaaagcaggggctttgtttggttcactacaaatcttagtacatactttagtacttagaacctaatgggtacacaacaaatattaaaattttaaaacaaaaagcaggaaattattctttaaaattacaatgaaatgtatagccttccacctataatgattgagactatatttaacatagcaatatgcagtgaactaaattacctaacattaagtgttcaccgaaaagatgattttaaatgtcactatagtgtttcaatgtgttcactgtgtcaatgtgttacataattcatgtaactacttgagagtacttttatgtcattcctaatgttcactctgctaagcaatgctttgatattgttgctaacagtcaagggaggaagcacctatttggtttgcatggcataaagatggactccaaccactgaagtatgacagtaatagctgcagtgcctcctcttatgaaccattacaaagaggggtatttcttttgggcctaggttctgaaggaggaataggtagtgaggcaggggaggagtgaggagcttggaatcatacttggaaggattctgaaaattagtcattgctgaattacagtaagcattgctttattaattagtaactcatcaaaggtttccataaagaatgtgataaactcataggaagtatatattatgaaaataagataaaataataaacagcatcaagaaaaatgccatatcatacaaagcattagcaccagtggaagaaataaaatagatatatccacatcacaaaatgttagaattagaacacaacacttgttttgagcttcctggaaactaagagcactaggcctctgggtctcagggtatttggtggaatactatttcatagagatttactgggtgttaacaaattttaaaaagcaaacccaaaaatggattacatgatcaatatgtttgggaaacaacaggctaagaaaatacagcaaaaattttttccggttgttcctcagagcctttcctattctagtgtgcattctgaatcttcaaaaaagggtcacagagtatatacaatcttttcaaagcttatgtgacactgaacgtttttattgaatgccacaaagggctagtgttgcatggaatactctttaatactggattctgggatacccaaagccagattgcaatgttattgtagcaactagttgtcactcagttgtagttttcctagacatcatgtattactctaactatatctgtgtctgtatctacttgtctttatagttgtacatatacatacacacacgtgcatgcacacacacacacaaacactatcttattttattatacgtattccctgtgagtcattttgagtcttttgtggaatggattaattaattactaatacgattaagtaatgtttattatgtttgaattttaacaaaaggacctactcacacacattctgatactgtgatgctctttcttcaactgtgtcagtatatttttctattttgtattatcttttccattatagttccatggttacttattctaatcatgctctcagtgaattgttagcgacatttctccttacatagtgatgggtcaaagcagttccctaggcatatcttgtatgtgcctggtgtatgggagtaacattgattgattgcccctcagttccagaacctagactgagtttttcttcatcaaagtatcatttggattagttacttacttaaaatgcaactcttccaagaagaatttgtgtttttaatgttaacttttatgaaagaaaggagagaccattgaaattggcaagaggtgagttttcagaaattttgcaaaactttttcaagggatgggtgggcacttggttccatgaacagaatcttcttttccattagctaacagattgagtcggtttattttaataaaggggatgtttttttcctgggtttggagggcatatggcagcatcaaaaccagggaccagtcaaacagagaattggcccactagcccaattggcctctgcctaattttgtaacaggatattgctcttgaatttcaagcaatggtcttcatatgtgactattcttgtcaattcagaaatatgtgttgagtcccaaatctcaaatctacactagagcctattctagagactaggggatatggaaattatcaggaccctgtctataccctctaggagtatatatcacatttaagcgatttaagaaatatctgtgacatgaagaaatatttgtgttcaaatagcatatgatataacctgatggtcacatttggagagtcaagaatgtaagttcctcacctgaatgttttcttttctgacatgtacctgtgttttgctgttcctttaacctggaattcctttcccccagatatttacatctgatacttcccatcctcagatcttaactcaaacgtcacattcccagagatgccttccccgatctatcccaatccattactcttggtcatatcatcaatgccaaatttatttcttcataatacttatcaacacctgatattaacctacttaacatatcactgctggttttttatcatctctaactagaatgttaactgtggggagacaacagccttgtctactttgaatatcacattttaggcactcaataaatattagtgaaaattcttcaactaaaagagaaacaaagaagaaaacatggcagtatttatccagatctgaccaggtagaaaatcattcatttcggtgacagaaatattctagtcaccagagaattgatctttattataaaagcacagatggttcattactcctcatcattttctggatgaaacaaatcttatctccatttccttttgttccaagtccaagctaggcaaacaagtgcagtctaaagtgtcagcttcccaggtatgctgatctccaatctactctagaaagcagaaagtatgtctggccaggtgcggtggctcacgcctgttatcccagcactttgggaggccgaagtgggcagttcaagaccagcctggccaatatggaaaaaccctgtctctactaaaaatacaaagactagccaggtgtggtggtgtctgtctgtaatcctagttactcaggaggctgaggtgggagaattgcttgaacccaggaggtggaggttgcagtaagctgagatcatgccactgcattccagcctgagtgacagagtgagaccctgtttcaaaaaaaaaaaaaaaaaaaaaaaaaaggaggaaggaagaaattatatctcaggaatttgagtgtttgacctataaagttgagaataagctgttgaagcacacaaaaagaaattatcctggaaagcctccaaatgatcagcacattttcttagcactcatctccaagagtagtatgtcttctccaagtttagtaatatctaaatcaagaacaaaaaatatgaaaatgcctagtttgatactaaatataatacttttaaacagtgctttgtgataaaatgtctgtcactttgagaaatgtctcagcctgcactgtccaaggtttcaaaatgactcacagggaagctaaaggcagtctatctagagattaaaaatcaccaccttatattaacttatttaatttttatctatggttttctgcaatcttgaactagaatgactccataataccaagtttacttatgtacttaataggtatatttccatagatagataaaaatactagctctttaaaatgcataagtcacaaaaactatgttttcataaatttgaaaagacaagaataataccagtgtttataatctgaagcattactattaagaccataaggatgtaatgtaatctctttcaacgtgattttggaagcaatcttcaattactaggttatactggttcaatggcttaattatttctcccaacccagttatcatacaaaccctactatttctgcacagttggatagtttttgttcacttaagatggaactatttgatttcattttagaccctggatattagtcaacattagacacattatgtataccttttgtgggcatagataaatatttctcttatttattttaactgttagaggtatgaaacagttttaaaaattacaccttcacaagttaaatgtttaattatagaatctgatttatgtgccatgcattatgcatttgctattatcaatagcactacaatgataatttttcactttaaatacggtaatttttaatatcatctgtaaataattgctattcaaactcaaagtactttcaggttagccctgaaattcaagtcaaagaaagtacattttccaatttcccactgtaaacatagtcaattgaagtaatcacagcttgttaagaagattaaggctgtttaatatcatttaggattcttaaaataccaatctcacaatcttctgttactttacataaattgtagcagatttataaggattttagacaggctaattaatgcctttagaagtctttcctcaaattttatttatttttaaaggacctgtttcatttcttacaatgagaaggtactggtcttgaaaataaaatacataacctatcaataaattcctcacagagagtaaaaaaagtctcctctctcacttccaatattcaataacaaaaatgttcccctccattctaaataatctttctctttcttcatcctcaccctgatacataacaagctaaaaaaaggtacctacgtttgaagtttatgtatatgtctcagctctggaatatgagatttatgagttcaaaagaaaagtccagaaaccaattttgagaattgctgagtatgaagacataaacatttggtgccatgcctaaaaataattagctatgtttaattccaaaaatagacttgcagtgtctgccaatattttgaaaactgaaagagaaagagggtgttttttttttaaatgttttgcatgaaacttggctcttctgtatgcctcacagagaccaggtaatgtttccatgcatgtatgaataagtagattggaaattcaaagtctgctttttggcttatgtgaatattaccaatggcacctaatttccatgcccatcttagagtatagctgcttttacagcaggattgggccactgtccattattttactgctggtttactttttgtaaaaactaatgtcagaatgcatacagtttttcctaagaacatgtagattttataaatatataattgtccatttatactacaagtgcaattaaaagagaattttatgttttgaattttcgttttgatttaaaaatcaccacaagccttaggaccaaaaataacagtaacctactctaactgctgcctgtggggtgggggaggagaactatatgcaactgaatttatagacacaaatcctaagactgtgttaaatctattcaaagcatttttatgatgatatatcttacggcaaatcttagttattcactgggctttctcttcaggatataactgcaatctgctatttaaggaagctagaattataacctttatttcaaggttcttgggggcaggaggtaaagaggagaaaagatgtgaggggtagggagatagactcatagttaattctcatttcctgggttcaagacggtgcctcccctttctttcactgtatctggtttcctggagtacacagctttcctcacttacttctacggagaataaacttgctatcactatgttggctgggtggggagacctaggcctttaactgcttcttattagatttctgaacaatactctagttttcagtctcttcattaacctatgtactcataggcatataatgtctaatttctgagcatttgggggatctgcacctttaataagctcacctcacacatgcttcatcttctgcaggcatttaggcttccttttcctctgctctgctaagtccttagcacttgaccatctgctttccatttcccatcattttattgatatcatttctctactcttattaactctcttctttgtcctttctgggtttgttcttgtacaaccaatttaatgaagttgcaggagagagtagagataaatgcatgtgttccgtatgtcatatttcttcctgttctattcacgacagagagcaaaaatacctgtaataagcttatgtaatcttgaaagcagttatgaaattgtgctgccaatctttcatcccaatttttcaaagcgtcctttcgtgatcttatttatccattctctaaacattttacgatgacattgactttagttttaacacattagagattttcatacatcaaatatatattgaataactgatatatatgaggcctaggttaaggtgctaaaaggatgctctcagacttgtatgtatcattcattctgtctccattggagtcatctgtcatgcacatataaattcaagacacttcccactagctcttagctttaatttcccttgggaatttcttttcatactgcaggtggtctcatgaactttttgttacactaggtataatggccatattttctgaaataaaaatcaggatttactgtctaatggtcttaaaaatagtttgttttatgacttgtgtatttattttaatgaaaatacaaaaataaaatcacctttagtaatagtttaatttaataaacgtttttgaattctaagtcaatgttaaggtaagttgtaacggtaaagctctctgtgtctcggaggaattttgtataagtatatggttaaaacattttctatgttgaaagagtacatcagaaaaaggaaatcagagctgttctagaatataccaggagtatgatgggatgcagtaataccatggcaaggttaatcagataatggacatatttcagtaaatgaacacttttctcagtgtatttatattttatttcaacagataagtaaacagattcatcctcccaggcttataatcatggaaggcaagctatgaaactactcactgaaaaataaaaaattccaccaacttatctccttagctttagggttacaagtataaataattcaaaagaatctccaattaacatgccctaaagccactttaatgcaaacaagaagaaatactgaattaatttcctttaccctttaaagagggaaacaatttatgttctttctgccatgagtaattcacattgacttggatgtattaaattcaaggtccagatatttcaatatttttccaatttctaatggctttgagctcttggaggtggctacagctctagccatgtgtctcaataacttacagcattgattcagcatattttaagtaaatatatacagctcaaggcaaaaatactgagcaattttctcatacttttctagtccctagaccacagatttgtgaagtagaacctaataaagtaataatattactttattgttctgttttctatcctcgaactccatcactttgatgtgatattaatatatggaaaatgtagctgtaagaataaaaaaaataaagaatgacttggctttctttataatagatgctgttcatatgaactaatgagttgggagagagatgccaataaatactgtttttgtgccattacaattaacagcaagttttgtagtttttctttaaaaagttaccatattactttaaatgcaggagctgcatgtgtgtacttaatgtgacagaattacaatcttctgcacctatgtaaatttgtgttttatgtagacgcagagagagaagagagaagaaagccactaggtgtaaaactggtagagttttatgaatgttggactcacatccatgttcctgatacaaatcatttccatgagtattttgtgatatttggagaaatattatatttttatttttttcatgagatttctatctggttaaacaggaagtctaaatttaagggcaaatatcacataaccaagagaggaacattagctccagaaagactatcatgaagcctataatagagccaagaactgagatccagcttagtggtaccattctaaatgatggttctattcattcgaaatgatgaagattcctccccaagcatttgcctgtacttttcatgtaagttgattgagaaaatgcaaatttcataagcactcttaattctgttctaaatcaatctttgatcatactgtacctgtaagcctttaaaaattgcagcaaatatgtacaggctaaataatatttattcagtcaacatggactatacaaatatacactacttgtgcttttgcaattaattaccgtagcccatcagggtcacttactgattggtttgtaatcgtgatttagattagttggatttaccaagaaaactccaaattcctttttttttttttttttagtttgaggacagtattttccctgccattgagttataaatataatccctctcatctccagagagcacctgttaaattgtgtaccactaagggagtaaaatacacacaataattttaaaggtgtactgccatggttttcctgccattgtcaaacaaaggagaggaaacttgaaccctcttgtgatcaggcctttttctgctctctctaccacaattctaaggaagaaggagctgctaatttgattactctaagcctgagatactaattaacaatggacagagttatactttttaaaaagttatatcttctgcaaactttttcttgcatttcttactttgaagaagtcagaagagacaggcaaggcttgtattctcaagacagaccattcatattcatgtgattcacactctctctctttctcttacccactcactcttccttctttctcccagaaatgagcaaatgcatattcctcaaatattaattcaggagaggttgtctcctcctttcttgcttgctaaatttactcttactttcctttttctctctctcccttccttcctttcttccttgctctattttaaaggtccaggttagtattctgctttgcattctcatgcttaatttttttttttatcgattactttcagtggcaaaaactgcagttacttttgcaccaacctaatagtttagactttaactggagtttagctggtttctaccaaagaagacactgtagcataatgaaaggaatatgtatttagaagtaatccaaattttggattagctgagtaaaattgaaaataataactttgagctttgtctttccatctgagaaatggagatagtatttttaataaaagtcctatgactgctaaataagtcaatatgtatgaagacaacaccatcgtgaacaggattgttattaaactcactatttctctgtgttgagtaataagtacattatatatacataatctcattagtttcatttacagcataggaaaatgagactaaaaaaacttcaatattttgtctaagttagcatggcaaatgaggggcagagttaggatttgaacccgtttgacatattctaaagcctagactctcaactgctatctgctatggcctcctacatgttccttcttttgataaaactggtttctttcattctgttcatgtacgatgtacatatgaactggatttagaaaaaaattgtgtatcttcctatagttttgggtatctaaagattcttgtctatatacatatacatacacatgcatatactgaatgttgattttaatcatgtaaagtatgcatccatatatcaactagatctgcattgatcaatacagtagcttccagttataagtagctacttaaatttaagataaataaaattaaataaaatttaaaaatcaaaccctcagtcacactagccacatttcaagtactcaaaagccacatgaggttagtacctaccatactgaatagcacagacataggacagttccatcattgcagaaagttttactgacagcactgaaccagatacatttcaatgagaatgtgaataaatttgtttatcaaggaatttgtctataacaaatcctttgtcatagtagagaaagcacttactttgaaaattctcatactggatccttacacacacatacacactcaattatgcagaccaaatatacagagaactaaaatttatctgtaattttttcatggtcactctgaatctgaaactgtatgcaaagttttgccctgtgcaatgacatttgtaagcaaagcatagcaaacacattcttatgttattactcacccacttcaacagattctactcttggacacttcaaaatacatgccttcaaagctaagtaaacattagtcatcctcattaaatgaaagttcctagagagttcaatttgttggagaatcttcaataaaggaggatggaagtagagttattttaggaacccctgtgtttttctagaaaaaaaattaacaaggcaggatagatggtattctgatgtattgagccaatcttcagaaatagtccatgcagccacaaaaatacagaaaatgaaaagccagagtgatcaaacaatttcaaggaaataaacagataagcacaaaaattgaaataagccagcatgcctttcttctgcctggttttctaattatctatttggcaactagtgatagaatagtgacttattaagaagcaaacacatttttcctggatccttttttttctctttaaaagaagcagaggacatttgtataataaacatttatcttccctttcttcttctctattagtcaataaatgtaaaattattatctagctcagtttataagtggtcacttatgaaatacttaataaaaataaatatctctaggaatcaccagacatcataaatattctcagtggttatatatttattttaaacattttatgttagtactggattcctttacctctgaaaaaatggcttttataaacttacactccacacagtatggtgaatttgctcgatggaaaaaatggcaatcctttagcttgcattatttgcaattaaagtacgcagtgttccctaattcaatcctcaattttatattttaaaagaacagaccaagctttacttttagacatacatcttaaatgtgctcagaagacacaggaggattttttgacttatatcttagaagatatgaggaaattaatcaaaaaaatatattttcctacttgaacaaaactttgaagtattagataggaggatacaattttaatattggagtagagagaaagtaagagctatcgaaagaagtttcaaaaattatgtcagcatctttcatagtaaatctaaactttgcttgagtaagaaattctttatactttcatgcagaaaagcaatggaacaaaattgctgatggaccatgacattctctttgcctgaacaaagagacagctgataatagtgaaagttgtacaggtattcaaggcagtcattcccaatcatttgtcaacctcagtttccaaggatgttgtgtcagtttgcaaagtcttgtctacacttgaaaatacactaaaggattcttctgtctacccgaagaaaatttgttcaattccaactattgaattccattatctttagagaaaaatcttagaatgtgtttcagaaaagtccctcagggagcttttccaactccatatgaatgacaatacaaagatggtactataggtccatctggcccattttctcattttctttcccattagcctgtagaatttactaggagcccacagaggtatagctctataataggggaatactaagaaaatagtgtcatctactaatgtagctattttatatatgaaggaaacagaaaagctgtaaggtataattgtccaaatgtaagtgtaaattcatgctctgcaagtagagccaatggtacccacatgctctactctcttttggcaatgtgatgctagagtaaaaaagatactaatcacagaatggaaacaaatcagcttatttctcaatctttctataaaatgtaatttaattataaacacacagtaagtatatattccaaaactctaaaaactggtgtttaaatgtgagcaccagagggattaaatgacatgttctgtacatccttcttgtttttttaaggacatggggaattttaaaagtgaagagatcctctttcttctacaggaaatgtcataattcttctcatggtttattggccataaacaaggcagggatatcctgagaatggctgatattgctgcttctctattatcagggccaggacgctacctgatcaagataccctcaaaagccagaaaataatttcagaggtgggttatatagctatgatatctaacaataacattctcctttagaatttcccatttcatatagaaaaataaaatacagagaggtcaaaagtttacacttgaaagaacaggacatagtagaagggaaaagtgctgggtaaagtgtatcttataaattactggaggaaaatatgggcagttggcgatgattgtggaagtttaaagaatcaatgattagaagtcaagaggtaaaaatgttgcgcatatagcagtgataaattgaaatctatgctcatttgcacatgggaattagaacctttatattttaaaaaaagcattcattgtggtgcttaaatcacattttttgagctggaagagcaagtgaatattttcttttcatgtattgattggttcaatttaatcaaacaactgggaggccacaataaattcagtaaaaaaaaatgttagtcaagggttgtgcatgtgtctttgtgtgtgtgtgtgaactgaatcgatggaagtgtctaatccactatatcaacatggttatggcagcacataaaatacgcgggaccagaactccatcatagaaacactcttcatagtcacggtattgatttcaattatgatatctttcttgctaatgcattctgtgcacctgtcggttggcagagaaaacagacttaaatcaaactgaaagccatacctgcagcaaaaaaaggcttcatgtagcccagagaaagaataaagaagcaaacactgtgagctatgagagtcactcagagaaatgtgctcaatggcatggagttttaaattgcccataaaaaatgaacacattagccatcttttgctcttttggcacttctgcaattgacattacccctgtctggtgtgttaagactgggagaactaagctggaaaatgtgatagcaaatccttaactcaagcagcagtatatgggacaggctgttaaactgtcatgttagtggaatgcataaatgccaacattattttagaatgatttattacatccacaacagtcaaaataaataaatgtggcctcatagtccacaacccatggatagcttttctaattcaggattttgcagatgacattttcaactaggataaaattttggaccttttaaaaacaaaagacagaattttgttgggattttctgaagttctaagcatattatttcaatgattctgggaggagtggttgttagtaaaaaggtgctatcaaatagttaaatgaagaaagagtagaaaaaagaatgtgtagcataactcacttatatatccatctctacagaaagagcaattgcaatggcggttgcattgtaaaatgtcttcaatatgattttcgtgttgacaacataaccatcactacagataaactcccactgaccataaattgcaaatgaagcaaaactatttgagttgagaatgcaatccaaaaattatatctatttaaatattcattttttgagaatttatggaatacagtacattatctattgggattttttccccctaaatacagcaaggacttccactggcagcaatatttcttagaactaaaatggctcatttatgatcattattgaagtcactacattttatagtttgtcacttttaaaataaaataccatttattcaaataaatggatctgtaagttagaaatttcccatcatataaaagaaaaaagatatcgggtgatattcaggtgatattttaaactttattctcttgcgcacatgaaatttcaatttacatgccaacatccttcacattatataaactaaacagaaaatggcataaaaaactgtaatgcccttgttttgcatcaatgagaaaagcaaggaatagacatttattaatgtagttacacaaatcatcagtgctgatgtcaataaattcatgataaaatatataatatgtaatatactaaatgtatacatataatataaataatactacatattatatactgtatatatactatatgtgaattgattgagtggtgtattatttttatgtagtttattttttaagttacaataccttacttggaatgaacttctgaaataagaaattctagtaaaattaattaggtaatttatcctttaagttaaacaccaaatagaaattaaatagttcctgtgcctattggggttaatacactgttaaaatatttctaaagaatttttcaagttgtgaaaataaagacaactgaaatcaagattcacaaaaaaaagaaaaagaaaatatttgataagtttgtgcatgtgttctaaacatagcactcctgttcatacccttatgcatgactgttttcacagttttctctataagagcaaacaccaccatagaaaagacactttttgaagagagtcttggaagtcttatttttttctgaaatgttttcttcatatttttcttcttctaatgtccttattttcccatagtttatattgtctcctttattgccttgatgtccaaaatagccttcacattctgactcccataaaagatatttggtgacttataatgggtcttggtccgaaagaccccttctaacattttagctgtcagttattgagaaagtatatgacttcatgaaataggaactgcttttaaagtgcaggatcaacaaccgcaaacataatatgaccacaaaaagtggggtatattattttgagataattgtttgcagaaataaggtacctaggtttgaaaaactagaataattatctattataagaattaagatatcctaaggacataatttggaaaaagaggagggagatatattcttaaaatggtctaaaatatagattaaacataaagtctaatttggaaagggacagagatgaagatcaagttatagatttgtagatgtagatttgaagactagggtctggattctaattctaatatcataattatattatattataaatatatataattctaatataacattatcaaataatactaaatatagtatcaaatatcaaatgtatcaaataatatcaaacaataatatagtaatacaataactctattatacagttcctacatggaattaagaatttaatcttgaatttctaattttttttttagttatggaaatttggatagaatctgtaaaagaaaaatgaggtccctaagctagttaagtatgcacttacgaagtggatcatgccctccagtgacttgatataacacactatctagtaatcttggccagtctgcttcctagaaaaccagttctgtccacatcaccaaaaccaagcctgttctgaagtggaaaagtcacatgttctccacgataaagaacagatgtgacaaagccatggcctctaataattttgtatcatctcacagcccaatatcccgtgccacaacctaccttctataaatagatttctgctctggactttgagtggagaacatgagaccctgatattctaatgtttaactatattctccaccatgaaggacaaagctgaagaagccatggcttctaagaattttgtacaatctcacagcccaatgtctcatgccacaacctacctcctataactggatttctgccctgggcattgggtgaaggccatgagaccctgatatgctaatgtttcactattccctgcctggaatttaaagttcttcctgaggctccattccatagcaaatagcccatttgccatttcagacacaagaataaggtttctacttctgagtgccacttatttcaaattttctgagactataatttgcacgttagcttggataacctgaaacttgtcttcactagtgaccatttgccagaaattctaatcatttagtcctttaaataataacacatgcaggcagtcacccagttttcaggcagcatttgcagccggattagcttttgcagaaccaggacaacttgaccctatgaatatcattccttagtggccctatcctgttaactattgcctgacaattctctaaattcaactgaagttaagaagtatttgtggatgtctttttgtgccaggcaggcacccatgtaggccctagaaagatataattcttgctttcaaaaagcttaatattcagaaaaactaacgagtggctttctgcatacttgctctttctttagcctgcataaaaaatggggcttcttgttcagttacactcttttatatttcaaaatgatggatatgcttgccttattccttattttagaggttcttttttaaggtctcataaatagcaagaataatgccaagtaaaatttcatattattgctctcaaattgtcaatacatttatttctcttgttggaagcaatgtgaatacctattccttaaattataattttcctacagaatgcctgtcacatagatcttttatcaagattatattaaggttctgttttggcaaatcagtttaacttctttcacaaagctatcatgaaacatagtctagatatgtggcttttctagctgtgaattcgtaggtttatacccttcatagttagttatgcatgttgtagaacagcatttacaaagtatgttctattgaacagtggagctgctgcatagtctgtgcaaagagattttcacagacaaattatattgtgaaatgctacatactatgttttcctcttggagattcataacaaagattaaaatattaaaaattctaagtatggtcagtctgctgtatccatgagatctatatatgctgattcaaccagctacagatcatatttttaaaattccagaaaatattactttctggatgacatgaactaggatggttacatgtatactgagcctgcacaaagtttttttctggtcattattattccatacacagtgcagtataacaacaacttacatagagtttacattgtataaggtattatatgtaatctagagatgactttaagtttacaggaggatgtatgtatgttatatgccaatactatgccatttcatataagggactagagagtctgggattttcgtatctctgggagtcctggaaccaattccctgtggatactgagggatgactgtagtcctttggaaaagaaactggttgaattttaacacaacatttttcaaactctttcaaccataagtcctttaaaaagtataatactggctttcagaacaggttcaccatttaaaatcatcttgtttgtccgttatcacacaaaagcaagttctatgagaaaataagactcctgggtaccaggagcacacagtaggatgtcatataaacagatccaaatgaagaataaaatgctgctatggatatttttttagaagtagtgttatttggatttatttagaaatgtttttgactaaaggctctgaatacggcttaaaaagagttgaacttttcagatttttcagatcaactttaaaaaggatgcctttattgctaacttactcatttggtgtgttggttacaagttcatttctcatatgggacagtttacattgttccaatctacaaagaccctacattctagagctctgatctatcaaatcaccagatatatcagaaatgcctaccatcggtctccagaaaaattgaggtgtagatgccactaagtccatgccagatctgtatctccattgcaaaacaagcaagcaaaacaaccaagtaacacctccagcccaaaggaaaaaaacccaaacaaacaaaaattctgggtcaaataaagatgtcaatcaaatatgtaattacagttagtaggaataaattcaagagatccattgtatagcatggtgactatagttaatgacaatatattgcattcttcaaaaatgcaaagataggccggatgcggtggctcacgcctgtaatcccagcactttgggaggctgaggcgggtggatcacgaggtcaggagatcgaaaccatcctcgctaacacggtgaaaccccgtctctaataaaaatagaaaaaattagccgggcgtggtggcgggcgcctgtaaggtcccagctacttggaggctgaggcaggagaatggcgtgaacccaggaggcggagcttgcagtgagcggagatggcgccactgcagtccagcctgggtgacagagccagaccccgtctaaaaaaaaaaaaaaaaaaaaaaaaaaagcaaagatagaggagattaagtgttctcaccacaaaaatgataattgtgagataatgaatgttaattagctaaatttaattattacacatgtatgtatacttcaaatcatcatgttttacgcagtaaatatataataaaaatacatttgctactcctaattggaagtagagggaaggtgttgggatccgatttaaaaaaagcatatgatttggtggttcataaataatcaggcaagtttagaaattactggtaataaagggagatattaaactttccaattacttgtcaaatttaaaattatagacactgaattgcaactgaattgcagctatttttagacaaacgacaaaactaagatatttaatgctttacttttacaacatataaaagatgaagaaatgctctgagtagatccctgatcattcttctagattcagaaagtgtcttcattacctcaatttcatctcacattcactgatataccaagttatccatgactttaagatatatacttgcttctttccaacaggatatactaatttctgtttttagatttccttcagagtaagttaatattttagctaaagcacttccacctctgaatattccagtctaaatccattttggaaaactagccctcacaacattcattagaaaattgtatttgtattatcttttgtgagatgtgctatgggtttagagatatgttatgaatcctactcaaaaggaaaaatccagaagcatgaatatattcattttacaaataaaaaaattatagaacaaaggaagataaaaatatacacctgaacatttttctcatttgattaattattcaactgtaacatttgtagaagaaatatttcccattcagtaattctgaattcaactgtgataaaaatgtggcaaatgtgaagaggcactgaatatttctttttaaatattgctgtaacttggtataagtgtaatttaaatagtgcatgaaaataaatggcattttcaggtattatatgacattgttcccataaaattccagtctaagtcataaatcacagcttttgaatcgaatacctatatgtgctaatgcatttctaacaaataactcttttttactacaaaaaacccattggcatacagaattttataatcagaggttcccagctgctcaccttaaattaaaacttgacttaggtaaaggcaaaatttaaaaaaaaaaagtcagcattaccttaggttttatactgagtcacatttcgaatctaataaaaattaggcatttgtttcttagtctgaatcacaggcatttccaaggataattgagcctatttgatttggtttaataactatttggatgattccaaatgcgcacaaaacactgaataaaatgagagatgaataagatcaatctccacagttaaggtgctaaaacatctagaaatgaaggtaagtcaaatacacaaacagctttatattcaagtcatgccacagtaagtttccaaaatcaagatatgaagagggggcgattacatacagctttaaggatggtagcattcactggggagagataagcgagatggtactctcggggaacagctggagtttacctagttagtcagaggaatgaaatcattatatatttctaaagaacaagaatagtcctatttcaagatacagtcatgacttgaaaaggagaagaatcacctgaaaaggagaatagaaaataaactgaggcctgagagccttctaaattgagggacttgcactcagttaggcaagcaaccactgtggactactgaaggatccttaaaagaagagagatggtatgtccatttgtgcttctgtaacaaaatacctgagatggggtaatttatttaaaaaattttgttttctcacagttctggaggctgagaagtccaagatcaagcctccagcaggttcagttgcctggtaaggcctgctctctgcttctaagattctgccgtctcacatcctctggaggggaggaatgctgtggtctcacatggaagaaggcataagggcaagagaaccaaacactgtgtgaagcctcttttacaatggcctaaatctcattcacaaggggagaagcccttataacctaatcacttcttaaaggccccacatcttaacagagttacactggccattaagtttcatcacccaaatttgcaggggggcatttgaaaccacagcagcaaatcaatgttttgtttcataaagattaattagatgcttatcaggctgattgggatggaagaaaagaagatggaaacaaaaagactagtttaatcaccaaagaaataatctaggcaggagatgaggagagcaaaaactatgatagtggttatggaaacagagagtgggagacaaagggatggatgctggaaacttcatagagctgaaatctttaacaactgcctgtacattgcctatggaaataaagagagaaaaaagacaaatatggccatgctttttaaaaatttggatgcatattgaaataccattaaccaaaatatggaagtcaagagtatttagcccccaaaataagataatgggttttgtagtagatattttgagtttggtgtggcaatgatagcaaagatgacaagtaattatattgactgggttgatgtgtaagtgtggaagttcatctactttcaggtaatagctgtaatcactgggatagatgaaactgtacaatcagactatacgaaataaataaggcagaattttttttttctgagacggagtctcactctgtagcccaggctggagtgcagtggtgccatctcggctcactgcaagctctgcctctcgggttcacaccattctcctgcctcagcctcccgagtagctgggactacaggtgcccgccaccatgcccagttaattttttctatttttagtagagacggggtttcaccgtgttagccaggatggtctcgatctcctgacctcgtgatttgcccgcctcggcctcccaaagtgccgggattacaggcgtgagccaccgcacctggcccagaattttttattgttacataatagatgtacatttataagggtacatgtagtattttgatacattcatataatatataatgattaaatcaggataactgggatatccatcatcgccacaaatatttaccttttctttatgtgggaatatttggagaattatcttacagctgtttcgaatagctgtaaaatagattatgattcactgaagtcaccctactgagctatcaaacactatgtcttattccttctaactgtatttttgtacccatttttcctctctttatctttccttccccatacccttcctggcctctgataaccaccgatttactttctatcttcatgaaatatagcttttaatccctatgaaaatattaatgacattcttcacaaagatagaatgaagtcctaaaatttgtatggaatcactaaacaccctaaatggcgaaagcagtcctgagaaaacaaaaaagaacaaagcctgaggcaccacactaccggaatcgaaatatactactaagctatagtacaaaaacagcaacataaaaacagacacatagaccaatggaacagaatagagaacccagaaataaaaccacacatttgcaaccaactcatttttgacaaaagcaccaagaacataccttgaagaaaggacagtcttcaatacaaggtgctgggaagactagatatccatatgcacaggaataaaactagagtcctatttctcaccatatagaaaagtcaaatcaaaatagattaaggatgtgaagttttggatgtctatatttgaaggaggtgaaagaagagcaggaaagggggccagtaaatgagaaaccgattagcaagaaacaaatacaacacttaggtattaatttaacattgttattattaaagggtataacatgttattgtgagatttttaaaattataattacagtgatttattatgttcttggatggtaagtctgaatatttaaagaatatttacaaatgtcaagtttcttcaaattactatatatgttaaatgcaatacaaatcaaaataccaatagaacttttctagcaatttgataaaattgtaacagattgtatgagaattgtaaaaaaattcttcctaaacataatgtcaatacagtctaaaggaaaaggccaatagttttaaatgcagtgaaaattaaaatttcttaatgagagaaaatatactaaaaattatgtagattgaaacactaacaaatatttcaataaatataatgaacaaaatataaataccctttatatataaagcattcttataaatcaacaattttaaaattccttaaatagaaatatgagcaaaacacacaagcaagcaatgtgaaaacctcatgaaaattataaagctgaccataagcagggaaatatattcaattttactagtagtgcaaaaaataaaaatagaaataatgagattccttttgaaacttgttaaattgaaatgatgttaaaatgaaaattccataagattgaaacaaatggccattttgaatttcaaaatttgtaagtgttcacaatggacaatcaccaaaatcagtcatctctccagtatggcaatcattgtcactctgaaaattgatgctaaatcaatctccaggaatgacttcatgttgtatctacataacaccagaagttcctccaaaatttaaaagcataaacctattaaatcttaaatggcttattctcacaatccagccaaggccacagaaagatttggtccactggaatgcattctgaatatatctcattggagatttaaaaacatgtatccaaaataatttcatcaacctgcaaggtaaaatccagaatttaaatagtacgagagtggttgtttcaggttctaccctctgggtctggaaagctcagctacatctctagcctatctgaagtgtaccaatttactcttcaagacccatctagtacctctgtgaggatttccctgtattcctctcctcctacttctggtagagtagaaatgtcttcccagtctcttatatatacctccattacagtatgttacatacaatgcacgtctgctatattaattatcatttgcacgcttttttctcttaccaggtagagtctttcttaaacagaggattttttttaatttctctgattcaagggcataagaagagaaatagaacacatcattgaggaagggtcggaagaaaaagagagagagaaagaaaaaagaaagaaagaaaaaggtaagaaggaaagaaggaaagaaggaaagaaggaaagaaagaaagaaagaaagaaagaaagaaagaaagaaagaaagaaagaaagaaagaaagagaaagagaaagaaagaaagagaggaaactgcatattatgatccagtgcatcccttggatccatcccttggatgcatttgtccaaaggtccttccagggctgaaagaatgcagggctatccaggaggagtgtagttagttaatcaatggcttttatcaggaataggcaatttaaagtgcaattgaccttagtaagtactaagccaatttttcgtacaattttagaactaggtagggttttaatatttgtatagttttcaggtatatgtatcagtcagcttgtaggtaggctgcagatctaatctcagtatcagtttgtggaaaatttctaacccattggattattatgaagatttaatgaaataatcgatctaaagagcttggcaaagtgtctggcacatactaagcactcaataaatcaagggccattattattatatgatatatgccttccaatgtacagatcagaaacttgaagctctgataatgtatgcaaatccaataggagctggcagaacaagaagtaaaatccagacatccccagtggttctcaagctatctttaaacattattaggcttttggttctgttttactaaattccatggaccatggtcccctattatttaggagagatagagcagctgctcaaggaaagaaaaaggttgaacttctttttgctattttcctctaattttttcatcccatctgacccagctataatttatgtctcattttaaaataagaatggtaaattacacaattagttgtacttctctaaaatggaaatgcagaatctatattgttccattctccccttctatgtggctggtatgtattctttaacaataaaatcaatgttctcttttttcctatgttaaacactaaatatttaaactacatacacaagtaacacttgaaactcagcaattaaaaaaaaaaagtataaaatgactcctaaaagactgtttagaatccctctagttaacagccacatactatgtaatgaagttgcaaacagattttccaccagagggcttttgctttggttactatccttttggggattccagtgtgagcaatatgaatgcctagcttgccatatgtctgatagtcaaaggaaggttcaggaaagatggcagcaaagaagccataacatctacaggatactgaaatgcaaacttgccctttccacaatttagcaaaaagccacaacactttgatgaataatacactatttattaattatccagagtaattagggctttattatttatctagaataaatatataaataaatagtcattcataaatagatcatcagatcgatagatgataggagcttaatacatgtagtcatatcctaatgattccatctaattacaaattacagagcaacatattggctttgaaaaaagatgaatcctttatttttggagccagatactcacctaatgaggagttcctaccttttataattatctagtgtgaactatctttgcacaatattttgaaaggtaggcaccaaatcactgcaggaatacctgtattttatgactttggaaggcagttctacctccatttttagaaagctctcagtgttagagagatcaacattttacccagctaactttctatatagcttctaccttttcatcttagttttgccctgtggaattgtacgaactaaatcagatccatttggcatacagcaagaccatgaattgactcatacatatctttcttcctttggtttaagtatctataattccttacaggaaaatgttgggatttgaaactttataaccaaaaagatattatttctgttaataagcaatgtaatgatattcatatataaagcaaaagttccagaaatatatcatctatgtgctatttttaaaagtaatatttgaatattcaagtagcctgagaatgtaaaataaagaatagagagatatgttataaaatgatttaaaaatcacttacaaagttaaatctaaacaatcacaaaattaaatctagctgatttgtttacaaaactaaatgggtcaaaattattcttaaaacaaaataatactttaatataataatttaatattttggaattattttttagttttatgtttttattaaatttctatatttttaaatgggaagaccttatttttacataatgagatgtgtctccttaaaacatttccaaatcaaacttgattagcatagaaattaaaatttttcttttcttattcctgtattcccataatttctagaatgccaggttgtactcatataagcatccagtatttccacatttattaatcagaatagagatcattctcatggatacacactaaaacctaaagcattatggaacaaaggtcattctcttctgagagtaaaacaggagaggaattcttttctttgactgaacttctaaacataacatacatatttacaaagaaaaggatgggaaaataaaaacatgcaaaattcctcctcttatatatagcacagttaaattatattttgttcttatttcattaaaaaggtaatttttaaaaggaatgttaaagagataaccttccaaaatattgaaaataaaacaaaaataccttgggctgtgacaataatatatgttgatatagacaattaataaaagtctataataactgtagaagaaaaaaataaagacaattttaatataccttgtttacaagaaaataagttaatagtaggaacaagtatcagaggagcaaagaagaagatgaagaacaagaggaggaggaaggaaaggtaaaggaccctccctatcatcagaaatggcagtgttaattttagacataaaacagaaggcaaatagttaacacaaaaagaatgaccaaaagatctaatatgtgatgacagaatagttgcaaaatgtgcgaactgaataatttagtatcaaaatgggtttaacaaaactttaaaaaataaagtgataatcagatagaaatatatagttagcaggaaaatttaacatattggctttcagttcttttatcaatcaattagaaacagagaaataaggtcacaggaattttactaaaattgaggaataaacgctgaactttgttccctcctaataaataattcaccttttattcatgtatccctagcccatttagaaaaattgaatatggagtttattgcaaaataagagtaatttaatttcatctcaaaaaagaacaacttgtacaaaggagctgatttgacctaaaggcaataaaagaaaaactaacaccaaaagtttcaacaaacaaacaaaaccgacttctcagttatctttattttaaaaagaaaaccaaaactcaaaatgcaagttgtgttagatgtgagaaaaattaaaataactatcaacgtcacatttattgttctaaaaactttctttgtaagacaacatactttagaaaatttagaaaaattgtattcaacaaattcaatgaaaggataaaaaatactatatgtgtgtgcatgtgtgtatgcagttaattaaaatgtgaaaaacagttgaataaactggttctgtaaaaaaataaaaatacaggtaaactccactaagtaagctactcagaaagtaacagtgttggcagatttccaaagctagaatcagatgtaattacaatcaaatgacaaatgtcatctttatcatacatgaaactatgatatcaggtttgtttttgaggtctaataccctacttggcttaatagtttatgtttcaataactgtagctttataatttcatttgatatttggtaaggtaaatcccatcttaactaatttaaaatatactatcaccagccagttattaatattatgttttattttttcaattaaagacagagtcttgctctatcaccaagtctacagtttttattattattaaattttgattttacattgttgaaaaccacaatagttattgagattttaattgaattgcaaaaaatctgcaaattaatttgtaaataatttacatttagagaatttcatcttcccatacaggaaatggatgtgcatactcacttatttctgtcttcttgcatgtttatccacagtgctttgttttttcaacataatatgccacatatttcttactatagtcttaaatatgttttataaatgttgacgtcacagttttacccaatatattttcttacttgtttataatggtatgtagagtatcaaatcaaatactgtcaaagcaacttaactaatgaaatagtcatgtttttctgacaaataatcttaatctcagctatgaccactatttattcagcacacatttcatgagttcctataagacaatgaatatactaatatataatatagagacctcaatatgtagttggaaaaacaaacctgggttgaagaataaaatgtttgacagtgggatcaatgagatcaagggttagcttaagcctcaaaaaaaaaatactacctttatgaacaaagaaaaatggtaaagataggtaaggatattattacattggaaggtgaaggaggacaacatgttgaaagagttcataatatatgcctaaatcattagaaataaaagagaagattcttccctatataggagccattcactgacaagccatttccaagtatatttaaacttttacttttagaaaaaaattattttttggagcagtgtgggaaaattggtttttcttttggtatttaaaattataaatactaaaggattcttaaatatttaagaaatgtttaattttttaaaaggaagtatgaaaatctagaatttaatcacattaacttctacaattaaaaagaaaacaaaactaatatctatagcaatatcatacatttgggaacaagcatgagatattacactgagttttaagacatctgacactctcttccctaatgggtttcaaaggacatactcccacatagttatagtaaaactctgttatttatgttaatggtttttgaggagatccttgagaagtcttatccctcaccaaatccttgttaggtaagtatggtaaagatgccattatctccattttacagatcagaccatcaacacactcagtttcaatgattagtagaaggcactaagcatgcacaaaaatggaaagataaaaaatatcctgattgctaggcatcttaaaaaaaggatacttcctatgctttatatatatatattttttctgctcttttatacttgtttctttaatattttcaatgtcaatattcaatgtttatatttaaagtaataaaatcagtataatacatcatccttaccttcacaagttcaaaccccatgctaattgatgactctctaaaactatgtctcttatatattggtaatttttacccatagaacttcccatatttaaaaagctgaaaagaggctgggcacggtggctcatgcctgtaatccaagaactttgggaggccaaggcgggcagatcacttgaggtcaggagttcgagaccagtctggccatcatgatgaaaccttgtctctactaaaattacaaaaaatagctaggcatggtggcacacacccataatttcagctactcgagaagctgaggctggagaattgcttaattcttggctcagggcaacctcctgggaggcagaggttgcactgagctgaggttgcgccactgcactccagcctgggtgacagaacgagattctatctcacaaaaaaaaaaaaaaaaaaaagctgaaaaaagattatgtttttctcccagagcttattaaggtaaaactgtcgaagttagatatatttactgtatacaatatgatgttttgttatatgtaaacattgtgaaatgcttaagtcaagctaattaatgtaacgagcacctcacataactcatcattattttgtgtgtggtgagaacatttaagaaccactctcttaacaattttcaagtatacaataattattattaactgcagtcattattctgtacagtaagtccccagaacatattcatcctgtttaattgaaactttgtacccttggaccaccatttccctactccctcactccccatgccctgccaaccaccattatactctttgcttctattagcttgacttcttgcattccccatataagtgagatcatgcatctggggaaaaaaaaaggcatgtcaactccattgctgtgaatattaactactcacccatgcatatgggaaataccctggtatcatccaacctggggatgcgtttagacttctatgattccataatcaagagaatgaattaagggcttatacttctcatgagagagacagtaaacattatatatatatatatatatatatatatatattagatatataatagatatacagtaaacattttaaatatatgtgtgtgggggggtctatgtgtgtgtgtatgtgtggtctgtgtgtgtgtgtgtgcgtatctgtgtgtgtgtcatctccattgatatgaaaaacatgtaagttattctaaaatcattattatctgtcccattccctttaataagtgacagataaactaattaactgaacaaatgggctccagtgagtttgagcaactaaacatacatttacttcctatttgaaaaatgtgtaacattatgaagacaattacagtcttaagtcaaattggcagaaacttaagtatatctggcaagatgaccttgccattagtgaggtatttctgagcagaggaatgacactcccaaacacctaatataaaatgttatgagcagtcatttaatttgaacacatgcaaaagcctgacttgattaagaaggaaaaataaaattatatttatcgttatagaatagtgttataagtgtgactttgatcttcaaagtaacttctttttaattctcattaaaagttgctgtgttagggtttgcaccatctcctctccaactccagcaagtacagctcatagcaacaaaagtgattacttccttctgtttaaggagaggagagtgaagacaaaagaggactttgttttgccttttggatgccagttcagccacaataggataggcaccaggtagagttgtgaggccccattccaggccctagctcccaggtgacatttctaggcaagtcctgggcaaaaagggatcctgttgccttgaagtgaagggcctggtcttggcagaattcaccacctgctgactaaagagcccttgggccctgaataaccagcagtaatacccagggtgtaagccattggccttgggctttgagctgtgctggcttcaggtgagactcagcacattcccacctatggtggctatagtgaaagactccttctatttgagaaaaacagagtgaaaagtaagggggactttgtcttggaccttagtaccagctcagccacagtggggtagagcaaccagcagattcttggggtcctggagtccaggcctagactcttaggcagcatttctggacctgccctgggccaaaaaggagcccactgccctgaaggccgagttccaggcctggcagcattcaccacaagctgacagaacagccctggggctttaagctaacatcagcagtggcatggcagaacccccggggactggtggtgatggtagccacaagcagaagcttctttgactatgtaaaggggaaggaagggtgtgaaaaactcagtatgggtaatattgagtgtcaacttgattggattgaaggatgcaaagtattgttcttgggtgtgtctgagacagtgttgccaaaggagattaacatttgagtcagtggactgggagaggcagacccactctcaatctatgggacaccagttcatcagctaccagcatggctagaataaagcaggcagaagaaaatggaaagagcagacttgctgaggcttccagccttcatctttctcctctgctggatgtttcctgccctcgaacatcagactccaagttcttcagcttttggaatcttggacttacgccagtggtttaccagggcctcttgtgcctttggccacagactgtcagcttccctatttttgaggttttgggactcagactggcttacttggtcctcagcttgcagatgacctattgtgggacctcaacttgtgatcgtgtgagtcaatactcaataaactcccctttatatatacgtatacaccactacttctgtccctctagaaaaccctgactagtacatgtggtctgagtgccagctaggatgcaagagagtagaacataaggtgaattgctaagatttttgactccaatccctggcttccacacagcatctctggacatgcctgggcactgagaaattcaccatcctaaagggaaggcccttgggcaaggtttaatactgtgctggctttaggtctgacctggcagagtcccagtggtggtggccacaagggtgcttacatcaccacatatgcagtttcaagtgactcaccacagagagagagagaatctctacatttgggagaaagtaagataaaagaacgagagtctctgccttgtaattcagagaattcttcaggatcttatccaagaccagcaaggaggtacctttgagagtctgtaaaaaccacagtattatttgttttgaagccaaagtccctttgaatacctggaaagcctccccaggaaggacatatgcaaacaagcccagactataaagactatagtaaatacctaactcttcaatgcccagacactagagaatatctataagcatcaacactatccaggaaaataggacctcatcaaatgaattaaacaaggtaccagggacaatcctggagaaacagagatatgtaacctttcagacacagaattcaaaatagctgctttaaggaaactcaaagaaattccagataacgcagagacgaaattcagaattctaccagataaatttaacagagattgtaataaaaagaatcaagcaggaattctagagttgaaaaatgccactgacatgctgaagaatgcatcaaagtttcttaatagcagaaatgatcaagcagaaagaattagtgagtttgaaaacaggctatttgaaattgcacagtcagaggagacaaaaaaagtcaatgaagcacacctacaagatctagaaaacagtctcaaagggcaaatgtaagagttattgaccgtaaggaggagatagagaaagagatagaggtagagagtttatttaaagagataatatcagaggacttcctaatcctagggaaaggtaagaacgttcaaatacacaagagggaaacagaacaacatgcagatttagcccaaataagactatttcaaggcatgtaataatcaaactcccaaaggtcaaggataaagaaaggatcctaaaagcagcaagagaaaagaaacaaataacatacaatggcactccagtacatctggcagctgacgtttcagtggaaaccttacaggccatgagagagtgaaatgacatatttttaatgtgatgaaaaaaatttacattagaatagtatatttggtaaaaatattctttaagcatgaaggataaagactgtcccagacaaacaaaagctgagagatttcatcaacaccagacctgtccaacaagaaatgctaaagggatttcttcaatctgaaaaataaatgttaatgagcaagaataaattatctaaaggcacaaaactcactgctaatagtaagcacaaagaaaaacgcggaatagtttaacacagtaattgtagtgtgtatacgtttcctgacttaagtagaaagactaaatgatgaaacaatcaaaaacagtaacacaactttttgagacatagacagtacatattcagccataaaaaagaatgagattctgtcatttgcaacaacatggacagaactagaggtcattgtgttcaatgaaataagctaggcacagaaaaataaacatcacatattctcacttgtttgtgagatcttaaaaatcaaaacaattgaaaccatggacataataaatacaaggatgtttaccaaaggccgggaagggtagtagggggtgtaggaagggaagtggaaatggttaatcagtataaaaataaagactgaaagaatgaataagacctagtatttgatagcacatcaggggaactatagtcaataataatttaattgtgcatattaaaataactaagagtataactggattgtttgtaacacaaaggacaatactttaggggttgaatacccaatttgtcatcatgtgattattatgcattgcatgtctataccagaatatctcgggtaccccatatttatatacaagtactatgtactgcaaaaattaaaaataaaaaaatttaaagtcatagggtaaaagacacagtacagtaagtcacaaagagaaacaaaatagttaaacagtgcggggggggggtaaagttaaatgtaggatttttattaggttttttttgcatgtttgtttgtttgtttatgcaatcagtgctaagctgtcatctgtttaagataatgggttataggatagtatttgcaaggctcacagaaacctcaaattgaaaaagcatacaatagatatacacacaaaaaattttcaaagcaagaaattaaagcataccaccagagaaaaatcacatttattaaaagaaagatgggaaggaagaaaataaggaagagaagaccacaaaacaaccagaaaagaaataataaaatggcaggagtaagtcaccacttatctgtcactcaataataacatcgaatgtaaagaaaccaaactctccaatcaaaaaagatagattggctgaatggattaaaaaaaacaaggcccagtgatctgttgcctataagaaactcttcactcgccaggtgcggtggctcacacctgcaatcccagcactttggaaggccgaggcaggtggatcagatcacaagatcaggagttcaagaccagcctggccaacgtggcaaaaccccagctctactaaaaatacagaaaaattagccgggcatggtggcacatgcctgtaatcccagctactcgggaggttgaagcagagaattgcttgaacctaggaggtggaggttgcagtgagccaagattgtgccactgcactccagcctgggcaacagagtgagactctgtcaaaaaaacacacacaaaaacaaacaaacaaaaaaacacttcactgataaatatgcacatagattgaaaataaagaaatggaaaaggatattccattccaatggaaacctaaaaagagcaggagtagctatacttatatcagacaaaatagatttcaagacagaaactgtaaaaagagataaagaaggtaattacatactgatccattagtcaattcggcataaggatacaacaattttaaatatatatgcatccaacactgcagcacccagatatatcaagcaaatattattagaactaaagagagagagagagagagatcccaatagggaatagatggagatttcaacaccccactttaaacattggaaatatttaccaggcagaaaatcaacgacaacaacaacaacaaaaaatgggacttaatctgcattatagaccaaatgaacctaatagatatatacagaacatttcatccaacagctgcagaatacacattttcctcaccacatagatcattctcaagaatagaccatatgttaggtcacaaaaagagttttaaaacattcaaaaaagttcaggaaatttcaggcatcatctctgaccacagcggaataaaactagaaatcaacaagaagcagaactttggaaactatataaacacatggaaattaaacaatgtgctcctgaatgacagtgggtcaataaagaaattaaaaaggaaattggaatttttttcaaaacaaatgataatggaaacacaacatgccaaaacctatgtgatatggcaaaaacagtactaagaggaaaatctgtagctataaatgcctacataaaatagaagaaaaacttcaagtaggtaacttaatgatgcatcttaaagaactagaaaatcaagagcaaaccaaatccaaaattagtagaagaaatactaaaaataagaacagaaataaataaatttgaaatgaaaataaataacagataaatgaaacaaatagttgtgatttttttgaaaagatgaacaaaattaacaaacctttagccagactagctaagaaaaaaagagaggagacccaaataattaaaaccagatatgaaaaaaggagtaattacaatggatgccacagaaattcaaaggatcattagtggctagcatgatcaactaaataccaataaatgggaagatctagaataaataaaaaattcacagacatctacaaccaaccaagattgaataatgaagaaatgtataacctgagcagaccaataacaagtaataaaatcaaatctgtaataaaaagtctcctagtaaagaaaaacccaggacaagatggcttcactgctgaattctaccaatcatttcaaaaagcaataccaataccactcagactgttctgaaaaatagaggaagagaagatacttccaaactcatctatgaggtcattattgtcctgataccaaaacaagacaaagatacatcaaaaaaagaaaaccacaggccaatagctctgatgaatattgattcaaaaatactcaacaaaatactagtaaactaaattcaacaatatattaaaaatatcattcatcatgaccaagtaggatttacaacagggctgtaaggatggttcaacatatgcaaatcaatcactgtgaaacatcataccaacagaatgaaggacaaaaaccatagatcatttcaaatgatgctgaaaagcatttgataaagttcaacacgccttcataataaaaaccctcaacagttgggtagagaaggaacatacctcaacataataaaatctgcttatgacaaacccatagctagtattatacagaatatgaaaacactaaaagcttttcctcatagatctgaaatactacaagattgctcactttcaccattgttattcaatattgtactggaagtcttagctagagcaattagacaagagaaagaaataaagggcatccaaattggaaaggaaaatgtcaaattatccttctttgcagatgatatgatcttatacttggaaaaaccaaaagattctacaagaaaactattagaactgataaacaaattcagtaaagttgcaggatacaaaatcgtcatataaaaattagcagcacttctgtatgccaatagtaaacaatgtgaaaaataaattaaaaagtaattccatttacaatagccacaaataaaataaaaaatctaggaattaaccaaagaagtaaaagatttctacaataaaaactataaaacattgatgaaagaaattgaagagggcaccccaaagtggaaagatattccatgttcatgaattggaagaattaatattgttaaaatatccatactacacaaagcaatctatagattcaacacaatccctataaaaataccaatgacattcttcacagaaatagaaaaaacaatcctaaaattgatatgacatcacaaaagacccagaatagccaaagccatcctgagtaaaaagaaaaaactggatgcatcacattacctgacttcaaattatactacagagctatagtaaccaaaacagcatggtactggcaaaaaaacaaacaaaaatatcccggacacatagaccaatggaacagagtagagaacccagaaataaatccacacacctgcagtaaacacatttttgacaaatgtgtcaagaacatacattagtgaaaagacagtctcttcaataaatggtgctgggaaaactggttatctatatgcagaagaatgaaacttgatccccatctcttatcttatgcaaaaatcaaaacaaaatagattaaagacttaaatctaaggccttaaactatgaaactagtaaaagaaaaccttgggggaaactccagtaaattggtctgggcaaaaatttcttgagtaatatcccacaagcataagcaacgaaagaaaacatggacaaatgggatcacatcaagtttaaaaagctgaagtttataaaaacttaagttttaagtttaaaaagcacagtaaagaaaagaatcaagaaagtgaagagacaaatcacagaattggagaaaatatttgcaaactacccatccgacaagggattaataaccagaatatataaggagctcaaacaactccataagaaaaaatctggtcgggcacagtggctcacgcctgtaattccaacactttgggaggccaaggcaggcagatcatgaggtcaggagatcaagaccatcctggccaacatggtgaaaccccgtctctactaaaaatacaaacattagctgggtgtgatggtgtgcgcctgtaatcccagctacttgggaggctgaggcaggagaattgcttgaacccgggaggtggaaactgcagtgagctgagatcgtgccactgcactccagcctggtgacaaagcaagaccctgtctcaaaaaaaaaaaaaaaaaaaaaaaaagaaaaaagaaaaaaaaaatctaagaatgtggggtggggccaagatagccaactagaagcagtggcaatcagaggcaaccatcaaaaagatccaaacagtgtgcaagtcctgcagtggtaaccgaggtatcagggttctgtcattaggactgactaggcggcaggtatgacccacagtgaggaaggaagggcagtgtggtgcagccgcccacctgagagccacagggggcaggggagccaccctcagccaagagaggtgctctgaggaatctggacagcccagattagtaggtttacccccagtgtagcacaccccatcaccaagggacagccaaagtgccttgttaaatgggtcctgcttcctatgccactcaactgagtgagatcccccaacaggggttgtcagacatcttatatagaagtgttcctactgtcatcaggtcagtactcctcaaggccagagatcccagaggaagaagtaggcacccatctttgctcttctccagcctccctgaataacatctccaggcatggaagtaaatagggcatgaggtaaacccccagcaaactgcagcagccctacagaagagggacctgactactgaaagaaaaacaaacagaaagccaacataacagcatcaacaaaaaagtccacacaaaatcttcatccaagggtcaacagcctcaaagatcaaaactagaaaaaatcatgaagatgagaaaaaaaaatcaatgaaaaaatgcttgaaacccaaaaggccagagtgcctcttctcctccaaataattgcagcacctttccaacaggggccagaattggatggaggatgagatggacaaattgacaaaagtaggcttcagaaggtgggtaataacaaacttcactaaggtaaaagagcatgttctaacccaatgcaaagaagctgagaaccttgacaaaatgttagaggaggtggtaactagaagaaccagttcagatagaaacataaatgaccaacggagctgaaaaacatagcatgagaacttcgtgaaccatacacaagtataaatagcagaattgatcaagtggaagaaagagtatcagagttggaagactatcttgctgaaataaggcaggcagacaagattaaagagaaaaaaaataaaaaggaaaaacaaaacctctgagaaatatgggcctatgtaaaaagaccaaaccaacgactgattggagtacctgaaagagacagggtgaatggattcaagttgaaaaacacacttcaggatattatccaggagaacttccccaacctagcaagacaggccaacattcaaattcgggaaatacagagaacaccactaagatactccatgagaagatcaaccccaagacacataatgatcagattctccaaggttgaaatgaggaaaaaatgttaaaggcagccagagagaaaggccaggtcacctacaaagggaagcccatcagattaacagcagacctctcagcagaaaccctacaagccagaagagagtaggggccaatattcgacattcttaaagaaaagaattttcaacctggaatttcatatccagccaaactaagcttcataagtgaaggagaaataaaatccttttcagacaagcaaatgctgagggaattcgtcattaccaggcctgccttgcaagagttcctgaagaaagcactaagtatggaaaggaaaaaccagtactagccactgcaaaacacaagaaaatataaacaccattgacatcatgaagaaacagcatcaactagtgtgcaaaataaccagctagcatcatgataacagaatcaaattcacacataacaatattaaccttaaatgtaaatggtctaaatgccccagttaaaagacacggactaggctgggtgtggtagctcacgcctgtaatcctagcactttgggaggcgaaggtgggcagattgcctgagtcaggagttcaaaaccagcctgggcaacatggtgaaaccccatctgtactaaaaaatacaaaaaaattaaccgggtgtggtggtgggtgcctgtagtcccagctactcaggaggctgaggcaggataattgcttgaacctgggaggcagaggttacagtgagccaagatcgtgctactgccttccagcctgtgcgacggagaaagactctctcaaaaaataaaaaaagaagaagaagaagacacagactggcaaattggataaggagtcaaggcccatcagtgtgctgtattcaggatacccatctcacgtgcaaagataccataggctcaaaataaagggatggaagaatatttaccaagcaaatggaaagcaacaaacaaacaaacaaacaaacaaaaaaacaaaaaaaacgggttggattcctagttcctgataaaacagactttaaaccaaaaaagattaaaagaagaagaagaagaagaagggcgttacataatggtaaagagaacaattcaacaagaggagctgactatcctaaatatatatgcacccaatacaagagcacccagattcataaaacatgttcttagagacctacaaagatacttagactcccactcaataatagtgagagactataacaccccactggcaatattagacaaatccatgagacagaaaattaacaaggatattcaggacttgaactctgctctggatcaaatggacctaataaatatctatagaactctctaccccaaaacaatagaatatacattcttctcagagccacatgggacttatgctaaaattgaccacataattggaagtaaaacactcctcagcaaacgcataagaacagaaatcatacaaacagtctcttagaccacagtgcaatcaaattagaactcagaattaagaaactcactgaaaaccacacaattacatggaaattgaacaacctactcctgaatgattcctgggtaaataatgaaattaaggcagaaatcaagaagttctttgaaaccaatgagaacaaacagacaatgtaccagaatctctggaacacagctaaagcagttttaagagggaaattgatagcactaaatgcccacatcagaaagctagaaagatctcaaatcgacagaactacagatgcaagagcaaagacatcaaaaagctagcagaagacaagaaataattaagatcagagtggaactgaaggagacagagaaacaaaaaacccttcaaaaaattagtgaatccaggagctggtttattgaaaaaaattaataaaatagactgctagctaaactaataaagaagaaaagagagaagattcaaatcaacacaataaaaaatgaataaggggatatcatcactgacctcacagaaatacaaactaccatcagagaatactataaacaaccctacacaaataactagaaaatctaaaagaaatggatgaattcctggacacatacaccctcccaaaactaaaccaggaagaagtcgaatccttgcatagaccaataacaagtcctgaaattgaggcagtaatagtatgccaaccaaaaaaaaaaaaaagcccaggaccacatggattcacagccaaattctaccagaggtacaaagaggaactggtaccattccttcagaaattattcgaaataattgaaaagtaaggactcctccctaacttattttatgaggccagcatcattctgataccaacacctggcagagacacaacaaaaaaagaaaagttcaggccaacattcctgatcaccatagatgtaaaaatccttaatcaaatactggcaaaccaaatccagcaccacatcaaaaagtttatccaccactatcgagtcagcctcatcactgggatgcaagactggttcaacataagtgaatcaataaacgtaatccatcacacaaactgaaccaatgataaaaaccacatgatcgtctcaataaacgcagaaaaggccttcaataaaattcgacataccttcaggttaaaaactctcaataaactaggtattgatggaacatatctcaaaataataagtgctatttataacaaacccacaactgatatactaaatgggctaaagctggaagcgttccctttgaaaactggcacaaggtaaggatgtcctctctcaccactcctattcaacatagtattggaagttccagccagggcaatcaggcaagagaaataaaaaaaggttttcaattaggaagagacaaagtcaaactgtctctgtttgcagatgacgtgatcctacacctagagaaccccatcatctcagcccataagctgataagcaatgtcagcaaagtctcaggatacaaaatcaatgtgcaaaaatcacaagaattcctatacaacaacaatagacaagcagagagccaaatcatcaatgaactcccattcacaattgctacaaagagaataaaatacctaggaatatagctaagaagggatgtggagaaactcttcaaggagaactacaaaccactgctcaaggcaataagacaggacacaagcaaatggaaaaacattgtatcctcatggataggaagaatcaacataatgaaatggccatactgctcaaaataatttatagattgaatgctattctcatcaaactaccattaacattcttcacagaattagaaaaaaaaactactttaaatttcatgtggaatcaaagtagaacccatatagccaagacaaccctaaacaaaaagaacaaagctggaggcatcatgctacctgacttcaaactataccacaaggctacagtaaccaaaacactatggtactggtaccaaaacagacacatagacaactggaacagaatagagacctcagaaataagaccacatgccaggcacggtggctcatgcctgtaatcccagcactttagaatgctgaggcaggtggatcatgaagtcaggagttcaagaccagcctgaccaacatggtgaaaccccatctctactaaaaataccaaaattagccgggcatggtggtgtgtacctgtagtcacagctacctgggaggctgaggaaggagaatcgcttgaacccagggggaggcggagtttgcagtgagccgagatcttgccactgcactccagtctgggtgacagagtgagactccatctcaaaaaaataaaaaagaagaccacacatctacaaccatctgatcttaaacaaacctaacaaaaacaaggaatagggaaagtattccctatttaataataggtgctgggaaaactggctagccgtatgcagaaaattgacactggaccccttccttacaccttatagaaaaattaactcaagatggattaaagacttaaatataaaacccaaaaccataaaagccttagaagaaaacctaggcaataccattcaggacataggcatgggaaaagcttgtatgatgacatctccagaagcaactgtaacaaaagctaaaattggcaaatgggttctaattaaactaaagagcttctgcacagcaaaagaaactatcgttagattgaacaggcatcctacagagtgggagaatatttttgcaatctacccttttgacaaaggtctaatatacagaatttacaagaaactaaaacaaatttacaagaaaaaacaaacaaacaaccctttttcaaagtgggcaaaggatatgaacagacacttctttaaagaagaaatttaggtagccaacatgaaaaaaagctcaacatcactgatcattagagaaatgcaaatcaaaaccacaatggaataccatctcacgccagtcagaatggcaattattaaaaaatcacaacaattaatgatggcaaggctgtggagaaatagcaacaggttttacattgctggtgggaatgttaattagttcaaccattgtggatgacagtgtggcgattcctcaaggatctagaaccagaaatgccattggatccagcaatcccattactgggtatatacccaaaggaatataaatcattctattataaagatatatgcatagtatgtttattgtagcactattcacaacagcaaagagatggaaccaacccaaatgtccatcaatgatagactggataaagaaaatgtggtacatataaaccatggaatattatgcagccacaaaaaggaatgagatcatgtgttttgcagagacatggatgaagctggaagtcatcatactcagcaaactaacacaggaacagaaaaccaaacactgtatgttctcactcttaggtgggagttgaacaatgagaacacatggacacagggaggggaacaacgcacactggggcctgtagggaagggacaaagtgggggagagcatcaagacaaatagctaatgcatgcaggtttaaaacctaggtgatgggttgataggtgtaacaaagtaccatggcactcatatacctttgtaacacgcctgcatgatctgcacatgtatcccagaacttaaagtttaaaaaaaaaattgaatatccaattacaaaatgggcaaaagatttgaatggaaatttctcaaaagaagacatacaaatggcaaacatgcatttgaaaatgtgccaacatcatggatcatcagataaatgcaaatcaaaactataataaaatatcatctcaccccagttaaaatggcttttatccaaaagtcaggagctaacaaatgccagagaggatgtggaaaaaaggcaaccctcatacactgttggttggaatgtaaattggtacaaccactatggtgaacagtttgaggtttttcaaaaactgaaaacagagctacaataaaatccagcaatctcactttcgggtatgtatctaaaagaaaggaaatcagtatatcaaagggatatttgccctcctatgtttatcacagcactgttcacaatagttaagatttggaagcaacctaagtgttcattaacagatgaaaggatggaggaaatgtggtacctctgcacagtgaagtactattcaccataaaaaagaatgagagtctgtcatttgcaacaacagggatggaactggaagtcattatgttaagtgatataagccagacacagaaagagaaactatgcatgtttttactcatttgtgagatctaaaaatctgaagaattaaactcatggacatagagaagagagaaacagtggtcaccagtggttggaatgggtcatagggtgtacagggaaggatatgcagattgttgacgggcacaaaacaaaattagaaagaatgaataagacctagtatttggtagcacatcagggggactgtagtcaataataatctaattatgcatcttaaaataactaagagtataattggattgtttgtaacacaaaagataaatgcttgagggaatgaatacccaattttccgtgatgtgattattatgcattgcatgcctgtaccacagtatctcatgtaccccataaatatatacaactactatgtatccagaaaaaataaaattgttttctaaagtttctatgttgattcaaggtagatttctcatttatagaaaagttaacttgctagtgttgagaaacagtaatgcctataaagaaactagaattagacatcaggccttaaccaagtttggaatcccacaccaagagagagttattattaatctaagtcattcatgtcattaatctaagccatctatgacaggaacagtgcttttctagggcttctacagattatgctctcatgtagaacaacacttactaactccttcaccatgcatacacagaaatgtgtagagtcctatatttacttacatgatttgtggggaaatgtggtttcttttttttagaaaaaaataagaagcgaagtattattttaccttgggaactgtattttcaacatgcaacattcaatatatattcctaaatttattttggatcatgaggctgttttaaccatgagaaaatcttaagttttacctaaaactctctacagtaattaaacctagaaatgtttatttctgctgatgaaaatatatttttatgctgaaaagaagtttgatatatttgatatgctcagaccagtaattgagtttggatcagcatattaatctttattattcaagtttctagaataactgcagctagaaatgtgtttaatgtgcttatggtaagtgattggcaacaagaattattgaaaacgtagaataaaagtagaagaaagaaaagcattgtacaatcatgcactttacaaagaagtttccttaaattaatgggccttaagaattttttctggactgaagtaggttgattgagtaatcaaattccacagactaatggaaataataaacctcctaaagcccaaccttgcaaaaaaaacccacttgagttttattggagaaaattttatagcaatgcttaatgagacggcaagcatgcatgaataattatttttacttactgttctcattaaaggaaacaatgagttatcattcttttagtcagaagtaaaaattcttcccctatcattaccattaacttgacttattttgtattttttaaaactccatttaaattcttccttgaagtgatagaagaaatagacaattttaatcagagaaaggggaaccatttttcctttggtcaaacaattatcttaagttttcaacaaaagtgttgcaaatattcagatagaaggggcagcgtttgggtaccacaattattatccttcactctggtactcattctcagacatgaaaaacctgtttataaaggcaagaaaatgttttattactgacaccaaaaggactgaaaattatcaaaaagtgaataaaacagtccctgtcctcatgggtcttaacaatgagtggttaagaaggaaagggattggatttctggatgttagtcacatccttctgagctcctgcaacataagtgacttatgccactattttcaaaatatgcacagagagacttctgcttccaggaagataaagtggatgtagctttccttatttctgccaagtacagttacaaatactatacagtgtttacaaaagaaacatacgaagtctttcaaagttgaagaacaggctgactggctagagaatttagcacagtggtgagtttccttggttttctttttgcctcagatatcccagacttggagcttaagaagcaggcaatacaggacatcaacaggtgcagacaaagaagcccgaacaagtcagccttttctagtgaaaggaccaggaaaggggcagttttgcaggacagaaaacttttagactttaataactctgctccagctaaacaccacagaaatatctgtgtccccatccccgctcatgatggctgaatgggcagggaagacttctaccttccagaggctataacaaagcaccctaacccctcaccagagctacgctatagaagagaagacaaagcaggatctggactttttatcccatgccagccacagggacagcttgcacttatgccctatctggcagtaatacggcacgcttcccactccctattcaggggttgccagaggaggactagtggacagagaggactttcacagctacccagtgataatgaggccacttccaccttggtgtggatctccgtcagttggggacctgcaaatcctcccaccccagcagtcacaagacgccctcaccatcaggtgtcaacataggctaagttggggaacctgttcttcgcctccacctggcaatcacaaggtgttctcccctttctgtaagggtacattcaaattttaaaaagaaaaaaaaaattaattttccttaatgtaaaatggaaaaagacttttcctccccctgccctttgcttagaacatttactttagaaaacctctgtgaattctttctctgccccctatgatgaatataaatctttctgaaagctaaataggcctcaggtcagtttttaaactcaggaacctttttttcccaagaacccagaagctatctttgaaatgtaatcatcaaagaagatagttcccttatctctcagcttctagagaagggtaggaacctaacttcctcagggtagttgcaatatgcctcctttttgtaaagatatgagaagtctattttcctttggataaaggcaattagtaaacgtagactgtcactctaattatcaggtaaatttaagataaactgtgtgacaaatttcaagtcctcttatttgaggattagttgtcatttatcctgaaaacatgtatgtaatggatcatacctgcctgattatacaaaagggtagaatttctttctctctttgcaatctctttagcagattgtctgtggtgggcatcacattctgatttagtgcttattcaaaaatagaactgttttctttctcttctgtctttgtggagaggttttctgaattggcagaaaattttacttttaattatatttccccaagatttcaaagaaaagcaagagtagctctattaataacaggtagaattcagagtgaaaaaaaactattacatacagggaggaatattatgtgataattaaagggtcaatccttcaagaagacatagcaatcctacatatgtatgtaccaaacaaagctgcaaattgtatacctggaattgtactctctggagaagtacatgaaagaatactgggccaagggttaggagatcttgattcttacatgttctaccactaaatagctatgtgacgttggccaatttgcttaacttccttgagcctcagtttctctattttctataaaatatgaaatatgaagatcatgcagtttaatatgttatagatattgataattttcagaagaagcacaaacatttatagtcacatttcataaaatatatttttatgttatgaaagaatatttgcagtggtctatacaaagatcattacataaatggaatgaaggttaaaaatcatagtaacacttttttttgtttgttttttgagatggactctcactctgtttctaggctggagtgcagtggtgtgatcttggctcactgcaacctctgcctcccgggttcaagtgattctcctgcctcagtctcctgagtagctgggactacaggcacgcatcactatgcctagctaatttgtgtattctttagtagagacggggttttgccatgttggccaggatggtctcaatctcttaacctcgtgatctgccccccttggcctcccaaaatgctgggattacaggtaggaaccatggttgagagaatttggcacacattatttctactctaagccaacatttgtctaaccttgagtcatgagtcatattgtaacataaaattcagttaaatgagagcaatcatatgaaaatatatagtatatttactacatataagaatagtatatatagtacaaaatatataatagtatcagaaaatattaccctataaagaactttagaaatgattttcttcaactcttactttataccaataaggaaattaaggacagagagtttgagttacacagtgagtagtaatagtacaagatgtggaaatccaggtcttctggatttaattatgcctatacagtggttatcaagctcacagccaaatcatattgtagattggccattaatttacagagtaactttaatggacagtctcaatttctctacacttaaaaaatataaacaaagaaaactagcatttggagaatataataaaggttttgtaagctatctaagtgctaaaaggtaagcaacaagtattttcagagcagttatcaaacctaaacttcctcatgtttcaatttgctaaaaaaaaaaaaatattattttcttcaataaacaggtgggaaagacaaggcagagaaaaattaatggatgttttcaaggcattatagtacatatattgattttcatgtggtattagaacagaaacacatttcttttattagagtacagtttcattaaatcttaaaagtacactgtaggatattgacaggtgcccaatgggaaagtccatcaacaagcatttattgaccacttaactctgcagggcagtgtactaaacacaatgagacctcacaaaagaaatggaaggcatgacccttgacttgtggatgttaaaaacaaaggctgctgcataccaattattttagaatttatgataatctgtcattttagatgagtgagaaagcattcttatttctttctctcaatccagaggtaaatatattcctaggtattctcagcagtaagctaaatgattcctcttgcattgtatttttgtaaccatgttttagtagtttctgtctggaaattaaatgcatgttaaatgaaaaaaagtcttttctcagatttgaatgacgaggttaagatggtaggagttaaaacctcagggtctggaaacaggctcacctggggcaaatgccattaccaccaccttaacctgcggcctggggcaacctaacttcccttcctggtctcaggtctcagtttcatttgtaaaatggggatcacaatagtctagcctcataatgagacagctaagtgtaagcgggtccccggaaaaactccaaccagcctacacactgggaaaaatgtgcacgggtggagccacagaagttcctccatttgcagcggggaagagcctggcccttcctcttcctgggtggaacctgggattcagtctgtgaagtgggaagcgtactagtcggactcttgttcaggagagagtcctttttttcccttttgcccaacaaattccatttttcctcacccttcaaggtgtctgtgagcctaatatttcatggccgtgtgacaaggacccccgtctttagctgaactaaggagaaagtcctacaacaataacataattatgtgaattaaattctattatctttaagtgcttggcatgtttcctagtacataatagttgctaggtaaaattttagtaatttttaacattaatattaacaatgctaccattattatttctaaaacttgtcagaatatatgaaagagcatttatatttaatgctatttccactgtattgttggaatatagcaatgaaatggtattaaaatggtaactaaaatgtgcacaaaggttgcccctaaccacgctctctcaactatttcttaatatacaatatcacatttttcagaaaaatagactacttttagggcacttgatttatcttcctagatgaaagatagacacatatgtatttatttcatatctggtgcaaagaatatatcatcatgacactcaatgaagaaaaatcttatagttcttagcaactgatagcttttagaggcactttaaatcccatgagaaggttcacttccatcatatccatcttttaacttatgtataaaggtgccataacatctgtccttttactgaaaaaaaaatttgcttttggctagaagataaagttttcagaaggctctcactcaaacaaccattttttaagcaaccaatagaaataccaaattttttaaaatttaacttttaagttcaggggtacatgtgcagatttgttatataggtaaaaacttgtgtcatgggggtttgttgtacagattatttcatcacccaggtattaagcccagtatgcattagttatttttcctgatcctctccctgtttccaccctccaccctacaataggccccagtgtgtgttgctcctatgtgtccatgtgttctcatcaagaaataccaaatctaatacataaatccatgtaacacctaaatttactagagttcctcatttactagagttcctttgttacttagtaaatgatacttattcctcccaattttatttcaaaatagttgtgaaaatagatttatgtacagtctcaaggaaattatgttttcctttcttctctttttacccttccttccttccttccctccctctctcgctctctctctctctttctttttggtcttaacattattcctagcacacttaaaattatttcgctatttctaggtgtatagtaacatctgtacaggtattatagtagtccccactcggaatggcttttgacttctgccctctcctctagtgattgaaatcttatcctcctgtagagaaatgctgtatcagcatggaaagacagagtcagacttgctaggcttgaaaccctgctctactatttattagctgaatatcctggggcaagtaactgaacctctctgttactttttctataaagtagggatactgttgggactttaaaaatatgatgtatgtaaagcacttagtagagtgtctagcacttgtaatgcactcaatcagccctagctattattttattattacgactattcaagatataactcacacatcaggtctcccataaaacttttactgacatgcttcagtggaataaacattcatctttgacttagcttcacatgaaattctatgatggctttccaatttttagcaagttctttaactttgcaattctatttcctgatcttgaggtaataataactaaatgtgatcatatttgcaatgtgttctctctatgagaggctaaagtgaaacttctgctgctgctcctagatacaactgcaaattcttgtgaagatttctaactatcctgtgctttgtaacttattatgtatgtcacaaaagacaaagcaatagcttttattgtggaaactacacactcttaaggcggtctgtgaatctgcagaaattgtttgcaaaacatcatgtacatgtccaaatatacacagatatatttctgagggaatgtttcagatctttgattagattctcaaagggatatatacccaaaacaaagagatatagaccaacgatttggagacagagttgtgaccacactccagcagctgaataggaattcttggcatttattttgtaagcggccctcaccccttgcttcatttttctatttttatttccttaatgctcatatttttcttcaaaagtaaaatgcatttcatcctgccaatgccaaaacatagtagctggtttcattaatgttagttcctttttttcttcttaatatgcctgacaattatatacacactgccaactattgattaattctttaagagcacatgaaggacaaatatgtccttcatgctagaccgaattccaggggacgtagaagtaagccagataggaaagttttctgctaccctcgtaggttttctttcaaatgcaatagacagacatcaaacaaataattgcattaaataacaggttaatgatataatttctgatagtgccatgaaaaaaatgaagaaagataatgtggtaagaatgatgaaaaagtaatgtctgagcaaatatgtaaaataatttaatgcagccagctatgagagtgggaaaagaacattctggacagagggtacaagcagcaaagaacaagcttgacatgcttgaaaaatagaaatgcttcattaaaataaaaacaaagtaaaagaatcttcattgttttaggctaattaaagcagtattatattcttattttagaaaatgtgaaacatacaaagaagtataaaaataaaatgtatttcaaaaaagccttttaataattttggtattttcctatatttcctcccagaaattttaaatatatgtttagcaaaggaaaaggtctaaaagatgctgctatgtacaatttttattctgcctttaaatctattgtgaggaatatcttcctggatcattaaaaatattaataaacataattgctaattgctgcatattatttcatgacacaaaagtattaacttttatgtaatcaatccccatggacttttaagttacttttagttttttttttctgacataaatgctataattattatttttatggaaatatttatgttattatctttgaacagtttattggattagatgactggaagtagaattcattttgattttaaatgtccaaatagcataaagcgtctcttagacttattcagctcagtgtagatttagtataaaacatgtttaaagagatgtttttttaacctaccattttgtctatatcagtcatgtgttcacatatttatatgtccactggcctttttaaataattcatcaagacagaagaccattccagtccgcaggagagtagtccttaaaagagaaaggactctttgtgatttaaaagatggtctttagtaaaaatagcctcccagagactcactaaaattatgactactagaagtcgctaattcagagttcagagaaaacaaacaaaccttggtttctttataattcagtaacagaaaataattccataagtaagataacattttggcaatgatggatatctcaaaatttgtacttacagctatacttgaagctaccttgatctccacctgcgtttcagcaatactctttgatccacatgcttatttattgcctttctatcttatcctagagctatttctgcccagtagaagaacaacatcaataaactacaagattttattaggtttatccaacaaatgctgatctctcctgttgggtttaatttgttggtctgttatggttgttccaatacatcatttagtgaccttttcttctgtatattctagagcccatgtaacattaatccttttatgtacttatattggagaattactgatgtgcaattgtcattcctaataattgtggtgttgttgattaacgcataaaaagcagtcacataggtaagcaaccaaagcaatacatattagaagctacagaatgacaaattttattctttgtcctctatttacttggaagaccaacctgagcaggcagtttaacctctttgctaataaatgatgaggtgtccagtttgtctttcaagtgcttattttttcttagatgacaaaagaagtgtctaatcaggttcattttaaaccacttcacaaatacaaaggctataaaaatattgaataggacttatatgttcactggagtaaaaatgcttcctgaaaaatatatttttaattaagggtcataggagaggagaaaaatctctctctcccatcctaagagaaaactacccctatgacccttctcttatttttcccaagagtgaggtctgaggaataaatgtagagctgctgaaataaaataaatacaagtcatataaaattaaattatgcacttaattgtcaatataaacatataaaaagatcactgcaaaaaaacttttctggaccctgaattattgaaaacacacacacaccccacaagattgttagaattatgctgctcttcctgtaatattatgctcaacttgggcttcttatgtatgcctcattaaaaaataccttttaaagaatttttcccagtctgttggtgattaacagatatctcaccagagagcctttacagagaggtttagaaataaatctgaattccacagctcaatgaaagctgtgaactacaacacggaacatcttttacagacattgggatattatttttacccttcttatctgtgagttctatggcttgccaaccatataccataccaaagtttatacaatgtgtataagtcatatccaagaggaattgctttttcttctgaaacctgaaagcctaggcaagcatggttctgacttttcaaatggtgcagtgaatatttcataagtcaaaaaaaaaaacattaagtttcaaggcaagaaaatcataggaggattggtcccataccaactttatttatattttgagaagatgcatatgaggttttttaattctctaatttaaaaattttaccctctccagaattagtctgtttgcatgtgtgatgcatagcagaccctgacaagaaaaggcttggttctggtgctattctgtaagtagtgttgcttatttgatctccccagtattgacaccagagtcctgactcagtctatcagttagaatgtacataatttctcttttgtttggtggtttaggaaccacagaggtgcctaaatttaggacttacccagggataaaataagaattaacctgcttaaatgaaataaaaatgtatgactatggtagaattgtgttttaattgaaaacctaatgtttttttcttcttctctttctaggaggtactggaagaagggcatggaaatagtttcctttacctcctggagagatttggcaattaatttctcccagtcgtacaaaagaagggatgttgattttacttgccgatagcttggggtctgagttggtgagccatacaaggtctatgaaggaaacagaagggaagaaggtttttgagggaagaggaagaaatacagggaagaagagagatgaagggacccagggaggagagagaatgagcaagagagagagagtcatgaaaggaaacagagaaggagcatttcctcatgttaaaaggagaccagtagaggtacactggtaggggagagtataaattgatcctgaaagcccaaaggaaattgatcaagaagggaaagactagtgagagaaaaactcagaaaggaacactaaagaaaagattatctgaaggtctggaagccaaaggataggggagtcattctgtaccagccaccagccctgattagagcaggatcctccctttcctacttccaaagccttggtcagttgagcctctcctcttgcaccagcaactaacatctcatagattgaccacccggcaaaaatgaagactatttattccacaattttgttttcaggatgtcagcaatattgtgccccatggacaacccatttttaagataccctgtttgcctataagagcaagaatgagcaatgggctcatctgtactgagatggaatggacctgacttgaaaaaaacttcaggatccataaattcagaaattatatcgtgataaccccaacaaataataaatatgtcagttgtcctatgcataaccatatatacaaaggatactatactactcaaagtggacaaatgatgacttgtaatttttttttttttttttacttgggaaacttttaggttgaactgccaagagaactaatgcttcactcttgaaaacttctctataccacctgctaaagcttttctatgttccatgttgctccaaactctattctgatgtgtttcgtaatggtcgctttgacttcaaacttttaattctaacttcagagatatcttaggatccttccctaagatacctagatccactttaagaacagtgccttagtcactgtttaacatgaatattcagtcttgtgagacagactcttaaatgctttgtcattactcgtagttacattccctcacatcagggtgtggcctgacagaggcacacaggtttagatcttggtggtagaaacacatattcaaacaaatttgcaccagagagtcctacgtatgtagcaagctttatacctagaattatacctatacctgtacatcaaaccagctctgagacagatgagtttatttcttgagtttctcacctctaatgagtttcttacctctgaaaataaataatgccttaccttagggtagcttcttcctttagtctcatatgacactttctctgcaatgtggttgatgctggggttttataaatcaactggatattcagtgatacgagcattccgtgaatgctatctgagcagaatttagtaacctgctgtggcatcatcaacaatctttgtgtcaccatcagaaatcttggtctgtgtgcttaaagatttaatgtacccgtataagatacaagtaggatacatgtaaatcatacatctagataacctgaaactgactattccttaattgccattattttttactgcttaattactgtgtagttctggaactatatgagattaaattattatgtaaaaaataattttatacaattcaatccctataacatggtaattttaaaataggaattatgttttattaaaatgataagcataacaaggaaagtcctctatattatgtaaagatgcagaattagagaattaaaaaatatctaaattagaagggactttaaaatctttaggcaaagataaatcccagcttactctttttgcagccatgcttaaattcagccaggaatagtaacatcacaagtttttaaagacactcgtgacatttccattgtattcaaaacaatatttgaactgttaccatctatccttgggttgagatccaacactactgctttgctacataggagacttttatgcacaaaatctcactatagtcaaatctcaaaacaaacaaataaaaaataaatttggcacgtagtcctttctatactcctaataagatacctttagatttgaaactttaaaatgaaactaaagagttgtcttttattccttgctaagtgacaaatacccctagagacagaggtgtacattcctataattctttgagaaaaaaaatccaccttaatttaagatgacaacatattattcaagaagagaaccatgcaattgcccagtgaaggtaattatagactgcaatatagaaaattaatatctgctaagcaattgagaatttcatatgttaagctgtcataacagtgggttttgttataagatattgtaaatgaatggacaaactttggacttggtgttaaaaggtcataaattaattttctaatttggcaaccatcttgctggtgactaaggacaaggcacgtaattactttcctccatcatctattgaaatatgaacactctcagattttaaaaagacagtttgaattatatattaaataagtcaatttgtgttaatacacgaagtacagattagaaaacaaaatattcacctgcacatgatctatgtaaaatcttccttttagggttatgtaatctttttgtgcatgctttttttaaatttcttttttccttaaaatggatgttgtaatggtacttacttgtttgagttgttatgagaaataattaagacgatgcttataaatcacttagcaaagtacttgacacctactagtccttactgaatattacttttttttttgtctatgcttatgtagttctattggttccaaaacaaactgcagagttaaaaattacaaaagatctattatagcttcaatgacacagagaagagaaatgagtcagaatggacatccaaattgaatttgaatcaacaatttccagctggtattttaaaatagaaagaaagaaacaaatggacaaaaaagccagattagtggggtattcttcaacacataacatataaagacaggatatagaaaggcaagtactaatgcctctattctattatcagtggtaaattctttattggattttgaatcagtttaagttaacacagtatatgtgagaaaactgaactgcgttcagaagaaaacattgtaagaaattaaaatatataagaagaaattttaaaacaatgtagagcttaagagtttacatgtgaatgttaaaagaatctagattttttgatgtatagagaattgaaggataagttactaagttcttatatataggggattttccaactattctctatttctttagaacacaaaattgaaggccatgaacttcaattttcagtaagagacatctcctgggagtaagagcaactaagccttgataaagcaaatggtagactaactgtattgactgtgtaacaagtaagtttgtactctaaacttagaagcttacaacacacacatttattccctattatttcacagttcctgtgggttaggagtctaagcatatagcctagctgggttcccgtctcctaaggcttaaattaaggtgttggctagaggtacaaccccctgttatcttgcagtcctcttcctggttattggcagaatttagtttcttgccactgtgaggaccgagacccattcctggccagatggccctctccacaccatggcaatttgcttctcaaaggccaacaggaaggagtctcctgcaacttcttgtctctttcctctagatcctctttgaaatggttcatttggttagttaaggccaaatgattttaattcatcttttgattaattcaaaatcaactgattaaagaccctaattacacctgtgcaattactccactctttccacaccacataacaaaataatggctgtaatattctatgatattcacaggtaccactcacactaaagaagagaggtttatgcaggacgtgtacatgagaaagcaggacttttggagaccatcctggaattctgcctatcatcctatctcaagatttgcctatctgacctaaaataatatcactttctatttaattattgggtttatccccaaatatgagataggttaaaatctcatttatttctctcaaaagtatttacagaacattttctcatgtgccaccccgcatggaggagtcatagccacgtatgtagtgtggttgaagcaatgccatgtgaccacagctgcttaaaaatatcttccctggtttgcaatgaaacctggcattagcttcaacttactctgtggcatttagctttagaaatgtacccaattcttaatgaacagattaatcagttggctaagatgggttaaaaaggagtaattcaaattcaaagttgatatcactcttttataggcattttcagtatgactggattgacattgcaagcgtctatatatgtatgtctcctacggtaatgaatattacttttatgattattatttgttacttaaaatgacctacaatggatgaaactctttctaatagtgaggatagttttcaagatataccacgagctctcattacagttctgctgtgaagtaaaaaaaaagacgaaaaaatctgtagccatcaaatcatctttgtaataaaatataaagctaaaatggctcatttggatatttaaactttatatttacatagatgtcatttatgattgattttgaacagcacagcttttctataaagtctcatatttttcgctacgccctctattaaacagaactgccaaatagtgacaatggtttaaatggtaaaaccataaataacgtaggttccaggaaaaaagggggtacaattgatctgtctattctaattaggggtactaatttaatacaaaggtatctgtacataaaaatattatctcttaataaaagaaatacaatggctttaaaacgcattattttttaacttaatataaatccataaaggcaaactgaactgtaaaagtcatctattacaatatttcattcaaggcttgagtcatttctgaaatattcctgttagctagtcattcagcccatgtttgcatgtcatcggtgactggaaactcaccacttcccgaatcatctcacactgaagttaggcaacagggcatgctatggaaaagcatgggttttgggaatgggacacactggatttgtattctagctcggccacacacactgagtacctttagtaagaacagtggtacagctcttcatctataaaatgtgagtgataatctcttcctgtgatagtttcatgtgtcaaattggctaggctagttattacttaaacactagtctaaatggtattgtaaaggtattttacatatgtggttaacaactactgtccttgactttaagaagagtgccctcacaatgtgggtgggacttgtctaatcagtctgaaggccttaagagcaaaaattgaggtttcctagagaagaagaaattctgcctcaaggctgcagcatcaactcctgctaagtttccagcctgatggcctgacctacagatttaaaactcaagatgacaatatcaaatcctggcaaagtttccagcctgccaggctgccctacaggctttgaattaccagccccacaattgtaagagctaattccttaaaacaaatatcttcatatatgtgtatatacacaacaacacaacacacacacacacacacgcacacactcatatatcttactggttttgtttccctggacaaccctgatggatacatcacctcttctgaggataaaaaggcacatcactcacagggatacctcttctgagtataaaaaggataaatctgactcccccatagctcctttctaaatgttgtctggaaattatcttcctatagcccctcctgttagtcagaattctaatactgtgaatgtaatacatgattctaaactagatttggtacctgtgctgtaaattatatgatagggacagtggacaaatttcaaaatggattgtagattagataaaagtagaatagatacaatttaataaatgtactgtatttatgtaagaagatatttttgcttttaggaaatatacattaaagtattaaagagtaaaggggcatgacacatgcaacttctcaaatggagctgaaaaaagatgttctaacttgagaaatttaaagcaaatatgataaaatgttacaaactggtgattctggataaaggggatacaggaattctttgtactattcttgaaacttttctgtatgtttaaatttatttctaacacaatgttttaaaaatggcaaaagaaaatgacataaatgggcccaaacaaaagtagaggtcttattaccacctttctgaaagcacctgacctgacttgctgtatgctttggttaggtttaaaggctcataaacataaacatgcctgctccttataccctgtcacattcaaagagacacattcaaagtggggaccagaatctgagatgataaggatggagtctgaagatacagaaacacctagtaattttttcatcacggaatgatttgaatgatttaatattagtttttaaaatggatgttatctaaaaacatttaaactaagtatgccttttctttaatatactcactatgcatcatttcaagatgcttccgaagttctaccttgctaaagctttctctttagtgaaatgagacacaaagataacccaaaagatccccatttgatgaagtacccccagaggtccatttactttgggatattgtaaggaagttgtcatccaaatgtagcacattacttgaatagtataatgtttcacaaagaaagaacttcactcagaggattcttataagaaagttacaattttcaagtgagcttttctgccatcttctctgatgcaactaattgtgaccctctaatggacaaaggccacttaaatcctgctctctgtttccagggcaaacccagaatttcccagatttctctctccaaattccatttcctagaaagcatacatttgcttagacaccctacaatttcaaatcagttaacagaaaattgacaagagaagaatttgccttctttcttttctgtctcagagttcttctctttggttatctctttggttacctgtggattatctcatttttttcctaatatcgaatgccatccttgatatttggacatcctaatgcagaggcagttaaaccagaaaggcaaaacctaaattgggttaatattcttgctctgtgcctcttcagaaaatacagagacttaggtaagaatgtttgttactgctggcgaatcttctcccatttcagccactcctggtcccttgtgccctgagtaagctatgaccagtattaatgcccatgtcaaggtagcatgtacatcattattccacatcacaggacaatcgtggacatctgaacataatacactagctgtgccccgctgtacatctatcttgggcaaacctgtcaccaaagtacagaggaaaagttaaagaactttgttactcatggttccagggtgcagggagaaactaaagaatgaattcttcttccatgtttccagacagtgcaataatgccctgtttgtgtaggccgaggaggatgagcaagaaaacgttacctttgtaactatgtctttcctgctatagcaatgcagttttgagattgtgtgattatttcaggattaaaatactccagaacaatgtctctcattttgtgttgttgttgttgttcttgttaaagtgtttaaatccattacaataccaccatttttttttctgtcattcacctctgaaatcttttccagtctttatttaattatcttacacatagctgccaaattcaactttcctcacttattcctttgcttagggcaaaacaaaacgcaataaaataaacttctaatcacaaacattcacacccagaatgaatttcaaactattttatctgggttgtagttttctctggaatttgctacagctacccgtctagtaacattcctcctgtactttcatattcactttccacctcgttcctgacatgtattgccctctacacatcattctgtggttttccacttcggtgcctttgctgctaccaatctgtagcctgcatgtcaccttaatcttcacctgacaaaatcccaccaatcctgagcccagcttcaactcaatgtttcctcttttatgaacccttcatgaacaccacaaatggactttcttcgtacgccaaatttctagagtagttcctatatggctacatgatcccctactcctggaggtcccagtttccttccagggcatggagcctagcacagcatctaacagcaggagctccagactcaaatcaaccaagttcaattcttggctcctccatttcttggctcaggacatgagaaagctacatattaatctctcggagccttagttttctcatcgataaaatggggattttaattggtatcgattcatagacaaggattaaattagtttctattatgagaaagtactcagaataatgccttacaacatagtatccactatttaaaggtcaatatcagagttatttgtgcatacatacatccacacagccacacacacaaacacataattctttgcatataggcactttaaaaatgtaggtcaggcaaatatcaaataaaactaggtagcttttgaagatgtgctcttgattttctgtagccattcctctaatgcgctgatgaatctgggtaaactaatctttgagaggatgatgtctggttaacaaattctttggctaaagatagatgcaattttgaactagattagaagagtaccacagtctgtgatggtatctgaagtaaggaatagaaaagcttataaggcagacactcagggtcatgcagaagaacctggtgaacctagaacagagtttccatgacacaacaaagaagataaaacaccaccatccaggttttcaggtaattgcatttattgattcaggtggtctcataagaaagtcaattggtaggaaactagaggtcttacattttattcttgaccctgtcaatgagtccatttgagtataagacaatttctaaaactacagtgataatttttcctgtatgtttttctgatttgtaaaatgatttatatcaaattacatgagtataaaattaaatcacattattatgcttttcatcaattgcctttaccaaaagaattaaaagtacatgaggtcaggactacataaccactgaataaatatttttctgtctattaaactagaacatgctgtagacaacacaatgtctttattagacagtacaccgcagtatttggaaaagcaattagtagattactttattcttcagttgagtgtcatctaaatggaggaataaattttttaaatccacagtttggtatacaagtcttgagagatttttctctgctggcctttctaatctcatctactcactttggcagtggtcatactgaagaattcacatttctcagaatgcatgctgttcttcctggactccctctctgcacatgcataacctctttttctctcctcttatagcaaactcttacacatccttcaagttccagttcagaactatcaccttctccctttttctagatttttgtgagcagagttaaacatgtccatttcttgtgtttccataatgtcttaattatacctctattttcctactactgtaattacttatatacacatctgcctcttgatttaactgataggtcccagaggactgagatatggattgattcatctctaggtccattgtttccagtacaaaataggtcttcaataaatatgatttcagtgagtgcctaaatgaacttctgtcatttttctaaagggaacattaagttttctgtctatataaatttcctatagattgaatacatctcatctttatataaactaaatctgttttaattttcacttaaatgtcacattataaacgataacacaaatttccatttctacttttgaggacactttcttctttcattctaaattctccctaaaattactcagaggttttatggacagagtagcatttctcaagctttatactatgaccttaagtttcacagcaaggcaaacttttctaaacttcaggaatggcttttgaatcaataatttcccccaccaaatgttctctgctaatcaaaaagtattcccacatccaccacaaaagactttgctagattatttccttttccccaatttcatcagcgtagccattcatccattcatccaaccattcatgagtctatgcattcatgtagccaacaattgctacttaagtactgattgtctaacaggcactgaactcagggctggagatctaaagatgacaaaggtagaggacttgccctcacagagcacatagtccacagaagacaggaaggtcaataacagcaaccacaacaaataataatgcaatgagttaagtgccactagagaaatgtgcaaggtgcaatggataaaatccaggcaggaaagcagggattctcagatagtttgtaaataaaaatctgaaattacttcaaatgccatacctttaaggttctgaagataccctggcactaccccagatcatccttttcactgagttcggcaaagtgacagaaacaatgtcctaccctctttacggtatctctcagttgttctcaattattgtcgggaagcattttatttgaataccaaagagccctttccccttcagtcagcctgtggggtgatagaaatatgggagctgagcctatcagtgcttgtatcaagcagttgaaaaacttgtagcccatgagtcatggctcttttcatgtgtttccagatcagtgggaggaggcctttggctggcagcactagcaatctagcacctatgatgaccacccggggaaagaaagacactaaagccaccaggagagctatactgtcttcccacctccctaaagtatgcatatccccaatgcgaccaccaggccatgcctcaaaatagtgtgagagccaaaacccacattttcaaaataaggaacaaataaattaagctcctaccagccacctcccttatgtgcagctaaggaaaatcaaatgaaataaacaagcaaattagcagctggtatatgagctgcagatcacgactgaatatgttttgaaggctctgccaactagttcttcctgaatcgaatttgtgcttgttgggaaaatagtaattagtaatcatactactaatattaatatctaatatctattgaaagcttactgtgtaccaaacatcatgcttacaatttacaggcatatcctgtttaagtgttacaaaactcatgagtttcttctataatccagactctacagatgaggacttgagattcagagagactaaatcatttgccaaagtttactcaaacagtgggtggctgagcagagcctatgtctattaacatcttcagcctattactcttaaaatactttcctaacaataaaggaaaatagtaatataggatcatcagaagcatgagcattctttcctatcatcagttattaagcaacccatacattcctgtgatgttcttggaattcaagaacatagtcctcttgatctagagttatttcccccttgctctgtatttataagaaaaaagtaaaaaaaaaaaacacaaaaaacttagaactttgtaatttaatcacagtgtagaaaataattgttttattgtttctaatttgtataggcaatgttttagtcaaattactacctttacatatattcacttataaatgactttttcccactaagacattagctttaaattagttaacataatttagaaagacttccatatttacagaggacaaatattttcactgtctctactacacaatctaaaggatgcccagtgaaaacatacagagctttgtaaataattaagaagtaaaaaaactaagcattttccatgtaacaagcattactctttctcagaaataacatagaatttgtaaatggcacatgatagaataacttcaaaatattaaactaaagacacctggacataaagtgatttaagtagcttctaccattttcaaatctgaattggaaatctaccaagaatcagccttctaagatgacaatggtttccactgggccaataaatagaccaaggaaaagccttcatgtggtattctgaatggtgaagaaggaagtcaaacgtggctgtacccactgcgatgccttaagtatttgagggaattagaaaggacaaagacatctccaaaaatagcctccaaagctttcttactcaaagtgtacagtttggttagcatcatttctgtgacctaggaatttgttagaaaatagaaaaacagtccttatctcaggccttctgaattagaatctgcactgtaacagaatgcccaagtgatttctaagcacattgaggtttgaataccatgtctccaaaacacctcatcggaatctgttgtaaatgcttgccaagcagcaagggctgatgccagcttaaaacaattccagtcaactaagacctttcctgcatccttacttcttccccatgtcatccactcaccattttcatggctgcagccttaatacaagctacccccatctttaatatgggctattttagtaaccttctaactgttctctcccctttgcctactgaccccatgctgtccacactccacatagcagccagaggaaccctgacaacagggagaacagatcgtgttcctcttacgccaaaaatacttcaggggcctccctttgcacttagcataaaatcaagtatcaaagcacagcctatgaactctagctgaacctttgtctcacatgtctctttctcttgttccttcttctccttgaacatgctgagcttattcctgcttcagagcatttgcagctgctaaatctcccatatcgtcacatggctttctccttctcaacagtcaggtttcaacttgaatatcgcctcctgaaagatacctccctaaagactctcttccatgtttccctgaaattactttgttaactcaatttacaaatcattagatattttatttgaatagattgtgttaaacaaacaaaattgcctttaatattgcctttcttccttttttaattccctttattctttttctccctacttctgcccttgaacctcaacttcaacaaactacaaggcttataaaaacaactttcacaagaattgttctgacagtcattgcagtggtattggcccagtaatcatgagcagaggactaacaacaaaaacaatctcctacctcaccaccagcaagttttacagcagccaatgaggaaaattactaactgaaccaatctccaaggacaggtacccccatcttctcctcaccctataaaatcccacccctgctttaacttggagagttacccagtcttcaggtgctcccagtgcacatcagctgaataaagctcccagctcattttgagtcacttaaattattaccttttgaccttatgtattttttagttccctctattagaatgtaagctccatatatacttaggacaatgcttctcccataggttttcaataaatatctgtgggctgatttgtttttaaaaagaaaaccacatagttcctcatatccaacataattatttcttgcgtattgtataagctgaccacacggccccttgttccttagaagagattctttattttatacccaagagttatcttgttattgaatgcagcctcaataaataaagttacttattgtcctatttacactggttttatggctgtagtatccaccaaatcctgccaatggcaaaagcaaagtggtccttctgtaaagacaaatggaatagagctaaaatttactgatacttcaaaaagaaagccacggaaactctctggaagctttcactcagggaaaatggtcccttagtattttggtaaccaaatagtagtgagcattattcccaaagtccgaaaatgcccaggaaagctatgtggcaggtcatggaggactggtgaaagaaaattccaagctaccaaccaggggaaggagaaccctagcttgaattctgccatgcaacttttatccattttgtgtttgcttactatttcatctgattaatgcttctatcagaggatattgggattgttacgactttgggcaactaatggtcccataaaatccagggaagaaaagaaatacaaacagtaaaaccaagacttaagcccttagcagtagctgtacctaaatgagtgattctggtatctttattcagagagtaaatctgaagaaaaccttgtaatcttcagacatgtcagtctatcaaaggccagatactagggctacaactaatttccatagcaaatttaccagacacagcaatattcccctgcctagagagcaatggacaaaagaggaactcccctttcctccagatagaaagccacatataatggcacagactgagcagggacagacttaagagaccattatatcaaccagaagaagagaagatggggagaattggatatatttgagagctaaaatggagttataattaatatttactgtagatgatgacatctatggacatattttttgaataattgctactgtattacctcagtaacctaagcacacaaaactaattctaaccatatcaaaataatgtttcctggtgacaaatttattcctaatcattctctcctctcttttaacactataccttatacaaacctctattctattattccaagacccatttctgatagtaattttaaaaaagtaacccaggtccacttatgagcacatatttttttgcttctggaaatttaaaatgcatggctaatgtttgggttaaactgacatcaagatatatttgatagcatattctaattttctcactgaattcataaataacttggaaattcccctcattttaaattaggagaaaactacatcatgcataatgctatctgaactgtgaaaattgaagattttctttcatttaccttttaaaattagatttatctatcaattatttcaaccctccaagacaaattcacacacagtttcagtagaatgttatttctttgtaggctattcttgctaaaccaaactgattcataagataaagtgtggctaaataagttccacatagacaagtcagaagtggcagcagaatagcttgctttttcctaaatgactccttttaccaacaccccacacgatagggtgcttctttcttccaaccaacttcaggaacaagatatcccagttactactggtaccttttctcagggtgggtcatcacaaaagtagctatgccattggctattctcacatgtattcaaagcagctttagcacaatctctaaaactaattaagttaggtgctcacaagtatttagaaagttcctcctcattcagcagtagagtaagcctttattgatttcctgtcagtatgagtatcttcacctccgtcttaagtcatgtctgtttctagttcagaatgctggtcttgtctactctaaagtccatttttgttttgttttgttttgggacagagtctcactctgtcgcccaggctggagtgcagtggcgctatcttggctcactgcaagctccgtctcctgggttcacgccattctcctgcctcagcctcccgagtagctgggactacaggcacccgccaccacgcttggctaattttttgtattttttttttagtagagatggggttttaccgtgttagccaggatggtctcgacctcctgacctcatgatccgcctaccttggcctcccaaagtgctgggattacaggcgtgagccaccacacccggccctaaagtctattttctaagtataccaagtcaaacctaatcactctaccctcttcacagccttttaaatcccagcctcatcagtcttcaactcaaagacttcttttgctggcctcatcctcctttatacaacctatatcctttctacctttttaacactcttaactcttacactcctcctataggtcactgagagcacaagaaggtgtcttctgtcaaagaactaggcatattatctcttacagccttaacatggtgaggcaaaacacttaagtatatgcagtgttaaactatcctaaggcactataaaaaacaaagttgaaaattcaaagtcaacatgttcaagaactaccaggtaatgtgaatatcatgtaagaaactaatttcaagaagttagagatcgacctttaatgttttttctatctttatgtaatagggaatcataattattttacccaaggaaataaaacaatgaagggaacattcaagcttgacctgatcctgttgtgatcagagaatcaagtagagcaaaattagaaaagtagtggtctgtgaaaccacaatcatttgatctggagttctggctcaacccttaatatgtcactttgggtcagttacttaacctctctgagctttaattttgatttatacaaaattaacataatagtacttacctcagagagcttttgaagatgaaagataaaatatgcaaagtacccactgcttggctatgagtcaaggggatttgactatctaagaatttctgaaatcttcatatcaggagccttgtacgttttgatttctgagatgatgatgctataggcttctttaattttggcctggcttcatttctaaaccagtttctcaccatcctctcttcatgtacacagagcaacagtcagtcaaaatgctatgcacacgttgcctcccatatggaccacacatatttttttctttgtcttctctcatctttatctttcagtaccatccttccctcatctattcttattaatctaaatctagttaagaaactttccttcattactccatgtctcagttacctcattttcctagaaatatctattaggtatgtaacctgtcacttgctaacatgccctgctgagtcttgctccaggtattctgatgtatcaacaaagtcagcatggactaaaaaatatgtctgtctgccaccatactcttctgatctcccttccatctgttggaaaagtctttgttggataatactgatatttcagttaggtacagttacatccactggatgcttctccctcttcataatatctgtgattgtttcagaaactacttctcgcatattatattatctagtgattaactgcaccctccagttcccaaaactgggcaatattcctgagctacagggggataaaatgcatctatccctttttgttcttttatattaaaagacaaactctttatgtctaataccttttagatggatgatatctcgttaatattaatattaaagagttttatgtaacatttccttctctcttcctaagattctgatatgagtcagtagtgaaaggaggtgccatgttgggggcaaattcaagctgctcatcccctctaatgttcaaggcttagttattgggtcatgtttatctaccagttctctcatttacacactcaaacttcattttattttgctttgctttgttgcactttgtgatactgcatttttatacattgaaggttagtggtaaccctgtattgagcaagtttattggtgccatttttccagcagtatgcccttgcattgtgtctctgtgtcctactttggtaattctggcaatatatcaaatattttcattgttaatatatctgtaacagtgatctgtgatcgatgctttattatgttactattataattgttttggggtgacacaaatcgtacccacataggaggcaaacttaaccgataaatgtatgtgttctgactgctccattgactagcagttccttatctttccccctctcctagggcctccctattccctgagacacaatcatattgaaattaggccaattagtaactctatactgccctttaactgttcaaattaaatgaagaactgcacatctctcactttaaattaaaaactagaaatgggccgggtgcagtagctcatgactgtaatcccagcactctgggaggctgaggtgggcaggtcacctgaggtcaggagtttgagaccagcctggccaacatggtgaaaccctgtctctactaaaaacacacacaaaaaattagctgggtgtggtggcaggcacctgtaatcccagctacttgggaggctaaggcaggagactcacttgaacccaggaggtggaggttggagtttgtagttagcctagatggtgccacgcactccagcctgggcaataagagtgaaactccatctcaaaaaacaaaacaaaacaaaacaaaaaaaaaaaacaaaaaaaaaaacaactagaaatgatcgagcttagtgagaaaggtatgtggaaagtccagacgggctgaaagctgggcctcttaaccaaacagttagccaagttgtgaatgcaaatgaaagttcttgaagaaaattaaaagtgctactccagtgaacccaaaaattgtaagaaagcaaaacagacttattgttgatatggagaaaattgtagtggtctggatagaagatcaaaccagacacaagattccattaagccaaagcctaatccagagcaagaccctgactcactttaattctatcaaggtaagaaagctgcaggaaaaaaaagttgaacactagcagaggctggctcatgaagcttaacaaaagctgtctctataacacaaaagtgcaagatgaagcagcaagggctaatgtagaggctgcagcaagttatttagaagatctagttaagatcattgacagagataattacaccaaacaatagattttcaatttagatgaaatggccttattttggaagaaggtgccatctaggattttcatagctagagaggaatgtctggctacaaagcctcaaaggacatgctgatcctcttgttaggggctaatgcagctggtgactttaagttgaagccaatgctcctttaccatttcaaaaatcctagggcccttaagaaatatgttaaatctactctgcctctgtgaacaaaacaacaaagcctggatgacagcatatctatttacatcatggtttacagactattttaagcccattgttgagacctactgctcagaaagaaagattccttacaaaatattactgttcagtggcaagtcaaatagtcatccaagagctctgatagagatttacaagaataatgttgttttcatgcctattaacacaacattcattctgcagcccatgaatcaaggagtagttttgacttttaggttttattatttaagaaatatattttgtaaggctatagctccatagatagtgattcctctgatggttatgaacaaggtaaattgaaaacctcctggaaaagattcaccattctagatgtcataaagaacattcattattcacaggaagaggtcaaaataacaaccctaacaagagtttggaagaagctgattccagttctcatggatgactttgaaaggttacaggcttcggtagagaaagtaactacaaatgaggtagaaatagcaagagaattagaagtaaaggtagatcctgaagatgtgactaaattgctacaatctcatgatcaaacctgaatggatgagaagttgcttcttatggataagcaaagaaaatggtttcttgagataaaatctactcttggtgaacatgctgtgaacattggtgaaatgacaacagaagatttagaatattaaataaacttatttgataaagcagtagcaatgtttgagagaatggattccaattctgaaagaaattctattgtgggtaaaatgctaccatacagcattgcatgatacagagaaatcttttatgaaaagaagtatcaattgatgtggcaaagttaattgttttcttatttctaaaaattgccacagccacttcaaccttctgatctcatcactctgatcagtcagcagccatccacatcaaggcaaaccccccaccagcaaaaatattgtgatttgttgaaggatcacatgaaggttagcattctttagcttatttttaattaagatatgtacattgtttttagacatcatgttactgtacacttaataaactacagtatagtataaatataattttgtatgcactaggaagccaaaaatttcatgtgacttgctttactggggtggtctggaaccaaatcctcaatatctgcaaggtatgtttgtattgtattctcccaggaggtatgccagcccttcaaaactgtaaactctggcacccacccacccacaaagagcctaaagtttttccagatatgatctccagaatgaatctagcttagaaacagttttagaatacaccatattcatataatttatggtgttccttttagttatttatttcatcattttataatttagtcttttatgtgtttttattttgtctctgcacctagaaagtaagttatcttaggacagtcgaaggagtatggcaggccctgagaaacaaagcacagtgttataagatggcagatatttataactatcttctgactgattttttgagagaatgctaaatggagtgatggaattgcagaatcatttaaagatgtggatgaaaggcaaagaatgggcatttgaaaatgatgcaaaagtagtgtgcggaaaaattacatttatgaattcagcaaaaatttttgagagagctaataagtgttcaacactttattaggcactggattacattgtaagtaagatacataagagtccacaaggagctctcagtccaacaagagagctaaatatgttcaaaagtacaatttattgctttaaaaattataacaaacctaaactcagggtaatatgggaatacaaacatgaaaagaaattgaagaatgttagggagaagtttgtgaatttaagatcttacaaataaacactaggaactaatagtagttattaacatttcaaatatctatgaagttattggatcatatgaagatcatctttgtgtgatttcctttaggtatagctacttcctagtgtgttccatttaagacaatgtccttttactcttcctcagtgtagaagatttggggtagaggtaaaacatctggaagttgtgtggatatcagtatactctgaatggttggttatgcatttcagacaggtcctgttgatccagtagtaagtactcatggtactgttacccatttcagtgatagtgccatagactgaataaggaaagaactgagttgctctcccagcatgaggcaagcttcgtaagtgcaatgtaccaatccagtgcctagtcttctgcaaaaagttttctatcaaactgatgcttctctgggtagtcagacttcgaattgactaagactagcatattaaagcccagtgattattttcttatgtagcaacaaccctaacacctgtttgttttcacattatgaacagtaacagaagcaatctaatatttattatgatcatttgtaacagtcttttaaaaaactttctttcaaatataagaacatctggtcagatatgcaaactttgaaaattagctgctttaatttctttttaaacacagggagagttactggaaaagaaggtaaggtgaatgcagatgcatgtacagacagggtgaaatgtgtagacccctaaagcacactgtaaatgtcgctctctgctagcaggaagataactttatttttttaaaaattaataaaatgtgtaatttgggaatactggcaaagaaactacttccaatattttaatgtagtattcaaatttgaattttcagtgtaattcatttctaaagtaataaagaggagaaagaagttgcatatcattttcttttaaccattaaatgccccagttaactattaagacccacttccattgaaataaattcatatgcatattcattattttatcaattaaaaaatttacatatatatatatacacacacacacacatataaggggatataacgggactattaggtactaggcatttaaaaaactgaatgatcaacatctaccatttgccagtcactgttttaggaatgaagaatgctacagtaaaggggaaaaattaacagtgcctgaccttaagatgtttatatagtctagtggggaagagaaatagagatgtggatagcagctcatacaaggataggtgatatcacaaatacactatgttactgattgaatcacactgtcctaaggctaatctggcagatagtttacatccacttctatagaatctggcattatgtgattctgatttgtgacagacttgtttctagactaaagctgcaaatgccttcttagtatattctaaaactagtgaccggatttctgcatgtggaaatgcttgcttgaacctgtacctgtttccaaacaggaaacaatattccacatggtaaaggcaagctgaatctgctattgatctttataacacaaacattgggggaacttcaatgtccagtcacggagttccttaaattatgcccctgaataaatctcacaaagcatgccagatgtagaggccagatgcagacttacctgggtggaatttgattagacttgggaagtagaaagatactaaatgcaattacgttctgattcattagagaccaaagtttaaaatagtcaagttatttccaggatacaaatctttcaatattaaatgcatcatgttgactagaatgagttatgggacacagctcacaagggtgtcccaatgataagtgtgagacactgatacaatgataagtgagggtgagacaatgataagtaatggtgagacaatgataagtaatgagtgaatgatgtgcagaatttaggacaaatgagatcaaactgtagtttaccatctctttcaggatagtttttttttttttggaagtcctccaaatcatgtatttcagaaggttctggtttaagaattctatttgatgaaagatcagatgtagaaaacactgccctttctgctagtgaagtatgttttcattctgctgcaagttcatgccaggagaaaatattatttttcaaataaaaagtatcataagttatcttagaccctgtactaggctataataactgtgctcttttggcttacatcaaatcagagttgataatcaattttgcatcaactatgccctggagatgttcaggaatcgggtgggagactttctaggaggtatgggtttgagaaattctacaagtcggaattcttggctaggaaattatttgatgtctctttcagtgcttcagatttgctagtaaccagctctaaaaatttatatgcaaagaatttacttttagttcttctatatccatagcaatatatatcatttccaatatttgtactgtaagtcccagtaactgacagaatgtactaattattcaagaaaggagtaagcccctgtggcaggtaaacctaaactctttctgtttcagtccatactcaggaacagtccttatcataaattaacatacttgcaaaatgtatttggctacaaagccctttgtagatggaacacatacctccagaccagtggtccacagaacacacgctagaaaacaatccattcaatcactctggtacttagagaaagaaaaatcctatttagatgaacactaaagtattattcaaataacttttaacttggccctttaggtaattcttcaataagtaatgggtatatacatttacgtacaaaattatgccaagaattatacacgaagtgtgtccataggtgttttgttctttgatgaaaaggaaaaccagatgattgttgacattatcatcagcaaacacttgtttagaatcaggcctgtaatatcactagtagcaatggggcttccataaaaagaaatactaaggattttaagtcctaagctgctttcaaattcatggaaaggcaaaatatacacacagaacaaaaagtaaattatacaatatcatagaaatgtattttatagtagagcaaatagcacacatgtataatggcatagggattggattattaattttagaaaatgaaaaccaggttaatattatgaaaactcacagatttcaaaaagaggatactttgggagaaaaactcacacatgtattagctgtgtgagcttagtaaattacattcctttctatgtctcagcttcttcatcttgaacatatttacaaccatgtctacatttcagagtacacatacctttgtataaaatacctgtattaaggctgttatttaatttagggtagttattattattattattttattgctattgtcatgttagatttaatagaaagatacatgatatattcaggtactggttacttttccttacctatttctgaagaagagactttatgaagattgtctgtcttcagcagtatgttaatttcatgctaaactttatccttagaatgagtatattatttataatacaatgttccatttgctcactcagggatttcctagccactcagttcaaacctcttgcaaatattttatcaaatcgttagcctctggcatgactctgcttggctttcaatcaactccatagtctactgtaacagtgctactttcccaactgcagtacatccctgaatctctttcccttccaatgtctgcttcctctgcacctcactgaggggaaaagtgagctgctgagagaagatgagcagctttccagtcctcctttgtttcagatgccgactttgctgatgttgggtgaactcacttcctcccactgtagttttcccatttacactctctttctttacacctcagattagattgatcttgtgatgtagattctgcactcactgagaagactggaccaacccaaaaccaatagtttacaaagcattagctagaaactcttgggattgtctgtgtttatcccatttcttctcctaatatggttttagatggcatgttgtagatgaatgctgtcagttatttcataagtattattttatcatgttaaatacagttttaattctaacttttctttcaaaattaatgacagtctttttaataaaatacatgtaataaaaaaaggttaaaggcataattatagatacggctagattaatgtcagggattcccaaagaccgtttctatgagtgtacttcaaggtagtatctcaaattagagaattatgtcaacagagaaggattatttgtttgctactgtaaagatatatgttaacatttcatttagttgcttttaatgcattttatgatccaaaagactattatttgatagaaaaaccattctggtaatctatggctgtaaagaaaatgctgtttacctcaaggcaccaatatgatatgaactatatattagattattaaggagagtattacctcaaagtcaaaacctgaccataactcatagaactgccactactgtaagatggaaattgttgatagaaatgcactagacaaagatatcttcaaagagcctgaagaagaacaatgtttataaaagcaaataatagtaaccactaccacaacaaaacacttattgagtgtttatgaggtgtcaggcattgtgctaagcactggccttggattatctcacttacctctggagaccaaggtcaaaatattgtgacatttggctttaaacaaatgaacttctaggtagacctgctgtatatatagacttcacatcattatcatcgttatcatcatcatcatcatcacagtaacttatatataatgtatcagatacttgtctgagtattttatatcaatgatctcatttaatgcttacaattgtcccattgggtcactaccaatatctccatattactgattggaaatcaaactctgagaggacacgttgcccaagatcatttttttttttttttttttttttttgagactgagtctcactctgtctcccaggctggagtgcagtggcgtgatctcagctcactgcaaggtccgcctcccgggttcatgccattctcctgcctcagcctccccagcagctgggactacaggcacccaccaccatgcctggctaattttttgtatttttagtagagacggggtttcaccgtgttagccaggatggtctcgatctcctgacctcgtgatctgcctgcctcggcctcccaaagtgctgggattacaggcgtgagccactgcaccctgctgcccaagatcattaattagtgtcagagctatgattcaaacccaggccttacttaaagtcagataaacttgatagtttataggtcaatcacgacttcttatagattgcctcctcaaacaagaaaagggtagcttgctgggatggcagcattctaataaattctacccagtagtacatacccaacagccagaaaatggcaagccctacttctttctcccaatatatgagactttcacaacatgtagaccttattaagtaaaaattcaaagtttgtgaaagctcgtggaagagtccatactttatccataaaggcaacatgatacctaataaatgctttttcttgtccctttatttcagattaaatcctctatgctattatgtactacaagggcatgattatatgtcactctgtgatgtcaaaatatctattactaaataacggcactttagttaaccatgagaggataaagtagcattatctgacaatggacagaatgaactaattaccaactggtctgaccaacaagagagagatatgcttcctactgctaaaaatatagaagtgtgaccagtcagaatggctactattaaaaagtcaaaaaataacagatgctggcaaggttgtggagaaaaaggaatgcttatacactattagaggaagtttaaattcgttcagccgttgtggaagacagtatggaaatttctcaaagacttaaagacagaaataccattcaacccagcaatcccattactgggtatacacctaaaggaatataaatcattctattataaagacacatgcacacatatgttccttgcagcactattcccaatagcaaacacatggaatcaatctaaatgtccatcaatgatagactgagtaaagaaaatgtagtacgtatataccacggaatactatggagccataaaaaaggatgacatcatgttctttgcagggacatggatgaagctggagtccattatccttagcaaactaacacaggaatagaaaaccaaacacctcatgttctcacttataagtgggagctaaataatgagaacaaatggtcacatagagggaaacaacacataatggggcctttcagaaggtagagggtgggaggagggagaggatcaggaaaaacaactaattggtactagacttaacacctggacgattaaataatctgtacaacagcccccatgacacaagtttacctgtgtaacaaacctgcacttgtacccctgaacttaaaagttaaaaaaatatatagaagtgtgatgttagcacaggtttagatattcattcattcagtcagttaccagacctgagtatgtatggggctctggggttaagtcttaaggaagaaagacaaaggccctgacctcaagcacattacagtttagtgaaaaatatcacacttccccaagtctgcacatttagaaacaagttcttagattattttcagaacataagagaacttctctgaaaatacatgactcaatcatacaaaaaatactgactctgatgtactactacggagccgtacaacaatggtaattttcaataaaataactgaagagaaaatgatgctctgagttaggagattcttctaccagaggtgttaatgtgctccagctcattagaggattatatcaaataaagctgaactgacgttcacttttttgtgtgttttgtgtcttctttaggctccttcctccagttattttctatatccttaaaatatcccctattattttcaccacacatgcactgtaatggaaaggacatgatacattcagcagaattacttaattaggtttttgtgagcagtatgtgccaagtaagctaggtttgctttctagccataaaaatgtgcctgcagtgcatgccgtgttctcgaggaggaaacacagtgattgatgtgatgataaaatgatgaagggaaggataaagccagagagaaaaaagtctcaaaagggaaataaagtagggtagcagctgcccccatgttaattgaagcataaatttcagaagcaggatctgaggtttcatttcaagcatacactgagagagagtttgtgtgtgcgtgtgtgtgcgtatgtgtgcatatgtgcactgctgtgacaaaaaacacacaagctcttttcatcctttgtatgaagggttttaaagtcagttttataaaggaaaaagttgcaaatgtagaaatgtattgattttcactggaagacatttatttagtcagcatttaacagagaataacagaatccatgaaggacaagtgttccaggcactacagatacaataggctagaaaccacacatttctgcactcatggacctgaacgctcttagtttatcatttctctctgtacatatcttccctacttccgccccaccctttgccataatctttttaaaaacatatatataaatggcttcattttcactttgaacaccaccatagctgtgtatgtaaaaacactacagtctagccactaccgatacatccagccacttcttgcatctctcccaatatcacaatttcaagctttccattcctcaaacataacgtttatttttacataatggcgactttgtcagactgtactctgagcctcaaataccttcataccagtttcccatccattaaaacccactccatttgattgaagtgcagctgaaatgcctcttaagcttcatgctttttaatatttctaacagttttaacagtccttcatcttaatttctgggtaattttgcttggaatatgtcattaaagctctcagttcgtttgtcctgaaacgagctgttcatatctctgtttatatggcttgttattttgttgttgttgttttttctttggtaggtgtgaactacttgaggacagggcggggaggctgctaatttgtttctggctacatgctgttttacatgtgctaggcttttaaaaagtgtttagagggcaaacaaatatgcagccagaaagtatttaagagtcacatgagatttttcatgagggaatcagctgcctcactaaattctcaagattttatttcagaagatctaagaatgtgaagagttacataggtgagaatgcccactgctctctgcagagagcaagggatgtattgcatacacaggtgctatttaagtatttttcatgaatcaccttggggaaagcatagcccattaatggggcatactattatcaggaatgttttcagagatctcatcttttatatcctgtctttatagcttaatgttgcttctatgtatgagcctatagtaatgtaatcctaagcttggcaaatctttactttaaaaaatgctttaagaaagaaaaattgcttctaagcttagggacagtacaaatttttatagttttgttataaacttctgagaaacagaattaggacatcttgacactctttctaccttatggacaagctaatatacatcaccataaaataatgtgactgccattcatacaacagagaacaaaaataaatttaaaactaatgtaaactataaaactataatatataaattttctgttcattttaaaacacttaacctttaaccatgaaaacatactaattcactgtcaaatcttttatattccagaggacacttctaaatcatatatttgtacacagaaaagtggaatggactgtctctgtacatcctgattagcaggattcactttgaagggctatgtgaggagaagttttgcgttataatacttggatcaaaattatttgtgcattttccccatacttatgacttatacagttcagaaagataaagtattccaaagaaagaaagtgcatatctcacaaacaggggagctcttcctttgtgacaagataattattaattgcattatcttatcattatttaccttcaaaacagacttaattttatctcccttttaaaaacctgttctttctatacttaatttgagctaatgtgttatcaaaatctagggcaatattcagagttttgacctctaatggactaaatatcccaatatttaaattgcttaattagctactcttgcactgaagcatcttctctctccagtctctccctttttggaaatagtaccccactctcctgggcactcaggctagaaaccaggaagcaggacaaagaggtattccctccacattgtaattcaggaatgccagaaaattgtcttctcctttccccatgcccttcatacaaattcctcctggctcactgatgcctgaaattccatcatttattgctttggctcacagccaggagaagggatgccaggaagccatgtacatgtcttcctttctagtgttgccctggtgccaggcactctgttattaactctccatcattcttctgcattacatctttttttaagtgagggaaccaaagctgagagaagttaagtaattttgttagggtcacaaggcagattgatagaagatatgacaactgaacccaagttgggttgactcccgaatctgtgatttagcaactattctaggctaatatttatgtgggcctagcgctgtattaagtattggtcttactggatacttgttttcaggcaaatcagtggagcacctgaggaaagtgccctacccataccaacttacgcctcaccattgcagtgcactcggcaagactttggactgcctgaggtcattctctggctcctgctctctccagcaacgctaatatggcagactaaaagtgttacagaaacaccaggggactcagtctaggtccttctgctcgctgcacagaaagccaatcactgacacaacaatatcgccaaggaagaaggctttaattgggtgctacagctgaggagatgggaactcagtctgaaatccatctccctgattgactaaaactagaggtttatatagcagggaaggaatgtaacaatgtgtgagaaaacaggaactggggaggggcaaggaagcaatcatgaggagtgaagggcctggcatctcattgtctggatgtgggtatttagtgagtttcagttctttgatactttattttttttcagaggcctgaacatcatttcctgaggaaggaactcagagaagacaaatgtcagtttcaagctttaagatcagaagggtcaatttctatgtgtatcttaaaaactatccatgggactactgggtcggtttcaaaagcatgggataattaactctcccaccccaaccccagcagctctcaaccaatgactgatgagaatggtgtatataagctgcagctcccttgcctcttgtgaggaaaaaccctgcactgactctcagaattatccactgggattaggctccagttgtccacttaatgacacttttgataatacatcctttatcagctgcccttcttaccctgtctcagttcccagcttacctatagatatttcctggcatcctttccaaaataatctaatctatttgcacttgaatcttagtgttggggttcccaaggtctgcttctttggaacccaaactaaggcaatcggcatcatccaaaatacagattttcaggaagagaaggattggtggactttgagatcattaggcattgaagtgaacagaaaaagagctgggccactctcatttgttcccaaatcattactacatccacgtgttccttagcccatcactcacagctagggagatggcgtcacttgtttgtctatgaacagatattatgccagttctagggaacagggataatgcaatgaacaaaatggataaaatgctctgcccgtatggaagttatagtctaatagctgccaagagtttttttaaaagaaccaaatggaatttctagaatggaataatacatatctgaaatgattttacaaattttataggcttaactgcaggagaaaggatgaatgaatttgaagccagatgaaaagaaaccattcgagctgaagcaaatagagtaaaaatatattttttaatgaacagaggctcgataattgtgggacaatatctgacatgtaattagaatatcagatgatgcagagagagagaatgtggcagaatatttacttgaggaaaatgatggcagaatttccaaatttgagaaaaagtaattcaacttgtagacccaagaaacttggcaaattccaaacaggataaatttaaagaaaattaccattaggcaagtcatcagcaaactgctaaaaaccagagataaagcagccaaagaaaaaagacacattgcatataggagaacaatgatcagaaacaaccaaggcagaagacaatggaaaaccatctttaaagtgcttatgggggaagaaagacctgtcaatctagaatttcataactagtaaaagtatcctgagttatcctaaatgaagccaagtgagttatctgcatcatttgatctgtggaagcacttgtttggataagttaggctccaacatgtatcaaagggacagcagagtgtgatcgggagccagcctgcctgagtccaatttctgactccagctctcattagccaagtaaacttgggcaattttctcactttctctctgcctcactttctcatctctaacatgaggataacaataagatccaactcacatgggcattttatggattaagtgaattattttatttccaacagtctgaggattttcccagtatctttctgttattgatttctagtgtaattccattatggtccaagaacatattttgtgtaatatcaattattttatctttattttttaattttatttttgagacggagtcttgctctgtcacccaggctggagtgcaatggctcgatcttggctcactgcaacctccacctcctgggttcaagcgattctcctgcctcagcctactgagtagctgggattacaggtgtctgctaccatgcacagctaatttttgtattttttagtagagatggggtttcaccatgttggtcaggcttgtctcgaactcctgatctcaggtgatccacctgcctaggtctcccaaagtgctaggattacaggcatgagccaccacgcctggccctgatttttttctttctttctttttgagatggaatcttgctttgtcgcccaggctggagtgcagtgacacgatctcggttcactgcaagctctgcctcccgggttcatgccattctcctgtctcagcctcctgagtagctgggactacaggtgcccgccaccacgcttggataactttttttgtatttttagtagagacggggtttcaccatgttagccaggatggtcttgatctcctaaccttgtgatccgcctgccttggcctcccaaagtgctgggattacagccttgagccaccgcacccggctggccctgattttttaaaaattatttttatttatttatttttttatagacaggatctcaccctgtcacccaggctggaatgcagtagtgctatcatagctcactgtaacctccgactcttgggctcaagcagtcctcccacctcagcctcctaagtagctggaactacaagcacacaccaccattctcgactaattttttaaaattttatagagatgaggtctcactttgttgtccaggatgatctcaaactccttgtctcaagtgatcctctcaccttgacctcccaaagcactaagattacaggtgtaagccactgtacccagccacaaattcttttattttactttttcttatttttctttattccctttgatatacacaatcaacacacaaattcttttaaattgtaaatgtctgtttaatgactcaggatacagtttatcttggtaaatattacctatgcagttgaaaagaatgtatattttgttgttgggtggagtgttctataaatgtcaactagatccagttgattgatggtattgtccaattcttctaaatccttgctgattttctgtctgctggttgtagtactaagagaggaatgttaacgtctccaaaaaaaatttttttttaagtttttccttctaactctgaggttttgacatgtaacccaattttgtggtaaattctgaaataaaaataattaggattaactctaagacttaaaggtataagactatggaagtctatcccaaagtattttcgctacagttatgtgttagatgccaatgctatgaagcatagaactcggtttcactttcttctactaatgtatgctgtgttttgatgtccctttcatttacagactgtcagaagtcttctaaatgtgagtaatccactttgccactaagcaagacaaaaaaattattcaccagctcagttcatcaaataaacatttctgccatgagattggtaatctacactatttcaaaaaatttttaaatttgtagatatttgggttttatactctcatgatatcatcttatatgcaaataagtcattagggaattgaaagttaatgtttattaaactttaaaagattgttttcaaacacttcagaagtctttatttatatccaaataattatgtcaggctataatttactgactgagttccgtttactttattttcagaaagtatgaaagctatatttgtaaaaagcttaaggtgctcaagcattagtgacatagaataatctccatccattgctttctaaataaaggaattttacatacttttttccgtttctatacttgaacttaaagaaaagcttgctttgcaatgcagaaaattcaaataaactgttaaaatttcgacagtcttagagtcagaagacaataatagcttgtagtttcttcaggtaattatggacaacatatttaatttatgttgtaggggaggaagcgagttaaagagagagataagaagatctgaccaaaatatggttaacagttgggaagagtttccagcatgtaatagaaaaaggagataaaagagtacttgaataagagtgcaatgttttaaatcctcagagccaaaataatacagtatgtcattgtatcaccatcttaaataacaggtgaatagatttggaatgataaatactttcaaagaaataaaagaagaacaatggtataatcttctgaattggagtaaccttgaagcacatttataagatcatatgccatgaactgatattcacttctatattgtgtaaaatataaatacttaacggcaacactttctctaatgcaccttcaaaagtacaactgtttatgccattagagttcagaatagtagcttaaagaggaaatctttatagtattggcctctacagtattcatatgcctgcattatgtgtatcttaaaatagctcctttctcctcttgagagtaaagggactcaattattactatatgcattctcctaaatccaagggagccccattctttaacaacctgctctgtggacttagaaaacaaatagaaaagctatacattattcatatattttggcagcatactgaagcccttagagcaagtaataaatgatcagatgtctccctcgaaccttacctggtttactcttttgaaaaatccaacccttgccgtctcccacacaaagctcttggccactgggtgaaatccaagctgggtagttgatcatgataattcccgcatgtcatgggcagcagcatctctcagagtcccacaagccaactgcttgaaacgaacctgcaacaaacaagatatttctccattttaattgaaaaatagtgaaccgtgtcctaggtccaggaggcatcacaacttaatcaataagggaatcataaaggagtgtgtgagggactataaatgcttctcaagatgctgataaacattaaaactggaagactgaagtttatgtgctacaaaaggtgttttttccaagtgcatgtccctctgcatgttgttattgatctactcaagccatcagttattaatgaacattattgatattaaaactcacacatcctatatagtatgtaccgcctcttcttcaggtaggtgaccagttggggtactcagagtattcttctactttacccataatattctcagggtaactgggcaatgggatgcaatagggcaaaacccatgagcagttagagcgaaatccacaagattgtggatcaaggacaatttcctttgtgatttctgatgctccagtcaatgtgaacattccctgtataaatgttgggtcacctttctaggataatgtgtgagaaacaactttgagggacatatgtaaggtgttgcaaattcagcagccaccattattgatatcaacatacagactgtatgacagtaagacagtactgtaagagagtaaccaatgtaaatgcattgtagccagagtgggtacacaaaggaatgaccagactcaagaaagtaattagacagctaatttgggggcaatgtaccacgtatttaatgattcagttgtttatgtccatgaataaatatggcatttaaacttaattagcatgtttgacttttattcatacagagaaaacctatgtataatcagtaacctttattggactgttatctgacacataaacaacacttcaatagacgatcaggatgatattaatgaacagaaatgctcactggtcttcccagggtagctcttaaaaactattagattttttataactataacaaccatatttagtaatacatatacagaagcaaatttattactattattttctacgtagtgcacagaaagggcttagaggttattctaagtctgtagggggacttgtgaataactacgttctgaagattcatggacacaggtgcaaaaactgattttaacaagcaacaaaataataaatcctcatgcacctgtgattagagcttcacggattcccagaagtcagtgtggagactttgttaaaaggcacaacagtatgatatcctattacaccatttcagccacaatgctaagatgacaaagggttcaagtggaacacatgccttgcactagaatgcagcacttcaaaataattccttaaacaaagaggtgtatatgtgacactaaatgacaatactgcaattcaaagcaggagcgttatgttgatgctattagatacccataaatatccacaccccctcaacacacacacgtctaaaatttttgtatttattgatccaagttgtggtacttattaacctataacctcagtcaacttctagatgcaaactgtttttattcatgccaacatttttttctacttcctatcttctttgaagatcttctggaaattatcatatcacttattttataaaacaaacctgttttcatgaatgataaaccttttttggtcttttggcagccatgaaggatattaaaagaagccgtatactagtggaccagatgacagggaagagtttataaacataatttctaagcttccaaactgggtttgaagtgagaaatttttgaaagctacttgctttggaagcactcatcagtgacttagcgccacttctcatactttggttctgccacttattataaaaaaagtgaaaataagtcagtataactacttgctttataaaatggctatattttattacacagaaatgatgctattgatccctcctcagaaggggtaagttttgtgtattttcttttcagcagtgatgattttccactaacttttgttcatttatttatttattagccctcttattcattccacacattttatttgagcacctctgttgtgccaggcatgggatttggtgctacaggtacaaagcaaaaagacataagttctcttcatgaaaagattatcactgattctattctgtttaacattttcttgtaaccaagaaaggcagcaatattacatccaatcaagatgattagccttaccttatgaacaatctgctatgtgaccagagctgggaaattcatgaggtttgtcagtgagtagagcactataggccaagggaaaatctacaatatagaaggatcaattcacatagctaatgcttgtgaggttgttattggatgtgatagctttgtgtcactcttatatcttcttccacaacctcatgtagctgagttaaaatgaatcagataatccaaccaattaggttttgatagtacaataacatctacggcatcaaacacaagagtcactgccttccaactgttgtgtaaggaattacagtacaatcctgtgtgctctgcatcacatccaagttaacagacttttgtgtgtgcgggggtaggggaagatgctattgtataagttgctttacacaatttttgtatgattattctatttgttttctctaaaaggagatacaaaattaaatgcatgtattctccttgaagagaagtctatgaggggtcataagaagtaccaattccatgacattggtttgaaactgtatcctgtcaccaactttcattatgaaaaaacacgcttcaaataatttttcacttatctctctccaaatatgttattaatgagaatacaatgaaaacaaaaggtaggcataattattatttaaaatgctcttagatagtaggtgacttttttttactaaaatcaatatgatttccaaaggatttaattattttatgttttgaaactctgctattactgggatgcatagtatgataacaagatattttctttaatgctttcatttttttgagaaacttattcttttaaaaatgaatttggggctgggcgcagtggctcacacctgtaatcccagcactttgggaggctgaggggtggatcacgaggtcaagagatcgaaaccatcctgcccaacatggtgaaatcctgtctctaccaaaaaaaaaaaaaaagaaagaaaaaaatacaaaattagctgggagtggtggtgcatgcctgtaatcccagctactcgggaggctgaggcaggagaattgcttgaacctgggaggcagaggttgtggtgagccgagattgtgccattgcactccagcctgggcaacaagagcaaaactctgtctcaaaaaaaaaaaaaaaatcagaatgaatgtattttcttgtatgtaaattacacctcattaatgttgacttaaatgttctaaaatgaatttttgacaatgtgcaaacaggttccagataggggcatggcatacagaagtgattgataaatcactgttgtacattaatttaaaacaaaacaagaccaaaataacatttggaaaacaaaggagaagaaattctaacatgtacaaacgctgttttcctgtttgttggcctggccctaagtgccagttgaattttggtattctttgtctttccttatgcacaacactactacccttttagtataccttattgctttgaagaaagcttttcaaaggatccccttagcacttaggcactcattttataggctattgatttgcacttgttgacaagttgttttttatacgttatctcagcttcatcttccccgtggagacatgttgcataaccctctaggtggccaacagaactataagagtactcagcattcagtgagttcaatgcatttgttaaatgattgcttgatcttgatatattctggaagctttgtgtctaagtcactcattttcccatactaacacagagaatataataatcaagaatgtaaaaacagagagattataaataatcaaaattatgaggctttctaccttaaaaatgtcaaatttagccttttctgtcagtaattttagggaaagggtaggtttggccatttattattcacaaaattattgcttctaattttttttttctattcatttagtctgatgaaaaggtcagaaagtatttctcagtaggcagaggtcattaacaactaccactaatacttgtaaatgttgttgctatctattttatatgtagtttctttttaattgtctcccaaattatgagaagtttatactataataatgcccactttatggtgattaaaataagaatcagaaagtttaagttactcacccaaggatatagagcctttgaaaaatggagctgtgatttcaatgcagttaattgatagtgctgtaccgtattaactcaattaatgataagttcctagagactgaatctgaaagattcactcaatttatagatgaaaaacttagtcccagggaagtaaagtgacatattagaggctactcagatctcaatagggtctggaaaagcatttaaacccatgatactcctgtctttccaatacaccactttcttacccagcttactcagcatggtgtccaaacaactttatagatttccaattcacttgattttttttgtaaatggtgtttctggtaggttttatttcataaagaagataccaaagccaacaaacaaaataacaggattttgagatacacagttttaaatgaatttaattttgaaagcaacagatgacctttctctctctcatttttctaatggaaaaaaaaaaaaaaaaacaaagacacaaagagaagactgtgttgatagactatgacaaaacccctgattagattaaagtatgaatagcacatcagtgttttgctgatgaacattttgtatgtgtagctacattattagtaatcacaagctgcaaataatcttgcaaaatactcatttgatatcattttcatttcagaacccagcaggaagcccttcaagtgacataaagcaagatctaaggtaacgctatcaatcactgagaacgcagggcctgatactcaagcacaattctctttgtttttgtcttcgctcaaagatgcctaattctgaatttgattatgatctagaaactttaccaattaaaataggccacattcttgttttcattttctcaaaatgaggcatccatttgtcacattcccacattttccacagttgaaacttgcctctgtcctttttccttcctttcctgagtgttttatcccttcctgcctgctttcttctttctaccttttcttccttcctccattgtcttttttcttcctcccttccatccttctttcctttccttttcaccttcttcatttcaacaaatatttaaacatgttttaagttctatgcaatatgctaggctcagaggacaaggcaagacacttagttcgtgttcaagtattgctcatagtctagtagtgtgaacggggaagtaaaccaacaaattatggaagaagagtagaggtgcaacctacattgaacatgtcagaacatgtcagctttgagtagaaaataattcataaattgatcctgattggtttggcttggcctggtcaacttagaactcacaaacaaaatataattatcattaggcagtttccaaatacttcatatactctgagttttctatgatttagagagagatcttttaaattctcaaagctcacaaactggaatgcctcagagccaagtgtatctcttaaatgtaaatatagtgtggctgactttgacaaggagccagagagccacaaatggtgagctggagaaagtaagcttagactaaggatattacaaacaacatttgaaacaccattttgccagaaagaacacatttttggactggttttggtccttggccaccagtttgagatcctcctttgtaactattgaggagtcaccatccactgctctctagatatagtataggtcccatttccactgcctttggcaaaatccatgacaagttaaaaaaaaaaaaacaaaaaaaacagaaacttctccctagaaatcctttctagtggggaaaaaacaacttctgaattagctcatcaaaattatgagagtgttgttgataatgtgggttcttgggcaatgccccagaattaatgaatcaccatgtctagagtgagactggagattctgaagatgacacttccctagattacacttagacacactcatgtttaagaactcttctagaacaaagccattttttaatttttccagcattttcccacaacttttaatgtaaaacatttatttctctttgagtttcagatagcctattttgggggaaaatgattcttccatgaattgcataaagtgagaaatggcctttcaattctacacaagaagatcatccctaaaatacataatcatcaggttttccaaggtctaaatgaaatacagaatgttaaaggcagctagaaagaaaaggcaggtcacctacaaaggagaccccatcaggctaaccatggacctctcagctgaaatcctacaagccagaagagattgggggcctatattcaacattcttaaagaaaaaatcttcaaccaagaattctatgtccagccaaactaagcttcctctgtgaaggagaaataagatcatttccagataagcaaatatagagggagttccttaccaccagacctgccttataagatatcttgaaaggagcactaaatgtagaaaggaaagacctctagcagctaatataaaaacacagtaaatacacagaccagtgtcactacaaagcagccatataaacaagctaatgcaatcaagtttttattggtgtaaggcagactgtgcctaaaatgggaaacaagaaatgatggagggtaagtggtctcaccaggacttacatttcatgaagaagaaactgtcatctctctatataaccaccctcaagaacagtgccactgcattagtttgacagcagtaccatttcctgatgggatgtagttagcatatttgagatatacaaccccttttaggctgggagcaatggctcacacctttaatcccagcattttgggaggccaagacaggtggattacttgagctcaggagttcgagatcagcctgggcaacatggtgaaaccctctccctacaaaaaagtagctaggcctggtggcacacacctgttgtcccagctactcaggaggctgagttgggaggatcacctgaacccaggaagttgtggctgtagttagccctgatcacaccactgtactccaacctgggcaactgagtgagaacctgtctcaaatatatatattataacccctttcagcagggtgatggtagtagggatgaatcaaaagtaacacaatattctaaagaagagagatgggaaaataataagtatttggcaagtgaccattgagaattagtgtgtcacattgtatgctttacatacatgttctcatttaatcttcataaaaaacctgggagacaggtactacttccattttgcaattgaaaagcatggggtcagaaaagataagtagcttgcttaaggtcaaaaagttacaagggagaattaagatttaaacttgtgacttgttaattgtataggtcttacgctttctagcacaataaatgctctgtatgtcatttgtcctatcaatttgcttttgatttcccacatcaagaataaagccagatcaacccatttctttctctatttctaatagttccttcccctaaacactatattccactttatcccaatatcaggtatatacagacaaaatacaagagagacaatgtcatggacagcttgtgtatatatgtgtgtgaatatgattttatttgtttttgttttcatttaggctttccataaaccaacatgctcctctttctactaattctctgatttttattaggaagttgttgctgaggataatcttggagggaaggaaagaccttctttctactgcagcctgggaatgagaggggcttggatgtgacctaactcaactaacatgacctaaatatgaaagcttgagggagtgacacaaaggttttttaaactgtagttatatataaaattgacccctgaacaacatgtggattaggaacaccaacatcctcatgcagttgaaaatttgtgtacaatatttgactcccccaaaacttaactactagcagtctactcttgactggaagccttactgtaacataacagtagattaacacgtgttttgtgtgctctatttattaaatactgtaatcttacaataaattaagctaaagaaaagaaaatgttattaagtaaaccatgaggaagaaaaaggtatttactctttataataaatacctttatgggttatcataaaggtcttcatcttcattgtcttcatgttgagtaggctaaggaggaggaagggaaagggttggtcttgctgtctctggggtggcagaagaggaagaggtaaaggagatagaaaaggaggcaggagaaccaacacactgggtataacttttactgacaaaaatccacatgtaagtggacacaagcagttcaaacctgtgttgtttaaggatcacctgtgtatgtgtgtgtatgtgtacatatatatttacattatacagacatttataaggatagatgcataacaatgatagctaaagcactgggtttccctgcaatatgatctaggtgcacaagcttctttattcctctccatatgcctgttttgtgagatgtggatctccttctgatgaattctttttctgcttatgacagccagagtcattttctaatatttataacaaaaaatccttactgatacagaaatttgttctttgaaaattttaaataattaaaaaatttaaaatgtatatatatatataaaatgtataattctaaaaatatacttcacctggcatagaattaaatagctacatatatgtataatttgtataattacattatatacacatatactgatttataaatatatacatgatatgtatatatatgtaattaaatgttgtacaatttacagagagtgaaacataagattttatgtatacacttggatcagttttaagaaatcagtatatccctgaaaccaacacttaaatcaggatatagaatatttctgcaccccagaaagcttcctcatatctcttcctttcaacacacacctctcacaggcaattagtattctggttttaaaagatttgtttcacctgttcttgagctttatataaatggaattatacagtacacacatttatataagtctttttgtggatatatgttttcatttctcttggaagtttacttttaggtatttgtttagatctatgtttaactatattagaaactttaccaaacaattcaaattaatagaaaacctactggcacccagctcagagactaactcaaagtagcatggagtatgtcgaagagaataacaaaaaataaagcatgaaaaacaaaatttgaataaataaactgtagctgaggttataatgcctctagtaaagttagcaataagatgtaaagtctttatcagttattttagaaaatactttaattctattacttatcaatgttctaggaagaatttggcaaatgacttgcagataaaatggaatagccagagcaactttacaataaagatacattaaattaaaagagatttgcttcatacaaaagcagttgatgtaaccatattaaccatactaataaactaaaaaataaaaaccatatgatcatctcaattgacatacaaaaagcatttgacaaaattcaacatcaattcctcataaaaactttaaacaaactgggactagaaagaaatttcttcaacctgatgaaggatatctgcaaaaacctggagctaatattatacttgatgaaagtctgaatgctttcttattaagatcaggaaaaggcaaggatgtcagctcccatcacttctgttcaacattgtagtggaggttctatccagttcagtacggcaagaaataaaaggcatccaaattagaaagaaaaatgttaaaactgcctttatttgcagatgattgtctaagtaaaaatctattggaatctacacaaaaagtaccagaactgattaatatgtggatttagtaaggctacagaatagaaaaattacatacaaaaaccaattgtatttttatagtctagcaacaaaacattagacattgaaatttacacaaaaaagttcccaataatataaaattaaatgaaatacatggggatgactctttcacaacgtacatacaagatctgtacactgagagctataaaacattgctcagaaaaattagaatccgtatgtaatttctttaaaaaattctgttgggattgtgattagtcagtttggggtaaattgacatcaacaataatgggttttctaacccatgaatgtggcgttcattcattcatctggtctttaatttctctggctccttgtcaaagtcagccacactatatttacatttaagagatacacttgactctgaggcattccagtttgtgagctttgagaatttaaaagatctctctctaaatcatagaaaactcagagtatatgaagtatttggaaactgcctaatgataattatattttgtttgtgagttctaagttgaccaggccaagccaaaccaatcaggatcaatttatgaattattttctactcaaagctgacatgtcctgacacgttcaatgtaggttgcacctctactcttcttccataatctgttggtttacttccccgttcacactactagactatgagcaatacttgaacatgaactaagtgtcttgccttgtcctctgagcctagcatattgcatagaacttaaaacatgtttaaatatttgttgaaatgaagaaggtgaaaaggaaaggaaagaaggatggaagggaggaagaaaaaagacaatggaggaaggaagaaatgaaggcagaaataaggatgttctttgaaacctacgagaacaaagacacaacgtaccagaatctctgggacacagtcaaaacagtgtgtagagggaaatttatagcactaaatgcccacaagagaaagcaggaaagatccaaaactgacaccctaacatcacaattaaaagaactagaaaagcaagagcaaacacattcaaaagctagcagaaggcaagaaataactaaaatcagagcagaactgaaggaaatagagacacaaaaaacccttcaaaaaactaatgaatccaggagctggttttttgaaaggatcaacaaaattgatagaccgctagcaagactaacaaagaagaaaagagagaagaatcaaatagacgcaataaaaaatgataaaggggatatcaccactgatcccacagaaatacaaactaccatcagagaatactacaaacacctctacgcaaataaactagaaaatgtagaagaaatggataaattccttgacacatacaccttcccaagattaaaccacgaacaagttgaatctctgaatagaccaataacaaggtctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagcccggcagagacacaacaaaaaaagagaattttagatcaatatccctgatgaacattgatgcaaaaatcctcaataaaatactgggaaaccgaatccagcaacacatcaaaaagcttatccaccatggtcaagtgggcttcatccctgggatgcaaggctggttcaatatatgtaaatcaataaatgtaatccagcacataaacagaaccaaagacaaaaaccacatgattatctcaatatatgcagaaaaggcctttgacaaaattcaacaacccttcatgctaaaaactctcaataaattaggtattgatgggacgtatctcaaaacaataagagctatctatgacaaacccacaaccaatatcatattgaatgggcaaaaactggaagcattccctttgaaaactggcacaagacagggatgccctctctcaccactcctattcaacacagtgttggaagttctcgccagggcaattaggcaggagaaggaaataaagggtattcagttaggaaaagaggaagtcaaattgtccctgtttgcagatgacatgattgtatatctagaaaaccccattgtctcagcccaaaatctccttaagctgataagcaacttcagcaaattctcaggatacaaaatcaatgtacaaaaatgacaagcattcttatacaccaataacagacaaacagagagccaaatcatgagtgaactcctattcacaattgcttcaaagagaataaaatacctagaaatccaacttacaagggatgtgaaggacctcttcaaggagaactacaaaccactgctcaatgaaacaaaggaggatacaaagaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagccctcatcgccaagtcaatcctaagccaaaagaacaaagctggaggcatcacgctacctgacttcaaagtatactacaaggctacagtaaccaaaacagcatggtactggtaccaaaacagagatatagatcaatggaacagaacagagccctcagaaataatgccgcatatccacaactatctgatctttgacaaacctgagaaaaacaagcaatggggaaaggattccctatttaataaatggtgctgggaaaactggctagccatatgtagaaagctgaaactggatcccttccttacaccttatacaaaaattaattcaagatggattaaagacttaaatgttagacctaaaaccataaaaaccctagaagaaaacctaggcgttaccattcaggacataggcatgggcaaggacttcatgtctaaaacaccaaaagcaatggcaacaaaagccaaaattgacaaacgggatctcattaaactaaagagcttctgcacagcaaaagaaactaccatcagagtgaacaggcaacctacaaaatgggagaaaatttttgcaacctactcatctgacaaagggctaatatccagaatctacaatgaactcaaacaaatttacaagaaaaaaacaaacaaccccatcaaaaagtgggtgaaggacatgaacagactcttctcaaaagaagacatttatgcagccaaaaaacacatgaaaaaatgctcaccatcactggccatcagagaaatgcaaatcaaaaccacagtgagataccatctcacaccagttagaatggcattcattaaaaagtcaggaaacagcaggtgctggaaaggatgtggagaaataggaacacttttacactgttggtgggactgtaaactagttcaaccattgtggaagtcagtgtggcaattcctcagggatctagaactagaaataccatttgacccagccatcccattactgggtatatacccaaaggactgtaaatcatgctgccataaagacacatgcacacgtatgtttattgtggcattattcacaatagcaaagagttggaagcaacccaaatgtccaacgaagatagactggattaagaaaatgtggcacatatacaccatggaatactacgcagccataaaaaatgatgagttcatgtcctttgtagggacatggatgaaattggaaatcctcattctcagtaaactatcacaagtacaaaaaaccaaacaccgcatattctcactcataggtgggaattgaacaatgagaacacatggacacaggaaggggaacatcacactctggggactgttgtggggtggcgggaggggggagggatagcattaggatatatacctaatgcaaaatgatgagttaatggttgcagcacaccagcatggcacatgtatacatatataactaacctgcatgttgtgcacatggaccctaaaagttaaagtataataataataaaaaaaaacaaaacaaaaattagggtaagctaagattaatttactattaaagaaaaaatttaaaaaaattgataaatttgatttaattacaatttaaaacgtttttgcattgtgaaaaccaattttaagaaaatgaaaagaaaagccacaaaccaggggaaaatatatgcaagttacataaaaaactcgtgtaaaatacctaaagaactctcaaaacttaatcatataaaagcaaaccaatttaaaaaaaaaggtaaaagagttgatttcacacttcaccaaagaggctacatggatggcacatcagcacatgaaatgatgctcaatgtgattagttctccagcaaataaaaaacaccccgagatattgccacacagctattaaattaaataagattaaaaaggcttatcttaccaagtgttggcaagggtgtggaggaagctaaacttttatacagtgctggtaggagtgtaatatgacacaaccattttgaagagtagtttgatgttccttaaaatgttaaagatacacaattatataatccagcttaaaatgttaagcatacacaaatatatagtccagccattcaaattctaggtatttactcacaagaaatggaacatatgacatacaaacacttgtccacagtcgttcctagaaacttttttggcagttttccaaaagctgaaaactactcaaacatccaccaacatgtgagtgggtaaacaaatagtgttatatccatggaacagaattatactgcacaataaaaaggaatgaactaatggtgcatgcaatacatcaatgaatcacaaaataattatgctgcatgaaagaagccagattcttctgcagccctccaaaaagaatgtatactcttcaactccatgtatataaaacagtagaaaatacaaattcaaattaattatgattacagaaagccattctgtaatcatagcagttctgcgcctgaggacgcagagaggaaacaggaaggaaaaacttaaaagacacaagaaaacttgtgagggtgatggatacgttcattattttaactgcagtgatggtttcatgggtatattcatgtgtcaaaacataaaagtgtacactttaagtatatgcactttattatatgtcaattataggtaaataaagctgatttaaataaacaaatgggatataagtataaagtttaatttgaaaatttctttaaagttaaatctcttctatctgtagtaatttattaagaaacattgtccccaatctgatcgagaacaaaacttttttgagcacagaaactcacatcattcttttaagaagaaattttaatgctgataacatgctcaagcaatttttaataaagttcaacaatactaatattgggggaaattcagccagatattgggcgaaattcacccccgatatttcatgtagattcttttctattttctctaagtgtcagccggtctgagaaataaagggacagagtacaaaagagagaaattttaaagctggatgtccgggggagacatcacatgtcagcaggttctgtgatgccccccgagccataaaaccagcaagtttttattagtgattttcaaaaggggagggagtgtgggtcacagagatcacatgcttcacaaggtaatagaatatcacaaggcaaatggaggcagggcgagatcacaggaccacaggaccggggcaaaattaaaattgctaatgaagttttgggcacacattgtcattgataacatcttatcaggagacagggtttgagagcagacaaccagtctgaccaaaatttattaggcgggaatttcctcatcctaataagcctgggagcgctactggagactggggcttattacatccctacagcttcaaccataaaagatggccacccccaaagcagccattttagaggcctaccctcagggacgcattctctttctcagggatgttccttgctgagaaaaagaattcagcgatatttctcccatttgcttttgaaagaagagaaatatggctcttttctgtctggctcactggcagtcagagtttaaggttatctctcttgttccctgaacaatgctgttatcctgttcctttttcaaggtgcccagatttcatattgttcaaacacacatgctctacaatttgtgcagttaatgcaatcatcacaaggtcctgaggcaacatacatcccccttagcttacgaagatgatgggattaagagattaaaccaaagacaggcataggaaatcacaagggtattgataggggaagtgataagtatccatgaaatcttcacaatttatattcagagactgcagtaaagacaggcgtaagaaattataaaagtattaatttggggaactaataaatgtccatgaaatcttcacaatttatgttcttctgccatggcttcagccagtccctccgttcggggtccctgacttcccacaacaagtaaggcttcttctgaaattagctaaccatttattggttattagtcaagtatctatgttctttagctagatgttttagatgttttcttttttcttttttttgtatccagataccaataattgtctggtcaatctttttactttgaaattgtccttaccgagaaagaatatttcaaatggccagctcagccctctctttttgcaaactttgaaataaaactttgacataagctcaaatttttttaaatttttatttgaaaattgtgaatcatttaaataaaaatgagagggagagaagagggggtaatagagagagggtggtcaaggaaaataagaaaatgattagtggaaatcaaattattaaaattttcaggaaaaaatcacgaaaatttaacaaaataaagtgattatgattacattttaaaaataatgataaaattgcaaagaagctaaataagaggatttcagtcataaatatcaacatgcagagagtactgtgtagtatcataatgctttattctaattaaggcactagtagtatttacaaaatcattagattgggttcaaataagtctttatcccttctaataaaaatgtatttctacccttatacaagacagagtgcaattattataattctgagaaaattttaatagttttattagcatatgccaacatgaaataaaatcagtagtggcttattgtcattgctgtttccatttaaaataatcatttatatcactctcaacccaaaggagatttcacagcagaaatcaccttgtgcctttattcttaatcagggctctgttgtgtcaggaaaaaaggaaaacttgaccttcttgtttttaatgacccaagggtagttatttattacattaaatgtcatgaaaacccacaaaatacaaaggatttcaggctgacacagtatatcatccccactttcatacaaagattaatagtccaggtaccaagcaaaataccaacagagaataatcctgacacctgtttcaacatctgatgatgacactttgctgaataaaagtttaatcactcatttcctatatcgtacagacagttttgtaacgagactacataattacaattgagagaagttatatcattggctaatacataattatatctggaagcataaccactatattgggaaattgaatcatttcaaaagaatgcttttcacactcacagtattcagggaactatttaacgagaggggtctctgggctcctgctcacacattcaaattcttaggtgcaatttgggaaagatccagaaggcccagagaaagggttttggtacttggtgttagaataattcagacaaaaggacagtatataatattttataaagaatcttttgctaagtttcaactctacaggattcattaaatttggaaaatagttgactgtgccccttttttaatctagagcaattcaaattcttgaagttccatgtgtaaagatcagaagaaattgaaatctttcaatcattgtcatccctgtctgtaagacagcccattcttagattgttaggcagagaggctggattctctcagaatcaccctcaaacttattctgtatcaaattctattttgaagaaagttgcttctcgagttcaagcttttaaatgaaattagcatgaagtaataaattctttccctaatgcaaactggaaatgggagtatgtaaggagtgccaatgaatattaactagaagtcctatccacattattagttagtttgatggtactttgtatgtgtctctgaagggttcttatttgaagagggcctttaaatgttcatagacttagttgctcaacacgttgagaatttcaaacactgtgaccagtgagaattgatttttttttttgttttagatggagtctcgctctttcacccaggctggagtgcagtggcgcgatcttggctcactgcaggctccaccccgcggggttcccgccattctcctgcctcagcctcccgcgtagctgggactacaggcgcccaccacctcgcccggctaattttttgtatttttactagagacggggtttcaccatgttagccaggatggtctcgatctcctgacctcgtgatctgtccgcctcggcctcccaaagttctgggattacaggcgtgagccaccgcgcccggccgagaattgatttttgatctttttaagtcctataacatgattgtggcatgaaatactacacttaaatgcagctggatccttagttagggtaaacaaaaagttgatcaataaatccacaaatctttcaatttgaaacccaagacaaagttttagaaatcagagtcagtaaattttagaggagaaaaggagcttaaccctgtactctaacaccttccttccacctgtctcctgttccttcttcaagaaataattgagtgtctctgtgttcaaggcaccgagtttattttacagataaagaaactgacggctaaaatataaaacagtttccccaaagcactttgccagagctaggcttttgttgatgaccatcacaaaacaagctgacagctctttgctccatcatgttatttcacattaaaaatctgaatttacatacatcagtggaaacaatggcaaagataaatatatgaggccgggcgcggtggctcacgcctgtaatcccagcactttgggaggcagaggcaggcagatcactaggtcagaagatagagaccatcctggctaacacgatgaaaccccgtctctactaaaaataccaaaaaattagccgggcgtggtggcgggcacctgtagtcccagctactcgggaggctgaggcaggagaatggcgtgaacccgggaggcggagcttgcagtgagccgagatggcggagttcgcagtgagccgagatcgcgccactccagtccagcctgggtgacagagcaagactacgtctcaaaaaaaaaaaaaaaagaaacaaaatgaaaatatgaaacatttcaggagtatagaatgctttattgtattctaataattcccaaacgatcattggtaacacaatcagagatggataaaaaaagagacacactcgcctgtaatcccagcactctgggaagctgaggcgggaggattacaaggtcaggaattcaagacgagcctgcccaaaatggtgaaaccccgtctctactaaaaataccaaaaatttagcccgacgaggtggcaggcgcctgtaatcctagctactcgggaggctgaggcagagaatttcttaacccggaggcacaggttgcaatgagccaagattgtgccactgcactccagtctgggcgacagagggagactccgtctcggggaaaaaaaaaaaaaaatgacacactcttggtctgatgtggagtgactttccataggacaaatatttatatcctaaacttgttccatgtgcctcatctttatttatggaagcattctagctgaccagctgtttttactgatggaatgcaaattatttttgtcacttgaaatattatattcatattatctaggttttaataaaaagaagggctggttaagtgaaagagatcttaaaagcattggtagatgatttactagtttagatcatttcatcagtgggatccaagtggaatgtggcactcccagcatacatgagaacatccactgtagttcagcaagaaaataccagaacttcatttatatactcaaattttatcgttttctaatttctatttcatatatgtttattggagtaaaaactatgaatatgacattcaaagtacataattcttagtatagggtataataatagcgtaagatttgtgaatatgcaaattagtttttgggttaaatgcgtaggctccaggaccagatcttctgagtttcaaatttaaaagtggctctgccaattatcacttacctatgtgattgttggccaagtctctaaacctttctttccctcaagtttctcatttacaaatacagataataataaaaaatatttctcactttatagaattgtcagaaactttaaatgagcaaatacatatgaagcatttagtatagcacttgtcatatattaataataagcagccaataaatgttagttataaaaacaattattaaatatatattattacatgtatatacacatattttgaaaacagtaccaaaacttttttttaaaatttaatgactgtacaatgaaatatatagtgaggagatatgtatttcattatctactcttatcaaaataaaaaaacggatgaagacaaacagataaggcaatatgttttatgtaaaaattgaagattaccatatgccagctctgtgttgggatttgagggaactcaaaattattaagacactgaccttggcttttaaaggatttaagatattgcaggaagtagggaatagaggcaaagaagtggaatctggaaaagtacatagctaatttgaaaaactttgaaaacttctataatacaggtacaattacaaagaagttacaaaaaagatcatgtaaaattgagttgttttaggatgtgtcaagcaagtccccagagaggaaccggcatttgaacttggactaaaggacaaatcacatttatgaaaccaatatacacagagtgtcttaagcagaagagatgaaggagacattaacaaatacacacaaactaagtatataagattatagaagagggtttaatttatgccaagaagttccaagaaggcctttcagaaagacgtttaatctgacaccaggatgattagtaaaaattaggatgagggatttttaagcacccttatctgctagccatctgagaatacagaaagctcaatctccattttgtttccattaactgccaaaagtcccttgcatcagttgagtacatgctacatgcactatgctaacttggctatttcacctacatgacaatgtatatccgtcattatccttatgttgaagaggttaactctctttttcttagaaaaactaagttcttagaaatatattcttttgtactgtattaatgtattccaattatgtttcttctgtttcacagaacaatgtgaaactttgaggtctgaagattcggctcaactattcttgaagcacgaattataaagatgcattcagcatgtgatgcattttgtcagtatgagttccatatatatttgtgagaaaagagagatataattttcatgagagagctgaaattctagattgacctttccttgtttatctcagttggagagctagaagaaaagtttctgatgaagatttctccctaatttgtgtcaaacaaatgtcttaaaaagacaaataaaaatcttataaatgtgactgaaaaatgtttctaccttagattaaacatgttgctttgtaactttattagtaaaacctttcagaactttcagatcattattggaagcaaaatatgtaaaatagctaaaagtagagctgttcaaggtgaaataagtttggtagaggccatgagggttctatggattataattgaaacttgaatattgtgaggatgaaattttaatggattcattattctgaaaaaacagagtgttaaaaaaagatactttcaaaagacgttcattctatttgctttctcccttttctactgttcacataaaagtgggttgatagtaaaaatgaaatattatattaattcatacagggtacgagaacagccagctgtgttagcagttactaactttcaaaggctccctgtctgctaatttaagtcacagttctgtctgccacacagggtatgggccaacttttagagtccccataatgcagtccagtcaaacccagtccctgcctttgttgggactaagcataacacaacaaaaagagataaagagggagtttgaatggccattctctcagacatctgtgcatgagtcacatcaaaagactatcagcaaggaatacacatatgctgcagccatacaagaagcaactgagttgaaacaggtacctggcccttcatcccaccaggattcccatgttctttcaaggttcactgagttaatatcaggctacaattggactaatttgcttcacaatcggaacaagaatgactcaaagcacttctgtccttataaacacctaagaaatgcaaaggaaagaatttctttaatttcactgtttctatagaactgaaatacattgagtgacaactcctcattgtaaattagcacttgaaaaagttaaatacagatcatgaacatcaaattatacacatatttctatttatatcattgatttattcataagcatatattatattgtataatctccaaatttctgtttgggagaagaaaattaatatttaaagtgtgaactatgtgttcatcttagtagaacctcatgataactttgggagttggagattatttttatcaagttcaaaaaggttaaatagcatgcacaaagtcacttgcaatggtcagtgatagaatgtgacacttgtttggctgaagctaaatttcatgctttttcacaactataaaaaaaacagtctacttagaaaatgagctccaaaggacagagagatcaattgttgtattgtctattgacaagaattccgcctggcattactggtcatgtgggtatttaattagtaagtatgtcccacaaaagagatccctatatttgaaaatataaagacctaagattactattggaaatgcttattactaaaaattgtgataacaataaaaccatcatttcttgggtgctttctctaggctaggcactgtactaagcaaacacttgacaaaacactacttaatcctcataacaataatctttattgtttcccactttttacaagttaaaaactgaagcttagagatgttcagctgcttgctacatacacttggttagtaagtggcagaaggagccttagaatgtagggctgactcaaaagcctcttccattagttaatagtttaaaactctttatagtcagtgacaatttatgtattgcatttattagaaataattacaaagtatgaactgcccagcagacagaagagaaataaacatttaaagagtcaggatctacacatgaaatcaaatttaacacaatgtataatgggaaaattggggcttccatatagatttcaaaagtaatagggatggccacccaccttccgtgacttgtggcccctctcctcctccattctcaaagccagcaataatgggtggaaccctgtcagtcttctaatctctgctccttctttcatctatctttttctttactactctcttatatggatttatatgattagattaagaccactcagataattcaggataatctctctgttttaagattccaaatcttaattgtatctacaaaattgcttttatcatgtaaaataagagatttataagtttcagggattagggtgtgaacatcttggggggctgttattattcttcctaccacaacccctcagcaacatacttaaactagtaacacatacagcgtgaatgaatcttaaatttatgacactaaataaaagtgttacatactgtatgattcctgttatatgacatttggaaaagacaaaactatagaggcagaaaatagattggttgtttccaggaaatgagaatgagaggaggcgactgattacacaggagcttgaggcaattttttgggtgatagaaatgttttacatctttcttctgatgggattatactgctgtgtgcatttgtccaaactcatagaactgaatcctaaaaagagtaaatttttatatgtaaattacatgcaagaaaactgattgaaaacaaacagaaaagaaaaaggtattaatgcttcactgagtcaccatgaatcttaaagtactagaattttagggcttaaagtactagaattagtagggtgagaatatgtccctaattttctgagactttactgatttcaaacattttgtctcattgctcctatggaattccagctatacgaatattttagtgtgcaaaatatactttgtgcacccaagaaaaattccatcacacgtcagttgttccagttttgcattggaaacatacaatcccctcattctcaagggtcacatagcttagttccatcatttccaagaagaagcagcagccagtgagattaagtaatttgcttgaggtcatatatcttattagtatgagagccaggagtagaattcatgtctctaagctccagtccactactcttatcactgaactgaagggttcttagaaatctaagggaaactataattgtttctgtcaatcccaatatttaagcattagtgagacacctgtgcaactgcacaaattgtgaatgatgctgcagttagccgacataattggtgacaatttcagtagttatatttacttttccagatgtgtgtgctgctcttaggctctggagaaatagttatatggcattagacttacttatgaattggtcaaacaaacaggtatctttagacgttcacttaggcaatatgttctagggatggggtcaggaatataactttaggcacaggacgcagaagtggagaagacagaggcagtactatatagtacagtttaatgacgggagccagatcgctctctatgaatggcagcttcattaccttcaaaagatttcttctcaaagatccaattcaatagaggactctcaatccagactgagactagggatttgtttacttgccaactccctcagacatctgttccccttctgtttccttcttgacgttaagaagccctgttttatcatggcaggacactgaaactcggggagcacttttagctagcttcaaatggcagattcttatagcacagaagtatagtatggtctgattgacagcatcagtaatttaatgcactttgtcttgcagctgccaatccatggcataaaatgacagctcatttaatcacatttcttaggatgaataagttactttaatttttgttaattttttttaaatattggcaaactcatgcaatcacattcattctcacccttatcccattgaaattaaaacactcacttcatttaaagaaatgcttatcaaagagttgaatacaaactattccatatgtttctccataactatcttgagaaaatacccaaacaaattacctactgaaattcaagaatcaagaagccagagacctgcttcagaagtaaaacatttgacaaacatgttgtcacaataagcctctatgggatcattcagcccacaagatataacatgttagaggcagagaaaactgcatatagccaggcagaaactacataaaagacatgcaaaagccagtgtgctgaaaattcaaaagttaggaaacctgagttctagttcacctcaatcactagtcataacagtaatggagggcctactatgtgccagtgaattgatgtgctgtattagttaaggttctctggttgcaagcaattgaaactgttactggctaaagagaatgtactggaaatatattaaaagtttatgaattcaaaatgaagagtggagaagcagatttcaaagcagagaagtgctataatagggccaagaaacagagactataggacctgtcccattcaacatgaacaggcttcaaacattctcaatttcattgttgatctgccttatattcaaattcagattggaaatatatgctgaacatattttaggtcatgtcctgggttgggacaaggtcagggcccacccaattacacccaccaatgaagagatagtttcccaaaataaattccattggatgttaggacaggcgatggaaagctagattccagtcactggaatggaaaaaaagaaaaaaaacaaactcaacaatttaattttgatgcatatttttatacatccatcaatgagatccattttgtaaatacaataaaatcacatcattccaaaagctttccatgctacttggaataatccaaactacttacctcagcttactaagcttcatctccaattttgtcttgtagtattctccttacacactaaccttgagacacatgggtttttttcatctttagacacatcaagttcatactggccttgggcctgtgctccaactgtcccttttgcctggaatgtccttacatttcatggatgaatccttctgatcatttggatgacagcacaaatgtttcctcatcagagaggttttcactgatcacccaagctaaaattaatcaatgacttcctatcatatcacaccattttcattccacttaaaaaatattacctgtcacaactaaaatataagattcactgagaatagtaagcctcttttgcatatttgatagttcctagacatagtaggcactcagtacacacacacacacacacacacacacacacacacacacacacgtttacaataaatacttttttaaataaccaaacataatagattttattttattcactttatagaagaggacactgaatttaataaaaattaaggaacttgcacatcaaacatttatgtatggcataattcaaagtcagatctgtttggatccaaggccaggctcttaaacactgtcatgtactgattgtctatcactacctgtatgatttggggtaagtcactggacgtaaagatgcttttctaattttttttagcagcagaatatattttctctctaaataaaatcatatagacaacctcaataaattgctaatttgatatattcaaagacacaatgtttatttattgtgaaatcattcagtgaaagtaataagattgcctgaccaatacattttaaaatttctagctgaatatgttaagaaaatccctatttatatgtacacagtgagacacagtgagcttttaaaaactgacctccttgaaatctcaacatactcattgattgcaggtatggcaggaaaatctttattctaattgtgcccagaagggagttaacctggaatcacatgtttagatattgatggtctccagtgtgttaaaatctggtgtataaaaatagtcccagagtgggtggtttattattatgccacctaaaatacagtttaatatgttatatatgcacagaaaaacttgtagaatttcaaaaggatcttcaaaaaattcacagtttaaaatctgtgggcctaatggattacctatagctctcacattctgtaggcaaattctgtgccttttgatataactatatttgctctgataaagtaatataagaaacaacctgggtgcggtggctcacgcctgtaatcccaacactttgagaggccaaggtgagtggatcacttgaggtcaggagttctagaccagcctggccaacatggtgaaatgccacctctactaaaaatacaaaaattagccaggtgtggtggtgcgcacctgtaatcccagctaattgggaggctgaggcaggagaatcacttgaacctgggaggcagaggttgcactgagctgagatcacgtcattgcactccagcctaggcaatggagggagactctgtctcaatcaatcaataaaataagaagcaagccaaacagatccaaaatagtctcaaaataagctgtaaataactccagagcgtagcatcaaagcaaacataagttcggagaacaatggcaggataatgggcacctgacagtaaccaatcacaattaattaccatcacctgctttaaaaggtagacggctaacatcaccatatatcagaataagaggctgaggaggaatcatcagacatataatttgtaaagaagctgatagaaataatgcatggtattataacagaaattaaaagctacccctaaaatactaatagttgataagaaaagacaggtaggttaacgaagcaatccaggaaacctaacagtacaaatgctctaaggctcttcctttgttttgcagattctagagaaagtcacagctttctacagctcttatataaacaaaagccttggtgtgttatactgaggaaattatttgtctaaagcaaaatgttgtatccgtaaggctaatacttagagtcagaaggggattaaccatgaagcaagcaagtttaggattgaaagtctctggcttgcacgggcccctgtcaaggcttcattcctatttttccattagcagttattcgtttgttggtgtttttaaaaaaataatagccgtatcccttccccaaattttataagcttcaagccccacaaacctgcatctacctctggtttcggtaatcggtttttacttgtgaaggaaccaggtatagttgtcagaggtgtttgaacaagagcaactccatcttgaataagggctggttaaaatggggctgaaacctactgggctgcattcccaggaggttagacattctaaatcataggatgaataggaagttggcacaatgtacaggtcataaagaccttgctgataaaatagcctgtggtaaagaatctgccaaaacccaccaaaactaagatggcaatgaaagtaacctctggtcatcctcactgctcattatatgctaattataatgtattagcatgctgaaagatacttccaccagtgccataacagcttacaaacaccatggcaacatcaggaagttaccctatatggtctaaaaaggggaggaaccctcaggtccaggaattggccaccccttccccagaaaactcatgaataaactaacccttgtttaacatataatcaagaagtaaaaatacatataagcagctgagcagcccatgccactgctctgcctatagagtagccattcttttatttctttacttctccgataatattgatttgcctcaaattctttcttgcacgagatccaaggaccctctcttgaagacccctttccagtaacatagtcagtaccaggtgtgactatggagcagcaaactaaattttatgtctctcttaacttctctcttccacgtatctctctttcaggctcacatacactccctctctctctccttctctccctctcctccctctccccctacctatcccccatctctgtcactgactaagatggcctgtttctctcagcttgactaaactttagacaggtttgttcctgattataggcccctgaattctctttccttagggcatttatattagaaaacttgcaattataaataatttatcctcccctttaagacataaattttgtttcagcctcttgccagttacacaacttagaaaagtcttttttaaggacctaggagtcatacctttgaaatataatcatcaagaaagatagaacccctatctcctagtctctgtagaacagctggagccaaacttcactaagtaccaataagaaaacacacacggtctgatatggtttggctgtgtacccacccaaatctcatcttgaattgtagctcccataattcccactgtgttgtgggagggacccggtgggagataactgaattatgggggtggttttccccatactgttcttgtggaagtgaataagtctcacaggacctgatggttttataagggatttcccttttcacttggttctcattctgtctcgtctgtcaccatgtaagatgtgccttttgccttctgccatgattgtgacgcctccccagccacatggaactgtgagtccattaaacctctttttctttataaattacccagtctcgggtatgcctttataggcagtgtgaaaatgaactaatacatggtctaatcacattgattaaactctggcctagtaccctccagtactatcctattagctcacaccagggcttaaaaactctcccacattttatttaaacagagttgagctcaatctctctcccctactgcaacagtcttaaataaagtcatccttgcctgtttaagtctgtccattgcaattcttctttgacaattcatacatacaaacttttgttttgttttgtttagacaaagtctcgctctgtcgcttaggctggagtgcagtggcgtgatcttggctcactgcaacctccgcctcctgggttcaagcgagcctcctgcctcagcctcccgagtagctggaatcacagtcacctgctaccatatgtgactaatttttgtatttttagcagagatgggatttcaccatgttggtcatgctggtctgtaactcctgacctcgtgatctgcccaccttggcctcccaaagtgctgggattacaggtgtgaaccaccacacccggccacaaactgtttttataatgctgtagataaagtgtttagttctagtgcgtgccaatgtcggttttttcctcagattctttaaccttgctcctctaccctaacccaatttttcacttcctttgtttgttcacttaaatcttactttctctggcattcctagctataaaaacttgatattctatatcactgcttcctgtttgtttcttatacagtgttcaccacaaatagtaattactgtatttgttgttcacctgtctattacctggttcttccatgagatggtatgttccatgagattaagaactatattggcatcgttcactgttttgcttttctttaatcctcagaacatagcacagtgctctaagacatggtatatacttaatgaatgtttttcaaataaacgactgaataaaatacatcaatagtatttttctaatcccaaatcataggctccataattcacaaatgttaggaaggttcaatattccttggggatcatggtcacaagagaacaggcacaataggtgattgtggcatgctggttacatggtcacccctggacacataaataccattactgagaaaagcactaggggaatggctaagggcctcattcacctcttcacatccaacaggcttgctaaggtctgaatgcaatttgtgtctctccaaaattcatttgttgaaaaattgatcttcaatgtggtggcattaagaggtggccatttgggaagtgattaggtcatgagggctccaccctcatgaatgggattagtaccattacaaaaaggcttgttcacctcttctgctatgtgaagatgcagtaagaaggtgccatccatgagaaacaggccctccctagacactcattctgctgctgccttaattttggacttcccagcttcaagaactgtgagcaataaattactattgtttatagattacccagtctaaggtattttgttatagcagcccatgtggactaagaaagtctgctaccatcattcccacctccagctgaatgagtattaagtcggcaggaagaagtcccgaaaaaatgtttaaaataggaataagctcaagaaccactggcaatgcatttcttccagctctgaggaagaatgaatggctttttcaagctcattttgtgagttgaggtggaaaatctctctcatttttatctacttctaagcttagtccaacagcagttctcccttagggggagtgtggaggattatttggcccagtgtttaattaccataggccatattccctttacagtcaaactggcaaattttatctcagaattttgtttgtttttcaaaaacagcagaaataagcacacttgtttttgtcatctttgtgctaacatctaattgatattatacatatatgggctttgtatggcaataaaacagttggttaattttagtttcatctgataaaatatactggcagctgttcttacaaatctgtgatgataatgtgaaaatcactcatcaataaaaaaagtcatgtgatatattcaatattctatcattaaacgtctagtgtaatgtgatcaacagaaacaaagaaaggaaggaaggcaaggagaaaggaagaaaggaaggaaggaaggaaagaaaaaaaataagagtggaagagttatgtgaaagtacaacatacactctcagcagccaggggcccagaccctcctttcagacttttggaccctgtgaatgtgtgcatcagaaagctcttagcaggagcgagaacaaatacgcagcaagaagaattgcagtggagaatattaaagaacatggaaaatcatatattgtatccagaggaaatcactaggaaaagaccctatggctcatagcacgtgtagtagaaatgagacaaccattctcaggtaagcaaaatgaggaaagttagaaggcagctgttacttgccttttgataagtagagatgggatattaacaataaggtatccaaaaagtaaaaggctgtctgtaatgttatttatatctaacattatggaaagtccaatgtgttgtgataattagaatgagagttggttgtgaagcaaaaagaacaaaactaaatgaatagcagaagaaatatgtcagacattttcacaaccaaacatatgccttcagcatccttgtagaatatgttgttcttatctctaaggggctggttattattgtgggaactaggaagagaagaggaatttttagaaagattttttaaaaagtccatctttgaaaaaaaaaaagcagaatgacggaaataatttagaatgctaaccttaatttaatcttgggaatggcataaaacaaatcattaagaaccttaaggcactaagcaaaacattaggaaagccataatgtgccaaatttccttaattttcttcattaagggagtaatgcaatgtacataaaaatatgtatataatccaatggaactcaaataagttataggattcttccagttaactattttagtaagccaagaatatcatctcaatatcatacattgatcaggttacaagatgtcagtaggtcacagtcaaaattctgaagatttattgttgaaagacaaaaatagtgagagacagtgagtccttctgggattaatactggtgccatttgacaaaaaaataatatctaagaaaacagtgaaaattaatggaatacattgaatggccttcacagagacttctcaggttctcaccccatccgtatacgagctaggccttatcccttacaagagcagtcccagtatttcttggtgtgttgctcatgttcataaatatttttgcatattcctttgctccagtcacttactaagacagacagaaggctcccaaatctgaaaccaagcctccagtttccaaaggagccgagatttcctaatagtctaattgtgctcagctcattttgcctctgtccaaaagtgggaagaatggttctctccatttctagtcataattctgtcccatggcacaaagcagagcttcttatttccctgtatctgacaaatactcccttcaaagcagtaccttctgcctgttactaaaccccttctctccatatggcttaacttgagggcttgggctaataaggtaggggcacacaccacgctgtctcttcggccaagtcattatttcttgtcatgtatatacaagttttgctcctgttcaatctaaaatgctcatgataattgactcctggtacaacatgcatgttcagacttgtttgagccagggcttcggttcaagccaggatatccaagcatacacaaaaattctttatataattgcacttgctattctctctgcctggaatagtttccttcccactctccccttctttcactcatttaccactgcaactgctacctcccccatattctttatctggctaattttaacttgcccttcaagacttcaaacaggcatgaccttttccatgcagaccatcctgaccccaccctgaattagatagccatcctctggggttttatatcaccttgtgcatatctctatgaaagcacctcacctgtgtatagctctatgaaactttatttgtctatttgtgtatttagctcttccaatagacactttcttttaatttttatgtatttatttcaacactttattttttgagcttgctatttactgaattctgcgcccctagtgttcatctattgaagccataacccccaatgcgatagtgtttggagatgaggtctttaagtggtaatcaggtcatgagaatggcaccctcatgatggaattagtaactttataagaacgaacaggagagaatgctctctctctcttctcatccacacagagataaggcaatgtgaatacacagtgagatggtactgcctacaagtcaagataagagacctcagaatgaaatctatcttgctgacactttaatcttgaattcctcagcctctaaaattgtgagaaataaatttctgttgtttaagccactcagtctatggattttgttatgacagcccaagctaagacaaagagcagttttaggtttacaggaaaattaagcgtaaagtacagagagctcccatatgtcacccatcctctctccacaagttttcctcattattaacatcacacattagtgtggtacatttgttatcattgatgagccaatattgatacattatattagatggtcatatttttaatctccatatccctagaccctaagggctgtgcttggtacatggtagatgtttactaaatactgaatttagtaaaagaattatacgaataaataaataaataatggctctgaaacacttgattcacccaaaatgtgatctgttattgtgaattactgatcaccttgactgtgacacctggacatggtgggcaggtctaaagctgagccccaacttcatgccatcttttaacatcctgtttcttttatgcttaatgctttgtggtatactcttctcccgttctcaccttccaggacatgtggtgttcaaaagagtgaccacaaattttggattagaaaaataatttaggtaggttttaatatgaaatttcgtaattcattctgcctcattcaaaaaataagacagattttcaagagacatgaagatctggtaggatactgttgctatttctaactttatttcttaatggttataaacttaaataggctaaattttctttattaaacctgtgtgaagttgacattgttttaaaaacaatgtttcaaaatatttattatttattaagtaatctaataatttcataataattttaaaaagtattcaactgaaacaaaagagtttattcctttccaggtctctttattggtgaggggtaaagaaaacccatactttctcaataaatcttaaacattattaattaaaaataacttttagttcagtctcataatttgtggccaagaatatagaagcaaacaacttctatattttatatgcaagaagaaaagaacaaaaaccaaataaacaagcaaaaaacttaaatctccataaccttaattaatcaagtagagttgaaaatgctatctatgctaaatatgaatctgttctaatcacttctagaaactgggccctaagatatgcaaagtaaatctctcaaaacaggagtacattttctgatgcatataaattcttcccacataactaatattgttacagtttttcttttttgttttttggagaagaagtctcactctgtcacccaggctacagtgcaatggcctgatcatgggtcagggtagcctcaacatcctgggctctggtgatcctccagccttagtctcccaagtagttgggactacaggcacacgccaccatgcctggcaaatttttgtaatttttttagagacagagtttcaccatgttgcccagcctggcctcggactctccggctcaagcaatcctcctgtcttggcctccccaaaatgataggattacaggatgagccaccattcccatcctgatatactttaaaaatcacataaaggaaaaagaaacttttttggaattgctgatcaccttgcacatgtcactaacctggatgtggtgggcgcatctaaatctgagctccaacttcatgacatctcttattaaagagtctttttgccttacctgatttttcaaaggattatctaaaacatttgtagataataaagttcttatattgatctttcattaaaataatcaacctaaatgccaaataaacttacgttaacctgatacctaattaattaaagcacacagttatgtgccatttaagtaaactctgaagaaaattctctgatttttttaatagactttatttttcagagcaatttaggcacctttcaatctctttttagaattttttttttctagtccttgcttaagacttaaaaaatcctgaaaagtagatagtaggcctggggctgtagtttctattaggttgatgtcaaagtaattgtggtcttgccgtcactttcaaaaccgcaattacttttgcatcaacctaataatccaaggcgctacactgagcttcctctttgacccttacctggcctgagactcacatggaaggtttctctggaagtgaaaacagtaatgtaccaattctctaataaacgaaaaagacatggtcttaatagaggcacacatattttgtggtgaaaatttcttacaaggacacttctcaaatcatcctagggtggtactatctattcttgaagttggccttgttgaaatgggataaaaattaagtacagaaaaaaaaaaaggcagggggaatggggaaaaggttttgtaagagccaaactcaagacagagatgggctcttataagaatctgactggttcctctcatgaaaagagaatcaaatgaaaggaaatgaatagagtttgattgaaacaagaaccttatttagtcataagaattcaacgcatgcctggaggaattcataaatccctaagtaggaaaacctgtaaaactctggcccaggaaaagtccataggaagtgaatggttaaagcacatatcagcgtggggatgggggctgactcaatggtctctgccttgttttctaggtctgtgatctgatgattaaatgtaatcagaaagaaggggatcgggtaaacatcctcactcctcaaagtttaaagctagatgttttaacaagaaaatgaaagtgttatgattcagagatatttatctttaatttctgcagttttacggatcaaaatccagctggtctttccaaaaatcagtcagtaaaaagaagagacacatccacaggaaacatcacactagaagctttctaacaagttgtgagtcacacaaaaagaagaacaattaagttaggcaaacatcgtgcccatgtctttgtgttttaacaattgaaggcagatacttacatttgggaacacagttgattaaacaggaagaacacttgattcaataaaaaatatctacagttgctgtaaagcttctttaaaagaaagagacctttcagtgtaagggtaatgtaggtcaactagtaattgtctaaggacacatcagacatttttaaaggacagatttgtataaggttaatctaggtgggaggctaaggtacattcaaatgtaaatacaaagatatttaggacaactgcatggcaaagtcaagccacaatggtaacttgatggagctgataagggaagatacatttttcttcttcttctaatccagtgataactacttagttttcaaaatacctcaaatgaaaaatgtacattgttattcaggaaattaaaccaaattgaaaaccagtcaatcctcaagtgtgcatattaaagctgtgacgtactcttaagatatttttaatgaactttcaaaatataatcacgtcagggccgtgccatatcctctgatttatgcatacacagttctttaaaagtcatacaactactatgtaagatattcgaacggggtatcatcattgctccaaatgacttaaaaactgtacatgagcagacattctctcagtgcattaaatctaacattatattcatttgaaaagcgcaaaggaaatgaaaatattgcttacaaatgaccttattatacttttgtcagtctgctgtttcataaaagaaagggaaccatgatactggggcacagtaacattagcaaaattatcaagaatttatctaacgctgatttatatttcagatttgaaaattagattacaggcttccccttgtgctgcagtttgcttctttgtaaaagcaggagctgtttctgctctgaagccttctctgaacatagagtagcttccctggtgggtgaatgttgtggacacatacatgttacctactgtaagaaatttaatgaaatataagaaagaagatggcctgagagctttcaatcttataagcaaataagatacatgaggaaaaaaggtactatgagtgacgaaactctatttgtaaatcctgtatttatatttcttctgatggcaaactagggaactaaataatggtacaattatttaaagacactattcagccaattattatgtctatttttcaattgaagcctagttaatgaattccactagaaaaatatccacaacgtatagttcaataaaatagtatgggtttaggtatctaaaatcatatactttaactctgtgactgctttttcctctactaagtggggtttttatgaggaaaaatgagttaatagtaataaggcactcagaacaatgcctggtatgtagtacattttaaataagtgttttccgtagagaatgggactctagtaggtttgggtggcgtagtggttatgtaagaactctctgtggagtcctatgcttactggaaccatgaaacagtggcaacattaaagggaatgaattgatgtgcttcaaggagctgtcctgtcctactcatgcccaaggcaggtattggagcaccacagtcatgaacctgaaatgatcctggggtttatgacagtgggcattgtgattgtattcagacagctatgaagagaggattcccggaggccttggccccatttaaaacaccagaattcaggcacaaagacaaagcagggataatgagacttgttaggggaaacccaggaatgactgagtcagaattccctgctaggccagtgagatagaggccagggttagaaattaagttactttagagataatagaaatgtgatgtttcttgcctatccatattggtggaatgaggttcatattcactacaattataattatttttaaattccttctcttcctctagttagctgttaattctgatctacactctccatctcttctgaggcagaggatcaatgctgaggcttaggagggagagctggtgtcacattctcaatacatgtcaaatgacaggtggaaacaacagaaagtctagcatttaaggtattgttacattccatgcatatttgtgccaaggagtgcttcatatacattgtcatctaagagaagaatgaatatagagaggtcttcacagaaccctccagggatctcgcattgtagccctagggcagtcacttcaggcaagacatttctttgtaatcatctgttacatgtgaaaaacatacccaaatttcatattctactgcacaaaatatccatgctttccatatacataccatgctaagtgttcaaataaaacagatattccaggaagatgggcttatccagaggatttgtgcacattgctctggggtttccttaacaagaatcttaccccagtttgagaagcatattcttttgttttccttaaaaatatctgaggacttttttaagattatagaaacaacatatgccaacagtcagtaagctgaaaaatgttaaaaagtagtaaaacaaaacaataaagtcaaccatgatccaaggataaataaccactgacatttttgaaagcattcaaattttaaaaatatgaattattggctgagtaatattggcatggatgtacaacagtttatttaactattcatccagtgaaggacatttgggttgtttccagtttttggatattacaagtaaaactgcaatttacattcatttccaggttttcgtgctaacataagtttacttttctgttagatcaatgctcagtagtataattttagatgtaatattgtaggtttaatttcttttttaaaaaaacaacctgacagatttccagagtggttatacaattttacattcccatcagcattatatgagagatctagtatctcaacatctttgccaacatttggtattatctttaattttatctgttctagtagatatgtagtagtgtcacatcatagttttaatttgcattgctctaaatggctgaacataatttcctgtgcttacttctcatttgtatatattctttagaaagatgtttaagacttttgcttattttccaattggattatatgttttgttaatgttgagtttagagagttctttatatattattaatacaagtcatttgatagaggatttggaagtatttcccctcaagttggtaatttgtcttttcatcctcttaacagtatcattcacagaacaaaagttattaattttgagaaaatccaatttatccattttttctttttggatttctttttggtaaatgtaagaaacctttacctgacactaggtcataaagactttctatacatcctttccagaaaattttatggttttatattttacacttagatctacaatccactttgagttaattttaaaataacatcagttttaggtcaaacttcattctttggtctactgctgttcaatggttctagtactgtttgttaaagagattcttcttccattgaactacttttgcacctttgcagaaaaatcagttgggtaaatgtatgtgcatctgggtttagaagcatggttgtgataagctgttcgtttaatcattaccagtgcaaattgtggcaaaaaaaaaccacctcattttccatagcaatagcagatttaaaatattttgcttattactagaatactttttttaaataaaaatttgaatatttaaaaaatcacaaagacaattttgagctgaccacacatatcacagaattatttctctcagtaattctttacatagacaactgttttgaagtactaaaatttgaatcaacttattaaaaattttacacatagcttttcaatattttaataattttaattataaatgaacatatatactttcatattataaaaataaaatataaaagcataaatattatatatatagaatatgtatatagagaaattcctgaaagcacagtgttatattttatagaataatagtagaattatgagaaaaacactttctctctttgtgcttttctgtattttagacattttctacaatgcttatgtattatttaaaggtaattgctaggttgtggtaggaaaaacgaccctccaaattaaaataaaaaattgatattaaaaataaaatacaattaaacaaatcattttgtaatcaaatgtaaacaaatcattcaacaggaagcagggcatgaaagtttggaaaatctgcagcccgaagatgtgatagaaaataaaattccattttctgaagataaattcaagccagctgcagaaatttgtataagtaacacggagccaaattttatcaccaatacaaggggaaaatgtctccagggcatgtcagagacctgcacagcagcctctcccataacaggcctgaaggcctatgaagaataaatggtttcctatgcctggtctagatacccattgctctgtgcagccttgggacatggttccctgagtcccagctacttcatctccagccattgctaaagggggccaagttacgggttaggtcattgcttcagagagtgccagccccaaactttggaggcttacatgtggtattgagcctatgggtgcacagaggtcaagaattgaggtttgggaacatccacctagatttcagaggatgtatggaaatgcctgggtgtctaggcagaagtttgctgcaggggtggggccctcatggagcacctctgttagagaagtgcagaagggaaatgtggggtaaaacttcccacacagagtccccactggggtactgcctggtggagctatgagaagacagccactatcgtccagaccccagaatggtatatccactgacagcatgtaccatgcacctggaaaagccacagaaactcaatgccagcctatgaaagaaccgagaaggggagatgtacctggcaaagccacaggaacagagctgcccaaggccatgggcacctcatgcaagcccacctcttgcatcattgtgtcctggatgtgagacaggagtcaaaggagtttagttttgacctttaatatttgactgtcctgctggatttcagacttgcatggggcttgtagcccctttgttttggccaatttctcccatttggaacaggtgtatttacccaatccctgtaaccccataatatctaggaagtaactaacttgcttttgattttacaggcttataggtggaatggattttccttgtctcagatgagactttgggtttggacttttgagttaatgctggaatgagttaagactttggggaactgttggaaggccatgattgtcttttgaaatgtgaggacatgagatttgggaggtaccaggggcagaatgatgtggtctggctgtgtctccacccaaatctcatcttgaattgtagttcctataattcccccatgtagtgggagggaccagtggaaggtaagttagtcatgggggcattaccctcatgctgttcttgtgatactgagtgagctctcacaagatctgatgggtatataagaggcttttccctttttgctcattcttcttttctctgctgccctgtgaagaaggacgttcctgcttccccttccaccatgattgtaagtttcctgaggcctcctcagccaccctgaactgtgagtcaattaaacctctttcctttataaattacccagtctagggtaactttattagcagtgtgagaacaaatgaatacaccaccccctcatccactaacatacaaagcaaaattaacaaacaaacaaacaaacaaacgttaaaatgatgccagatgggagtaaactcattctccaagagaatgatactcccaagtattgtcttggagcacagcctgaagcatgctctctaagcatgaaatacctttgcagtctcttgttttatcttaaaatctaatgagattctatttactcttcagtcataacaaaatgtccttatatgtccttttgctaactttgttaacccctttttagaataggtaagttatattatcaatgatcttacaaataaaattaatggattatgtctttaatggaactaatattaatgactactactaataataacagtaaacatttattgccttagaactaggctgtgctattttcagttcattatccattttaatttccaaaaaactatttatagtaggttgtatttagaaagtgaaaattgaagcttagtttctatgtctaaaaatgggataataggacttaccatatagattgttgtaaggttaaacataattgtacattgaaaatgtttatttgaatgattagcaaaatagtaagctctcagtgagtgttcagagttgcctaagtccagtagtatggtggctgtgaatatttttgaatgaggatactttttaatgtcaacatattttctgaacctaacttaaattaggcccactaaatagtaatattaggatctatcgactgagaaaatacttaaatataaactctgagttcagtgatgcttttaaataaatttttactttaattatcataatgaaatctgcatatacttgaaaaccagtagtgaatattatttactgtttccaggcaatggtagaaacaatgtgaagatctgttattagaacttcattcctacaggagtcaaagttaggaagctgtgtttgtggtagtgaaaaattctggacaactctgttgattggagcccctttatttaagttctctcctctgagcctgtagcctgtttagccataggtgcctactggctttacttgcctctaatgatcttgcaaagcctggccacttcccctccattatcctgcttcacagttgaattctccttcaagaagagtctggtctgcaactctgctgctcagtaaaacaggcaaatactgtatatatactattgttttgccatcaggaggaatagaatgatagtgaagagcacaaattctgttatcaggtagacctaaggttaaattctgacactagttctgtgaccacagggaaactatgtaatttatctgggtctcagtttctttgtatacataagatggacaattcataactcataaagttagtatgaagattatattagatagttacataaagctttgaagcacaatgtctcgtatataataagccctcaatactgctagctgatttgatgcttttacaacagaaaatagcacagtgaaacatatatgtgtgcttcatggaatgcataaaatcgagaacacattacattctttctggatggggtataaaatgtttgtaattatatgaaatttgatttgaagacagaatagtaatattccaacatatatcacactaaaataaatagaacagtatttatttttgaattcttttgagaggtaaggggaatctattagcaaaaaaaagaaatttaccatattctttacaaattttctgaacaagagtgagtaaaagtctcccctttgttggtttattcaaaactcaaatagtggatgtaaatgagtagagtttggctaatttcttagtagtgcaaagcaattccaggaaaaaatacttcatggaatagcagtctgtctttggaacatgaagaagtgggtttatgatgctcattatagaaaatacgtaaaactgtgaacattttaatagaaaaacttgttattaggttactcagcacagtaatagatgaagtaatcacatggatattttagtaacggaatcattccttcttgtcatttattttagaaaatctagcaataaattcaagagcacagtgtatcttttccccattctctttaaagggcaaataaaatgcatagcattaaaacaatctaatgagtccttagagaataatgcatcatgaaacaaaaaactaaggcaagcaaggactagtttttctttacatactgttatctggattgtttaatgaacaaagaaagttgactaagtgaaaaaacaagttttccgttgatataaatctttaaccaattcaatagatatgcctgggccattttaaaatccatctcttacagcacataacaaaaaactaaaatttgcaattttaaaaatttatttttaatatatgctgacaacagtgaatctgggaaaggtgttttggcaatctaataaaacacaacagaaagagatgtttttccacctactgtgttaccagtcattttggtcatatgttatattatgttttactatcaagactcacttaaattaacttttcattgttacaataatattatttcacaaaatacaactctgtgatggtgacttctaaaacaaagcaaagacaaaacattagccaagaaaagatgcactttacagtgatgaggactcaactctccatgaaagcagctaataaagcacatgggaaaaaatatggcattaaatacaatcagaaaagatgcacttgtacagtatttgccattttctcaaaagaatactcagcaactaaatggataatagttattaagcttatgaaactttacctattacaaaaccctttttcaaaatttaaccatatttaaccactgtgagaaccatatagcgtgtgtttctaactttcacacagtagataagtatcctagactggcctcctgactcaaaatctctaattgtttccattctaccataaggttcacagaaacaggtcaactttagcatccctttactggaaataaaacaccacatacccacaatgcattgtttaagttttcactaacttcagattctctctgtgaccaataacacatttaccaccttctttttatcctataggggagagttaggaagattcatgagttaggatgaatgctcaagccttctttacaatgtaattccaaataccaaaaaaaggaggggaaaatgttgcttaaaacttatggggaaagttctccttcttctaagggaccgtatgttaactctcttctctctgaaaaatgctgactataaaaaatactttccttttctcgaattcaaggaagtgcaaagcaaaatctgccacaaacctctcgctgtctatatagctagtatgtgctctcttttgcctgctgtgtttcaaccctgtcttctaatctatgttgttacttgtccttgatcttttagtgttcatattcccatcgtcatataagtatttctactgtaagatgcctcaaatcctacatatagacagaaaagaaatagtccaacaaacacgcaaactttatcgctacgtgtcatcccatcccctatgtccacccgcaattatggagatgtacaattctagtctcagtcatgctgcagtgacccaccagcccaccagcagtcagtggtactggaatctcaaatctcttgtcaggtatcctcgtggctgcttttcagcttaaggcctttggtgagatctgggtatctcttggcttggcttcctctcatctacaatattagacttcaattctatgatatcttagaggtttttccatcatgtaataacctcagaaaagtactgcagtatatggggtgagtggtggtggggaggaggactgaaactaacttctcctagaggagtaaaaaacttacaaatgtagtttaaacataatttaatattatttgaaaatgactctacatggttaaaacatactcttttttctcctttagtaaaaggaatgaccagaatgaagacattctgttaagtgagcattttctcctcatttaaacaaaacaataacaaaaacagctagaattggtctcgctgttcctggtgatcaaatccttccatttgtttcaggtgagtggctttatcatgagacattcactggcagcaaaagcctgctgctgggtagatagtgatttctaagggattgcaaaattggtttaaacatctgctctaatcaaaacccagggtttccatatggtcattttataaagcatatgacaatcacctttcatagtatttcacactgaggatttaggaaacaggatagcctgaggtcaaacagataagtgttgtctgtttagaaatctagaatatccctcagggcaatcagggtaatgggtcatacaatgaagcatcataataagacaatcacaagttaaacctacactttgcttatagtttatgacataaattgccaatagcagcaaatgctgttgataaacacacgcaaacatacatatatacattcctcacttcaaataaacaaataaacaaaaaatcatgctcatctcttccgtttcttggactgcagagctacgggtctgcctattctgtattgaaattagtataaaaatactgaaaagaagtctaaggtaaatattttgtgttttctggcaaatcaacaaagattgttctgtatacatagattgtcctgtataagtactgatagacatcgtgataaaagtactcttgggactgagatgaaaatttaaactcagctttgagactagttactgattacaatgactcaattaacataataggaaaaaacatccatattcttgctgaaaactatttaaggatcttactcaggtacctgaattcttgagaccttagacaagaaagtgcaggtcaaaaatgtagggaaaaaatttgggcccacctcttctcaccatttctataggacacatatgaagagtttctatcagctgccattagctgtggggactggaaatcatggagatgcctaaacgcgacattaagtttggagagactgagaattacttggtaagttaaacaggaaaccctccaaataaaatgtctccattaggtggcagggaggaataattgagcctttcttgctcaaatgtcttaaggcagccaaagctgactttctaagggaatttttgaacaaaaatgtttctcctgcagccagtaatgtctctctgtgtatctcgtcccccagctctgcaaactactgggcccctctaggctatcaacaaaagtttatgataaatttaaacattaatgattcagtaaataaattttaacattattggtaacaaaaaaaatgacagaagagtgaccctacataattattcacaaatttcatttaataacagaaaaacaacctggatctttttctataagaatgaggaggcagaaaaatcaacagagaaaatgaaaactctcagtagttcaaaagatggggatcatatgagcactaagaaaaaatatttccagcaaaacagggatttaaagaagcaggagagatacctaaaatatatggttatgttattaagtgaataaagtggactgtaaacagtataacagtaaaacagtaactgtatataactgtaaaacagtataaaatcatgtttgtgaaaataagtaatgaaaaatgagtatgtctatacattcatgattaggacaaaaagtatctgggtatatatacatagaaatatggagactgtgtattcctgaattgtgggattagattatttttattcttttctgtttgcttttgtggatcaaattaaatttatgtgtattaagctttattctcagaaaaagggtcattcaattttaaaatatataaataagcggcactagtaaaaaatatccactctcaaaaagaaaaatatttgtttgaacacagatggtttcagctaataaagactcaaggatttaagaaattataccatccatcccattgtccatcatttagcttagctaactccggaatatagcacccctagcttagcaaacagtttacctccctagttccccaactgcaccaaagcatcttagggtgttgcaataaatccacaaaggagccacagattatttttaattttcaaagaaaatacagtaatactagacattctgttggatactgtacaaaatattagacagtggtagttcactgactcaatataaaatctggcatcattccctttgatagtgtcttatctttgtgaagctcggcttttagtggctgacgtgttaagaaaaaaaaaaagaggtaccccttaagaagtaccttggaatagggaatgagggtggcttccattctgattctaaggtttgagaaaccatgtagcacccaacagggacacacctccagccagtaattaattgtggctatttaagaattgaattaaatatattttttcttttaattcatatatttttttcaagtggttactaagggcctaagtgcataataaataaaattgtgaaatatctcctttgccatgaaaatattactgagacactaagggtatcatgaactgaaaaagtttgaaagcctttggtcaatccattaactagtacacatcaaactgctagaacgccagaatgacctctcaaatatagggtaacctattgcagctttatatcaaactagcaggcctggatcacttagtaattgcaattgaacttgatcatagtatagtgttgttcattatataatgttgacctactcaagtttaatccctctaaaatttcatcacaacatgggccttttgaaggatgacttcagaaggaaaacaagttttaaatgaattttagattgccttcaactcacatttgagttttgtccagtattctttcaccaaagcaaactcttcttgactctcattgtgataaaatcactactgtggcctacacacgtggctcattatgtataaaatgttaatgcttctatgactcttgagactgtcaattgctcagtagtgacaatgaggaaggattagttaaaataaatgtttcctaaacaaaaatagcaaaagtccttatataaacaacacccacataatgtatcatgacagcgatcccattggaattgcctaatttaattgacaaagaaaaagatttataaaaaataactttgctagacaaaattatcactaaataatttggataactaaagcatcatccacagatttctgatttatcagaaacaaagaccatcatttaaaaaagcttttattttaggttcaggggtacatgtgcaggtttgttatataaacttgtgtcacaggggtttgtggtagagattattttgttacccagatactaagcctagtacatggttactggtcctctacttcctcccaccctcagtcttcaagtaggccccactgtctgttgttcctctcccagtatccatgtgttctcatcatttagctcctacttatatgtgagaaaatgtggtattcattcccgcattggtttgctaaggataatggcctccagctccatccatgttcccacaaaggacatgatctcattcttttttatggctgcatagtagtccatggtgtaccacgttttctttatccagtctattattgatgggcatttgggttggttccatgtctttgctattgtgaatagtgctgcaatgaacatacgtgtgcatgtgtctttagagtggaacaatttatattcctttgggtacatatccagtaataagattgctgggtcatatggtaggtctcttttgagctgtttcaggaattgccacgctgctttccacaatggttgaactaatttataatcccaccagcagtgtataagcattcccttttctccacaacctcatcagcatgttatttttgattttttaatagccattctgactggtgtgggatcatagctcattatgattttgatttgcatttctctaatgattagtgatattgagtcttttttttttcatatgcttgttggccacatgtatgccttcttagagaagtgtctgtttatgtcctttgtatactttttaatagagttgcttttttcttgtaaatttaagttccttatagatataggttagtagacttttgtcagatacatagtttgcaaatattttctcccattctgtaggttgtctgtttactctgttgataatttcttttgctgtacagaagctctaaagtttaattagatcccatttgtcaatttttgaaaagtgtcattttttgcagatacaaaatatgttttatattctttcccaagggcaaataaatctttaaggatataggatgtgaatccatggttacatttaaaagaataaaaatagaaaattcctacaaaggattttacaaaatataaaaatttgcatttaattcagcaaaaattattaaacctattatagcctttattggatatttaaatattcctagttcctatgattaaggcccttgcatttgaggaaacaaacactagctagacccattacaacgggctctcaggaaagtcatctgagtaaaaggaagagatatgtagctcaaccctcctaatatatatacatacacattgaagttgacctggcagagagtgatacacacacacacacacaaaaccaagatccataaagataaaagaagttgtcaatacaatccatcaatccatttatccatccacccatccattcatccaatatttagtgacagtctcctctgtgctagatatcaatttattcattgaagataaggtcccttctgtcattgaatgtgcagtccaatgcacaattttcttagttacatgttcgaataagctaagttgctcaattctgaaaatcttaatctccagactccactctgtaattcattaaacaagaatttctagggtattacccaggcgtcattattattttattaaaggtgtgcagtaattccaatgtgcatccaaggttgagaaccacttaagtgggaagacagacactgaccatataattacaaatgccctgagtgctgagtactactgagaaatgtcaagtctcctgtctagctcaaagatgtttctactatgttgttactgcctctcttgagataattagtattatcatttatagaaatatcccattaaaaagatttggatgtaaagaatgtcacttattttcaacactttggagtataagctattctcagaagtattttagaagctttctaggtaaacaggtcataggattgtaggtatagtgaatataagcagtgattgtaatctaatgaagaaatattttcatgacaaaaatgctgttcacggtggaggagccaagatggccgaataggaacagctccagtctacagctcccagcgtgagcgacgcagaagacgggtgatttctgcatttccatctgaggtaccgggttcatctcactagggagtgccagacagtgggcacaggtcagtgggtgtgtgcaccgtgcacgagccaaagcagggcgaggcattgcctcacttgggaagcgcaaggggtcagagagttccctttctgagtcaaagaaaggggtgacggactgcacctggaaaatcgggtcactcccaccagaatactgcgcttttctgacaggcttaaaaaacggcacaccacgagattatatcctgcacctggctcggagggtccaatgcccacagagtctcgctgattgctagcacagcagtctgagatcaaactgcaaggcggcagcgaggctgggggaggggcgcccaccattgcccaggcttgattaggtaaacaaagcagcctggaagctggaactgggtggagcccaccacagctcaaggaggcctgcctgcctctgtaggctccacctctgggggcagggcacagacaaacaaaaagacagcagtaacctctgcagacttaaatgtccctgtctgacagctttgaagagagcagtggttctcccagcacgcagctggagatctgagaacgggcagactgcctcctcaagtgggtccctgacccctgaaccccgggcagcctaactgggaggcaccccccaccaggggcacactgacacctcacatggcagggtattccaacagacctgcagctgagggtcctgtctgttagaaggaaaactaacaaacagaaaggacatccacaccaaaaacccatctgtacatcaccatcatcaaagaccaaaagtagataaaaccacaaagatggggaaaaaacagaacagaaaaactggaaactctaaaaagcagagcgcctctcctcctccaaaggaatgcagttcctcactagcaacggaacaaagctggatggaaaatgactttgacgagctgagagaagaaggcttcagacgatcaaattattctgagctacgggaggacattcaaaccaaaggcaaagaagttgaaaactttgaaaaaaatttagaagaatgtataattagaataaccaatacagagaagtgcttaaaggagctgatggagctgaaaaccaaggctcgagaactacgtgaagaatgcagaagcctcaggagccgatgcgatcaactggaagaaagggtatcagcgatggaagatgaaatgaatgaaatgaagcgagaagggaagtttagagaaaaaagaataaaaagaaatgagcaaagcctccaagaaatatgggactatgtgaaaagaccaaatctacgtctgattggtgtacctgaaagtgatggggagaatggaaccaagttggaaaacactctgcaggatattatccaggagaacttccccaatctagcaaggcaggacaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagactgggggccgatattcaacgttcttaaagaaaaggattttcaacccagaatttcatatccagccaaactaagcttcataagtgaaggagaaataaaatcctttacagacaagcaaatgctgagagattttgtcaccaccaggcctaccttaaaagagctcctgaaggaagcactaaacatggaaaggaacaaccggtaccagccgctgcaaaatcatgccaaaatgtaaagaccattgagactaggaagaaactgcatcaactaacgagcaaaatcaccagctaacatcataatgacaggatcaaattcacacataacaatattaactttaaatgtaaatggactaaatgctccaattaaaagacacagactggcaaattggataaagagtcaagacccatcagtgtgctgtattcaggaaacccatctcacatgcagagacacacataggctcaaaataaaaggatggaggaagatctaccaagccaatggaaaacaaaagaaggcaggggttgcaatcctagtctctgataaaacagactttaaagcaacaaagatcaaaagagacaaagaaggccattacataatggtaaagggatcaattcaacaagaagagctaactatcctaaatatatatgcacccaatacaggagcaccaagattcataaagcgagtcctgagtgacctacaaagagacttagactcccacacattaataatgggagactttaacaccccactgtcaacattagacagatcaacgagacagaaagtcaagaaggatacccaggaattgaactcagctctgcaccaagcggacctaataggcatctacagactctccaccccaaatcaacagaatatacatttttttcagcaccacaccacacctattccaaaattgaccacatacttggaagtaaagctctcctcagcaaatgtaaaagaacagaaattataacaaactatctctcagaccacagtgcaatcaaactagaactcaggattaagaatctcactcaaaaccgctcaaatacatggaaactgaacaacctgctcctgaatgactactgggtacataatgaaatgaaggcagaaataaagatgttctttgaaaccaacgagaacaaagacacaacataccagaatctctgggatgcattcaaagcagtgtgtagagggaaagttatagcactaaatgcccacaagagaaagcaggaaagatccaaaattggcaccctaacatcacaattaaaagaactagaaaagcaagagcaaacacattcaaaagctagcagaaggcaagaaataactaaaatcagagcagaactgaaggaaaaagagacacaaaaaacccttcaaaaaattaatgaatccaggagctggttttttgaaaggatcaacaaaattgatagaccgctagcaagactaataaagaaaaaaagagagaagaatcaaatagacgcaataaaaaatgataaaggggatatcaccaccgatcccacagaaatacaaactaccatcagagaatactacaaacacctctatgcaaataaactagaaaatctagaagaaatggataaattcctcgacacatacgctctcccaagactaaaccaggaagaagttgaatccctgaatagaccaataacaggagctgaaattgtggcaataatcaatagcttaccaaccaaaaagagtccaggaccagatggattcacagccgaattctaccagaggtacaaggaggaactggtaccattccttctgaaactattccaatcaatagaaaaagagggaatcctccctaactcattttatgaggccagcatcattctgataccaaagccaggcagagacacaacaaaaaaagagaattttagaccaatatccttgatgaacattggtgcaaaaatcctcaataaaatactggcaaaacgaatccagcagcacatcaagaagcttatccaccatgatcaagtgggcttcatccctgggatgcaaggctggttcaatatatgcaaatcaataaatgtaatccagcatataaacagagccaaagacaaaaaccacatgattatctcaatagatgcagaaaaagcctttgacaaaattcaacaacccttcatgctaaaaactctcaataaattaggtattgctgggatgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggccagggctattaggcaggagaaggaaataaagggtattcagttaggaaaagaggaagtcaaattgtccctgtttgcagacgaaatgattgtatatctagaaaaccccattgtctcagcccaaaatctccttaagctgataagcaacttcagcaaagtctcaggatacaaaatcaatgtacaaaaatcacaagcattcttatacaccaacaacagacaaacagagagccaaatcatgagtgaactcccattcacaattgcttcaaagagaataaaatacctaggaatccaacttacaagggatgcgaaggacctcttcaaggagaactacaaaccactgctcaaggaaataaaagaggatacaaagaaatggaagaacattccatgctcatgggtaggaagaatcaatatcgtgaaaatggccatactgcccaaggtaatttacatattcaatgccatccccatcaagctaccaatgactttcttcacagaattggaaaaaactactttaaagttcatatggaaccaaaaaagagcccgcatcgccaagtcaatcctaagccaaaagaacaaagctggaggcatcacactacctgacttcaaactatactacaaggctacagtcaccaaaacagcatggtactggtaccaaaacagagatatagatcaatggaacagaacagagccctcagaaataatgccacatatctacaactatctgatctttgacaaacctgagaaaaacaagcaatggggaaaggatcccctatttaataaatggtgctgggaaaactggctagccatatgtagaaagctgaaactggatcccttccttacaccttatacaaaaatcaattcaagatggattaaagacttaaacgttagacctaaaaccataaacaccctagaagaaaacctaggcattaccattcaggacataggcatgggcaaggacttcatgtctaaaacaccaaaagcaatggcaacaaaagccaaaattgacaaatgggatctaattaaactaaagagcttctgcacagcaaaagaaactaccatcagagtgaacaggcaacctacaaaatgggagaaaattttcgcaacctactcatctgacaaagggctaatatccagaatctacaatgaactcaaacaaatttacaagaaaaaaacaaacaaccccatccaaaagtgggcgaaggacatgaacagacacttctcaaaagaagacatttatgcagccaaaaaacacatgaaaaaatgctcatcatcactggccatcagagaaatgcaaatcaaaaccacaatgagataccatctcacaccagttagaatggcattcattaaaaagtcaggaaacagcaggtgctggagaggatgtggagaaataggaacacttttacactgttggtgggactgtaaactagttcaaccattgtggaagtcagtgtggcgattcctcagggatctagaactagaaataccatttgacccagccatcccattactggatatatacccagaggactataaatcatgctgctataaagacacatgcacacgtatgtttattgcggcactattcacaatagcaaagacttggaaccaacccaaatgtccaacaatgatagactggatcaagaaaatgtggcacatatacaccatggaatactatgcagccataaaaaatgatgagttcatgtcctttgtagggacatggatgaaattggaaatcatcattctcagtaaactatcgcaagaacaaaaatccaaacactgcatattctcactcataggtgggaattgaacagtgagatcacatggacacaggaaggggaatatcacactctggggcctgttgtggggtgggtgagggggcagggatagcatcgggagatatacctaatgctagatgacgagttagtgggtgcagcgcaccagcatggcgcatgtatacatatgtaactaacctgcacaatgtgcacatgtaccctaaaacttaaagttaattaaaaaaaaaatgctgttcacgtcatatgagttctgattaaaattgttaagacatatatgttttttaaattttggcttttaaggtgatacggtactcataccagtaggtttgggaaagatgaggatgtactatgttgcggttcattattaattttgctttattttatggtaattatgcaaattcatgttaacctattgcttcagaaatataaagcaaatatgacataagctaataaaaacttcacaaaatcctaccaatggctcccaaattacatatcaatatgatagtatgtaatagcgttaggtgttctagaacttcataattttttatgtgattttgcttctcaattctttcaattctcaaatgtagaaatcttcaaacagtaggagttaaggtgaaatttcaaaattcatgctcaagaaacatggggtgaaataagttttttaaacaatattgtcaaagctatttttgttactttaactatccccatccccttaaacacaacaaccctgtacacattttttctccttgtttgaccaatagaaaacaagttacacattttaaaacatttttatagctgttttttaccaatttgttctactgtatataagttcatacagaaaactcttttaatataacttcatacctatcatctcttaattcacaataaatttgacaggaggtatgttgttgtcagcagctaagagcagccaaataaaacctagtgatatcatataaaaaataaaatacaactgagacttgatcagcttgctgttgtgcattgctgaatttgtactgaaaactggagccttttcagtgcagcagcttttatcatgatttgacacattttaaaagaaatgtgctcacttattaaaggtgctaacaaacttacccaaaacattctaaaactaagtctaataggaagagaaattcattctaactttagtccacagaacattcatcttttaaacatagcagtctaatagacatctataattctacttacctgtcttaaccatctattttttttcttcattgccccaggttgtattataaatctcaaaaccgtaatctgtctctatctctctctgtctctctctctgtctctgtctctctctctgtctctgtctctctctctctctctatgtctctctctctctctctctctctctctgtctctgtctctctctctctctctctctccctccctctgtgtgtgtgtgtgtgtgtgtgtgtgtgtgtgtgtgtgtgtgtgtgtgcattgccttggaaaagttttttccccagaaataacattcgccccctaaagtgctgaacatttttgtattctgtaactaaatgtgttagacaccagctaaaacacacatatatttccacttctgaggtaacaacaaaagctttctcaaggagaacaagtgaaggtgggtctgcaaataatatatggatcctttctcacttcacaggtggacagagatccctagagatttctctgtacttctctggaacttggttctgcatgctgatcagcaggctccaggagggttcacagtgaaggatcgaaaccctaggctaagagagattgcttttgcgtagtatctgtacgtaatactcacactgtactctttgggaaatgtgacttgcattaaggtatctgtatgtgtgcatacagaaaaaacatctatcaccagaggtttgatttattgttgccagcgtgagtatcatcatgctacacaaatgtgcaagaaaaccttaaactgccccaggtgttgctggcttgaaagagagtgatacacatgaactgagagattatgtgatttccagattcccaggatgttacaatgacacttacagcatttagttagatatttaatcacttctagtgtctatacagagctattgatctagaaatagattatggaattatctccagaagaaagcaatcaattgtgaatacttcatccatgcagttgctaaaatgtcttaattgtcatacaactgccacaaagatatttgcttctggctattataaactaagcatgcaaagtggtccaatatacattacagatgtagagatttttttaaaaaaaatcattgaatatcatgatgttcctctagttccaagcaggtatatttctcaatcatttctccctttgtattttgaaagacatgacctcctaggtttgtagacccatacccatgagatattgtaacatgtataaactcaatcctccaaactcacttattagatattgttctttctggcagctacagaaactgtctctgggaaagttgaatgagtgccttattgtcactctgttggtcagtagcagcaaggcacaaactccaggtcaatctgtttaatcataaaattgctgcttttaaccactgtaccatgtagctgtttcttcatgggaaaaaattttaggttagataagaacttccacaatcctaagcaaaacgtttcagttgtaaggaaattgagaaatcacttaatcaaatgttctaccacctgaattatcccttttaccatatttctaaatgataatcacctggtctctgcctgaattatccccatgacaggtggtcacttctccactgtcagacagctttaattatcagaaagtgcatccttctattgagcagaaatcttgcctcccagaagctcttactattggatcctatttctaacctctggagagatactaagcaagtttacttcctcttccactgagtgattatattatttcttagaacagaaatatggggtaggggtaaaaacggctctgagaattttaaagggctacacactaacttcaaagtaaaaatgtttattaattatttaaatatacatatctaggctcctatgcaatcaatttcactaaatgaatgtggcaataatgcattcaagaatagaatatattaatattatttgttgtaatctatcccagaagcagagatcatggtgagcaattgggatagccaatagttaaaacagataaaatatatctagctttctaatttatggttctttcgggtttgcaaagtgagttaagcatacttattctataggcttaaaattaaccatctgccaaatggaaacagttggaaaatacaaccttttattagttaaacctctaaaagtctttcagatacagaaataaagcccaccccccccaaaaaagaaagcaccaatacttcttgatctttttagggatacaattctattatatggtctatgttgtgactaatttggagcaaatatttagtgtagaattaattatataaatcatgtataacactcatcatagacatgttggtttttctatatgacaaatattcaccccaaaatacaatcctaaatttgttgtgtttttaaagtgagacatatctttgattagaaacaactataaccatatagtataagcaagaattggggtatagatagtctatggaaacatttttacttagataatgatatttttaccctgaacaaatgaaaagcagaaatgtagtaaatgatatttcaactaataatgaggcatcatttttcttgtattctatagaatcactaacaggttcagtgttaactttaattttctgttaaagtttttataaacatcagagtgaagaagagtggggaacttatcatggagcattaattctacaaattttgtgcatggatttttcattcattgttcctagcacctagtagggaatcaatacatattagctacattgatcacatcaattaattaaatcaaataaatccaacaatttaaaaaatgtgtacacattcctgggatagaaaagggtaacttaattaagactttaaaaagttacaggtattttattgctttaaaatctagactaatttcataaaaagggtagatccagaatgattcatttttctctccatctagactattataactacaccaaaactattttataatttttagcttgtaaaacaggttagtaataaccataacagtaaaacttatcgagttgttactatgtgtcaggcactattttaattgatttactttaattaactaatttaattctatgaagaacataattattattatttccaattctagatgggaaaactgaagcccacgaagttaagttacatctccaggtcacagctagtaagtaaattctaatcaaggaagcctggctccaggattcacctcagccactgagcagtatctcctgtcatatattacggtgcctagctcatagcagactctaaatcattattttttaattgatcagtcacaaatggagagaataattcatgagatactgtgctgaagatatgatgaactgtaaccaaccccttttccacaggtctcaggatgacagccctttagtcaggcagctcagaattcagatacaccttagttttcaccctgactggggaagaaaagagttgagcccatgacctctggaaccaggcatatgggctacaggcagaaaatggaacttctctgtgcttcagtttcctcatttatgaaacggggattatagtgatgaagttggtggtggcagtggtacccagaccacagggttgacgtgaagcactacatacctggcacttagtaaacattctacaggtcttattgtcatgattacagctcaacttctttaccagacttccttcttagtagacaactgctggaggctagaaaatctttttattcattcaaaaaaataggttatttgggctgatttgcctgtcttgtaaaggttgaatccaactgctgctaagggggaatctgtgttgagtctgttcattctcattagctgttgtcaaggcttgataattccagattgttttgagacaccagagagattgaggagaatcacaggatgcaaatttccttgcgcaagatgcccttgaaaatcagcagttttgctgcctgtttcctttacctaacccaaacttctacttacaaaagaatcgactgcaaagaggacatctgtacctctcacggttttggataggggatgaacaaaaggctcttcactttgcaatgtaggggagaactgaggagaaagtccccctgagttcctgtcagagctagtcacaactgcttcattttttcattttaaccctcactggatgcagacagtgaatagaatctgggactagatatccagagcatactagactctctacttctatacagcataatttctggatcaaattaacatcaatcttcttcattgccaaacacaaaacaaacaaaaagaaaacattggtcccagagtaataccatttcctgtccccacacacaccacacacatacctgccctaaccctggccctaaaattacaaaaacacatgaaacaatttgttttataactgtacaatccaaaatatatttttagcatgatattcttttcatctcaatcactatcatttgggtgacagaatgcaaatatatttatgaagcataccacaaaattaacatttaaaagagaaacaaataagcagctgttttttctaccaagtccctttagaatccactgagaaacaaaagacacagttacatacccaatgtgtatagtgaagttgttgagacactgagcatcttcagcagtggctgactgcttaatgcgtaacacttttgtttagccaaattgcttgactttgcaggcatgcttccctctcagaaacatattacatatgatggtgaccttccaaaatcagtccataagcaccagtttaccctaggggctgaggcagtgaggtacagctgcaagtaaatgactgtagagatctgggtgtgaattctgcttctagccctggctactcatgtagattgaggttaattacttaatctctttgagcttcagtaagattatctatagagcatgtacactaaaacttttccattagagttctagaaggtaagagatcatggttgtaaagtacttagtacaattcttagtatatggtatgagctcacaaaatggtagccattaatgtacccattaaactgcatataatgtattattttattaagtaaggcagtgtttttgttaaaatgagaaaaatgaatttcaaaattcactttcagatgctagagcactattcctttaaaccgtcagccagagaaaggactccatcttttatcatagtcctaaactttgctttcagtagaggtagttggggattagaagagcatctgatacatcaaggaacctatacctgcaaagtataatttaacttatacctgaaaagtactattttcccttaccagtgtgctttaagcttagaatgtttgcacatacaaactgccccatgtccttcagctttttaggatcattcttttttaaaaatttcaaagaagctgctctaaaactcctttctgcatgatcttaaaagcccagtgccctccacaagatttttgaaggcactgaagagacacatattctcctgtccttctcctgaaagatgcctgaaaccgcagatagtaccaaaccatgtatatgccattttccttatacatgcatgcctatgataatgtttaattgtattccttttaacattcctttaaccatattccttttcatatattcctgcttcccttacacagtctcacctatagatgctgcctgcttcctgccccatcttgccctctatactggccagcacttctcttcttctattcctgagtatgacctccaaacacaactcagaatatataggagtaactcaggaggagacacaaaatggcacaaaaaacaactagatttaaatacaatagtcccccccttatttgtggtttagctttccattgtttcagttacccatggtcaacagctgtccaaaaatattaaatggaaaaatccagacataaaaaattaatgcattttaaactgtgtgccattcagctccgtccaacctgggatgtgaattatctctttgtccagtggatccacactgtctgtgctacctgcctgttagtcatttagtagctgttttgcttcagataaactgctgaggtaaagcagttcttgtattgaggtaatgcttattttacttaataagcggccccaaagtgcaagagtagtgatgatggtatgtcattataattaatatttaattattagttattgttgttcatcttacttgcctaatttatgaattaaactttttcataggtatgtatgtatagggaaaaacatagagttcgatattatctgtggccaggcatccactgggggtcttagaacacatctcttgcagacaacgggagactactgtattagacatctgattttaaacttcttcttatgggcaatgtgctctgatatttttcatcttattctatcctattctatttcattttattatattgtatttttaaaatgctggggctactaccagatcacacaattccctaatgagtcatgacctgagatttaacacacctaatctatctggagcagtcagaagtcacagcaaagggccttgatttttgaacaaaaaaaaaagctatttgcctctaaaaattcatatgggtctttttgcagattgtgaaacctagatgttcatttaattaatatgtttttttccatccttgtgacatataatatttcatttcatttactttttatcgcaactttataagttaggtttaacagacattttatagcaactttgtaagttaggtttaacagacatttacaagtttctccatcttttaaagatgaagacactgaatctcgggttgagtgattttctaaggtcacacagatagtaactgtttctgctttgaaagccagactcatttacatctatgcccgctgcaccacataggccattgtttctccaaaggtggtagagtactgtctgaatctgaatttcctaggtgcataatacttgctaaaacatacagattcctggctctaccttgatctagaggatcagaatatctaaagctggacgtggaaatatgcatatgcaatttcataaaggtccacagggaaccaatataagccaaactaggtttatcatttccctttaatggtgtaaattgtgtgtgtatgtgtgtgtgtgtgtgcgcatgcgcatgtgtgtgcacgtgtgtgtgtgcatgtgtgcgtgtttgagagagagagagaggacttctgaaagcttaaagatttcactgttttgcttcaaaaggatttgagagaacccagaagtcaaatacaaataaaattatacaattatagataaaccaagaacaaagattgagtaacagaagaatcaaaagaaaagaggaacttagcctagaagagaagttatttggctttccttttttttttttctttttttgagactgagtttcactctttttgcccaggctggagtgcaatggcgtgatctcagctcaccgcaacctccgcctcccaggttcaagcgattctccagcttcatcctcctgagtagctgggattacaggcatgcatcaccgcatttggctaattttgtatttttagtagagacggggtttctccacgttggtcaggctggtctcgaactcccaacctcaggtaatccgcctgcctcagcctccaaagtgcagggattacaggtgtgagccaccacgcccgacccagaaaagttatttgactttgacttggactctaattcttctagcagttaagataaaaataaaacagtattttgaaaagtgttttattctaacaagactaatttggttctaattctcccagcatctgagcaaaagaaaaaatagatgtctgtcgcatttttattttctgagtaagaacttaagggaactgcttatacatatggtcaaagtgtagagtgtgaaaaccttcatgtctcttccccttctccagcataatcatataattattataataacatcaattgagtatctacggcaggccaaaacaagattatcctatttaatattcataaacccctcaggatgcatcctccattttgtggataaggaaactcaagtttagagattagaagcgtctcttccaaaatgtacacagtaagtggaaaaactgggattcaagcccagattgtttgtctccagagcctatgctctgcttactctcagatcaatgataagtgaaacagccatgacatatacacattagtcctattgagaaggaaaactaaagcaagagtaagaaaataaagaggaagaacagcatatgagaaaaccagacctgaggctaagcaatcgtttatcaggaaggggcagtgggcaactcctctgctagtatgtaatttgatttgagccaatccaggaaatatctctaacttatctttggcccctgataataagccttcaggtaatagtcacattgactaaagaagtttgggtttctttagacatataaagacattcaggcagcatcatcagcaaaaagggtggaacacaggactttattattatttgtcctttgacaagctcacaaattaatcatccccaccaatcagcggagtcactatctttagctaattagtcaaggctagatgcacatgttcacttgaaaaaaaaaaccctttattacaaattgtacatttacaaaatttctactattatcttcatgatcaattcctgagattcctgttccatgtgcattagatgtctttgaggttgacaattattttctcctaacgtgtctgtctctttgctttgtgtttttcttttagcctatattcacagtatgttctcggcattacctttgtctccaaacaggaggtggttttgaagttacctttgataaagaaagctcaaaagagaaaatatttgttgtaattgcattaattaggttacaaaaaaaaaaaaaaagatgatgtattttctgtattcgctttttgggtaaagatggctgttacccctggtagtcatgtgagttaccaggagaaatatcaccctggttcatttctctcatatctttaaatagtcataattctaaactccttaagagattatgatataaagtgagttatagaatatatagtccttctgcagatgattctttatatgattagacataacagtttggtctatgagtgcaaaggatatgttgcaagtgattgattgactagaaataattcaacattcttttttgcaagagtctcctttttttcagatgctttctctgttctgagtgtcatcatctaccactgttagctttagttttttttttttctctatgttgttttctaacacggatacaaggtaagatgaacaccacagtcaaaatggcatcatgctgctgaagctgacatcaagcacttttggcggtcttcagaaaacagcttcacttggttctgtgcttaatgtctaagatgtggaatctgccaaggcacctgccattttatatagctctctaatcttcctttttattagctgtctgcaaacatcatcacactgactgcttggtttaaattgtgttcactcttgtaatgtaaaaagataagaactgtccccaaagatataaacttagactcttgtattgtagacagttatgttttcaacgtaattttccttgaaacaaaattcctttataattcaacaagaaaagagtctatctgtttgcctcctaagtaaatattttgcattacaattgtccagatgtgcaagatgcttactgaagctttctttgtttaatcactaattttttagatcagttgtttaaaaaggcacacactatggcctatattctcattcattcacatatttatttcattcattcaaataacattaattgggttcctgctacaaaccttatactgtgttatgtagtgtaaataccaagaagaataggatgcttttatttgagaaatcaggtaggaaagataaacccacaaaaacataaattaaaatacatcatgttaagtgctataatagacatatgagcaaaatgtcttgggagcacagagggattgctctctaagttcaaataagggagtataaggttttacagaggagggagagatattccagttagtctagtcagtgtgctgcagagaggggagagagtgggagagggatgatggcgggaaagggcattctcaatagagggaacgtgaagaatttagtgtggttggaacaaagggagctttctagaggaagatcaggataggaggttgaaaatgtcacctgggccagattgtgaaaaatgtatgtgtcatgctaaagagcctggaattaattgcctgggtattgggtaaccaatagaaatatgactaagagctaagaactggatctgtgctgcagaggcgaccctattttcaaacaggctgtatagtgaaataccagaaagcaaaactgcaacaccccctagtgcaagagctcgcaccacgttcctaacctggaatgaggctcctgcaggcctgggtgagggttgattgctgaggtagcaagtgagtaggcagttaaagggacctggaaaaaaacaaaacagggaacacgaaggagaagacagggccacagggagtgaagagtggtttggagtaggatttcttcacctgctttggggtttacggtttaccctgccttttcagagttaaagaatggggacaagagctaggaggtacaaaggaacctttggatcctctttttttttttttttttttcctctctctctcttccttttcttccaatggggaaatgaatccactttgagactactctggaggccttagaggcagaggcagagtgggcagagcatatgtacaagtcagggtctgtctgtgtgtgactaagaaaggatggagttcatagtaaagcaagccctgagtcaggagtcagtcctttcccaggggagctgcattgctttcaaaagagatgtcagaatttcacccttactttgaactttttcacaatgttaaatctgggccagaatttggctcagacccctttctaagtctacttttcacattttccttagtacggaaacagtcggagcctgttcctttttcgtctaacctccgttgctaccatattagtaactacagcttgcttccctggtggttgttgcatctgtgaagaagaagcagggcataacatcatccattctatagaaatgaaggacttggaacattacttagtttacttattcatcacttgcattacctctatattgtatttcatccctcttatgtgatctttaggctgtgtttgaaagactctaccatggaaaactcaccagttacctgtgccctggatagccatgttttacaataatgttccttttaatattgagctggatatgttttcttgaacctttcagctcatgtttttatcacttgaaaccaaagccaaattgcatctctcttccacataagactcattcaaatatctgaaagaagctaacacatttcttagctcctttaagagggaaatgaaaaagaatgctggaggactcactgcttcatgttagatattaaggtaggatcattcacttgcattagcttccttgtgaggaaaagcaaaagaaaatacaacaaatatacaaataaaccagttaaaaaaaaaaagagttactttcccaaggtaagtggtaaagcaggtatgtaaagttaaattataaatttttaatattaaatacatttaaattttgctttattttatgaaagtaatacagattaatattttaaaaagccaagtagttctataataatatattaatggtacactaataggaaaacatagtaataataataacctgctttattcttatcaacaggcttactctcacctcttatatttgtatattttgataataatctgtatctaatgacacaggtaaaatgccattttttcttcctcctcctcctttttatctttctcatcgatttcccacatggaatatacagatttagcttcttaaaactgcccatatgacacatatacatttatcttctctatatagttgtattataattttggttaaatcaaaagtcagcacatattattatgactgttaatattatcagctcaataatatgatgttctatacatttatttcaattcttatctctcctggagttagtaattgccctgtttcatgacttgcatgatttctataaatctgtcattaattaactcccaaatcatcctgcagaactgaacatcttctcttaatatgtgtgaacacattcatcattctttctggttttgcttattgaactgtatttggttttaaaacactcctcctggagtccttctttctatatttttgctgcagctggtctgttgaactggctgttctctagaggggctgcataagctgatattccagaacttcactgataacctgggaaatgttatctccttcttatattcatgaccttatttcctgggggccattttctcttctttcttggtggagcatgtggaaatttgagagtattgctccatggaattctagctttcaggattgatactgagaagtcatggtctattctggctcttacgcttttgtaggtgactctttttttcccctttcttctctctctggaagctgtagtgtactcttctgtctcttctattctgagcttctatggtagcatcataaaagttgttattatagcatcactgggcccttttaatctgaaaataattccggctattagtttgcaattattatttattaatcactcacctccaacctttctttatttcaagaactattatgagtcagatggtgggtattctgcattaattctggtttattgaactttttcccctatttttaatctttttgtcatttttttcaactttctggaaactctccttaagggtaacttccaatatgcttcaatttctttccttctttttccaagagcttttactttttttctttctctttgtctctctctatgtacatctacctctatctctgtatctctatctctatctcatctatctatacatcctgttctactttaggggatataatgtctcatcattttgacagtattatagcctttccattgttttctattacaccctgcattgtcttattttttttctgtttgtattggtgttcttctttcatggtgtacaattctcccctctgtttataggagtttccttctgtttattgcagaacctctaaggctgattggaatctctgggtgtgtttgctggacctgtcagttggtaagccttagtgcagcccacaataaagcactgaactttttgctgggagaaaacagtatccctatctgcacttcttttcttttgagttctttagtctccagagaggaatcctttgtttttctgcttggcttccagagttctgagagcgaagttagagagatgtattaagggtctcattttttcataagcatacttttatttaattatcttattttttgtatactttaattaaatcctgttttcattagagtgccttctttctttctcttcttttcttttcttttttttttttttctttttgagacggagtctcgctttgtagcccaggttggagtgcagtggcgctatctcggctcactgcaagctccccctcccgagttcacaccattctcctgcctcagcctcgcgagtagctgggactacaggcgcccgccaccacgcccggctaattttttgtatttttagtggagacggggtttcaccgtgttagccaggatggtctcgatctcctgacctcgtgatccacctgcctcggcctcccaaagtgctgggattacaggcgtgagccaccgtgcccagcctagagtgccttctttctgtcctaaactgatcttaggatttgcaagaccagtacttctccagttgaattacagaattcacaaagtatatctcaagtctttgacaaaatgaagccggggtagttgcctggcttcatgatgtgggaaagaatctgggagcccaattcttccatttacaaactttcaacccccattttaatgtttttagtcacttccttaatccctacctttaatatctctcatttctgggcatttctggggatcagcagctcagactccttttcattattattacttttctgattgcttcagtttcaaccttctgtcatgctactatgactatctttgtccatccacttaacatttttgaaaatgtgtttgccattttttgtctggtattgtctgtcacctttcttgattactttgtccttggggggttatgcattatttatcctttattcttattttagttacttttggggagggagtagagataaaagctcacaccatgtttaattaaaagtgacaccattgctataaccactacacgtgctgccactgcttacaattttgagtccatcaccatgctatagaatatgcatggctaagacaagatttactgacatttgggtacactcagcatttacataatctgcctattcttatctctcctcttccataggaaaacctagaaagataaaatcagacaggtaggtgggtaagagggaaggttttagtaagagagactaggttgaactacataataaaatgctggaagaaaggagagtgagatacatatgtagcaaaagtggcaagaactagggcttaagaagagcttaaggttttgatgaagatttgaaacattgcagtgtgaaagatttgacaggtgaagaaaaggatttgtgaaaagagttgccgtgagttacagatttgatcacctttaatgatctttgaaagagtaaagtgaatattggtattcctctttaattaataatcattgtataatctctgcttctttgactgacattctgcatattttgaagggcaaaataggttatttatagacttctaaatgtgtggtgctcaaatctaaacacgacactttgagtgtgaaaatattaaacagctctcacatggaaagaagagctacatcctattttcaaatacacaggaaggacaaaaggaaattagatctaagatctataataaaaaggaaattagttttcttattcctaatctttcttctgtatttaaaaactgagtctacttattctaacgtttagcctctggatcctctctatctatccaaacataccttcacattttcagtaggcattctctattctcttcagtcgctctaatggtttaccctgcaaatcattaaacccacatagtctcagataaatttaagtgatttcttttgaccacctcctcctcacacacattccaaaatatacacgcatgcaaaaacaaaaacaaaacccagccatctttctttggtttctggtttccttcagtgatttttttttctagatattctacaaagaatatgagtggaattcactgagttggaatagaggcagaggttcagtgttattgataaggtttagaataataatgaactgcacaacatttacctaaactttataaatatggtaaaaatacagagaaatgatagccatgagctttaccttcagggagatcatgatatagtcagggaagtaaaagggtttttgagaaatgcttaaaaatagaggacataaacaattttagccaacagattggtatgaaatgtgttgttacagaaaggtttctattccaaatgaaagaccttcctatcctccataccaaccaccactgtgggacgcctcatgttaagatggtaaacaatgtgattgtggaccctatttggtcattagtgaactctgatttagaacagtttacgtatttaacctctataggcctggattttattatttgaagacaaaaatgattaaaatgaataatagttgaagcatttttcaatctaaaaatctgttactgggcttcccttttataagaagggcatgagtatacctacagtggctaatgcaagccatcagaagtatctacatagagtgcacgtaaatggaagcatgaccatgggatattgtagggatagactaggtttcacaggcaggttcaaatttgggccccttcactcaaatatttaaatgtttcctggagatgggtctggagttatcaagaattattttccttttttaatttctccataaggacattgcagataattaagttttaccatttatctatggagtacagtgtggagatgatagctccatttcaacccattgacgttttaaacttttataacgagaacactagtgttttagtttgttctagctgctttaacaaaataccatcaatttagtgcattgaaacaacagaaatgtatgtctcattgttctggagtctgggaagtccaagatcaaggtacaggcaggagtactgtatgttgaaagcctgcttccttagagacagcactttctgtgtcctcacattctgagaggggcaaggtaactcccttgggcctcttttataagggcactaatccctttcgtgattcatgaacctaatcatttcccaaaaggcttcattgcctaagaccatcaccttgggggttaggacttcagcagagtaattttgagaggataaaaacattcaggccatagtaccttgtcactgcagggctacgctgtacctttatccaagggtgctcatatataaattcagttctgagtgttctatctcagaggccagattaggatttctttgtactctcctaatttacttgaattaaaatatacttggtagttatcgccctgatgatttcctctttgccccaattatttggaagtagacatattggcatacacataagctgaggaatgttagggaaactatgctcatttatcagatacagcaagttaaaatcgaatacctgttagaataggtgaaggtttattgctagtaataagcagaaagtgctggagcaaggggtagggttgcgaatctgttgaaggtcagccaaacaatgtacgaagagaggaaattagatgacaggaccttgcacacaatatgtaactaggattcattgataaaaatatatgaatagtagatggatggaatgatggatagatggatggagtgaaaaattattaatattaaatgttaatatgaaaatgttacatacttccaacttcacaattttgctacagattgaatcagctattatatttaattgctatattgaattcacttaagtctatgttgtacttttctgtccatgagtgaggaaaataaaaacataatgttttctaatagctattggtgcaaagctaaggatatatttctctctgctactttcatattgtttcatattaacatacatgttaaattctgtcatttatgacaacatggatagaacaagggaacattatgcaaagtgaaataagtcaggcacgaaagtcaaacttcacattcttataggtagactctaaaacagctgaagtcacagaaatagagaatagaatggtggttatagaggctggctgttggagagaatggaatgatgatagtcaaagggtacaaaatttcagttagacaagaagaataggctttttttcttgttagttctattgcacagcatggtaaatctaactaattctaactaattatagagtattttatatttgaaaattgctaagaggataaatttcaaatcttctcaccacaaaaaatgttaagaatttaaactgatggatatgttaactagcttaattattccacattgcagtcataaactataacattagtttttaccccatagatttacacaattacaaattgtcaatttataacaaaaattataaaatgtaccaaccttgaaagctgcattctgtttttctcacttcacctaaaaaatacaaaacacacacaaaaaggaaactgaaataaaagccaattaaagtaacacaagaagtcaaaaagacattttctttatttcttttaacttttacccatttttcttgttgacaggaaagaagcatttaactacagagagaaaaaaaactgataaaactctttttctcctatattgtttttaatatatttttactttttaaattttgtcataatttgctttttaaaatttcttatgagtatagaaattatgaatgacaatgagtaaaaatgcagaggggatgtttaataaacatgattaaattgtatgaaagaaaaaattatataggcagcacttatcccatggaagccatcatgataagatttttgataaattcaggcaagattattttaaggtgctattacaatttcttctcaggttctatatttctactcttgaatgctgattagaacacaggcttttgcgtcttctctctccttactcccctaataatctgttctcccttatggaccaagtgattattctgttgtttataataaatgctctacattccttatggaaattgtaattatgatgctgaatattcaaactgcaagccacttttgtcagggaaattgtaattatgataatgctgtatttacccaaacgatgttttttttagtcattgttctctttgaggaataaagaggtaagagaaaaaaactaacataaaacatcatgttgggatttaagatatggattcaggccgggcgcagtggctcatgcctgtaatccgagcactttgggaggctgaggcaggtagatcacctgaggtcaggagttcaagaccagcctggccaacatggcgaaaccccatctttactaaaaatacaaaaattagttgggcatggtggcgtgcgcctgtagtcccagctactcgggaggctgaggcaggagaattgcttgaacttggcaggcagaggttgcagtgagccaagatcaggccactgcactccagcctgggcaataagagcaaaactccatctcaaaaaaaaaaaaaaaaagatatggattcagacaagcataataataatagctaatctttactatggcaggcatgacacaaccaggcttacatgtgtatgacacagatgcatgttacaggcatatgtgaatcacaaaggtttctcctttaacccgcacaacaacctcatgaggtaagtaatagtattgtcccaattttatagacgaaggacatgaggcctttgttcggcaccacgacgtgaaggcctacggagtatttgatacatcaatatatgtaacatgactctacttttgttaaaaatatgtttttatttatatatatatatatatatatgtaatatccaattgtgcatagaaacaaatctaaaggagtagctatcagacacttaaagtaaccttttaataagaggttgaagagggaacttttttccttcatgatacatgaatattatgctttaagtgtttataatatttttttataaggagaaaataaatttttaaaaatgtaacaacatagaaagaaggacatccaaaaataaatgcaaaaattatactattttaataagaaagcaaaaaccaaacaaaacacaaggccgatcactgaaacagcttattaggtgggtccctagataaaatgggaagcagacctccaataactcctttcatctgcctgccttctttctagcttgccagatctgtacaaccagagccccaaataaggatggaagctctatcctttcctccttagctcagcagtaattgtttaggattgtttcaatattgataagcaactactgatcacccaccatgtataagcactttataagcaggtttcaatattctataataaccattttactccgctttcacaaatgagaaaattgagtctcacaaaagtcatttatttgcccaaatttaccaagttagcctgtgttcttttaatttgacaaattgacccacctcgaccaaaagtaaagtaagattgaaaagaaactcagaaactgaaggcaaacaaaaacaggaaattaaaaagataaggacaaagtatataaattagtgagtttttagaggacgaccctcttgtacagcttaagaactcccaggacctattcttggaccttttctggactttgttatgtttctaacaccccacccaagaaattccaaccccttatcgcacacacaccccttaacacacacacacacacacacacacacacacacacacacacacacatacaccccacactaagcttctctccactcctttggcagcatccatctgctgcaatgggaccgttcaattatccatttctgattttccatacctgaaaatgtggatgagctgtccaacctaatagcaacaggggtagatgctgggtctcaattcagtattattccccggttcagcctgctagtcagtagtaagctgattatgacatctactaccttagaaggagcagtaactcattttgactagaactgagccaattccaaattagggtttgccttatatgcctgcagggccttgtttagcaccaagatctgagggcctacagagtgtctgaaaggtgaatacataattctgcataatatcatccagaccaatgcgactactttggacggaggtagaaagtgggtacatagtcaggagatccacttgtcctggtacgcactgcatgccgcagaaggtgctggtctgatgagtgatggaacagcctttggaatcctaaagatgtggtaaattctctaaatcaatgaccattctttgatactgcatccccaacaggtagaatacatgggtctaggaacgaaggggaaaatatagaagtggttgaacctagcatcacttccacagtcttaaacgggaaatttgcatttcctgttcacaaaagtttaggctctgtgggtctagagatcttggttttcagagggaggttgcttctgagaggagacactgcctctgagaggggacacagtacgaatctcattaagcttcaagctatatcctacaccaaattactttgggctcctgtgccaagagattggcagcaaggagaagcgtcactctctttgccaggacaattatctcctcatcaggatctgatatggctgctattacacaataagggcagaaaagaatatctggcatgcaggtgatacactaggcattttgtgaactttccttgctttttttttttttttgtaataaacggacaagtgcagcagcctaaaaataaaatgttgaggaggggttcagatcccttagtaatagtctgtgttaccccataaggtaggccacatatgttcattagggtactggctgaggatgggagaattttagaatgggtaggagaagagaagaagagaagagaagagaagagaagcgaagcgagagatattaagtatctattgtgagcttgaatagcaggggccatggttccccactaatcttcttctaagaggtttcctaaagatggcaacctattcggattctggaggagctgttctcagatgggataaatatattatatgatgcaagtagtgccaagtagatgccacatggcatcacccacttcgtgacaaagactcactgccctagctgcctgaagtgctggctgctggtagcccacagctgagtccttctctgggaattttccaccttccacccgagggaactgccttgaccaagacaggttattcacaggcagctcatgctaatgactgattaatattgtactacaaagaccggactccctttcctcagcttgggacacctataaatacattgatcccaagtaacttcccaataaatttcatgcatgaaaacctctgtcttagagtttgtttcaccagaaaatttacctaaatcaaggtaaatttggaagacatggagcagagagttgaacacagatatgtcaggctctgaaatccatatcctttccattatatctttctacctatcaaaacgaagagttgaaacaaattttcagaacatttttgtgtatgcagtagacataggcaatgatggtatatttcagcctgtaagtcatcattcttcattattacacaatagctacaattatactgccattggaatattaaactaatgtatttagatctcttgaaatctagacatctacagagatgttagtagatatgtacaaacacacgttgatttataatattatattaaaatacagttgacccatgaacagcacagatttgaattgtgcagatgcacttatacatggaaatttttccataaaaattatataagtatgcctgcttccccttccacctcccccacctcttctgcctctgccatgcccgagagagcaagaccaacccctcctcttcctctgccttctcagtctactcaatgtgaagagaaagaggatgaagacctttatgatggtccagttttacttagagtaaatatattttctatcccttatgatttacttaataacaccttctttcctgcagtttattttattataaaaatacagcatacaatacatataatatacaaaagatgtcttaacctactgtttatgttatcagtaagccttccagacagcagtaggctattcgtagttaagttctgggggagtagaaaagttatacacagattttcaactgtgtgtgggggggttagtttcccaacccttgcattgttcaaagctcaagtggatatagtatacatgtacacacatgtctatatatcctataaaatgtatctcagcactcattccaaggttactgtgaccaaaatccttaattatactagcctatttgcaaagaacaatatgatacttttaataatgccatttttctaggaagactattcaagacttctctatttcagaaaacttaaaagattagttacggaacaagggcttacattttctgcaataaatgtaaggattttatcaggcatgaaatgtagtcagaacaatttacggtccagtaaaatgttacttcaggcagtatttacaatcagaacacagaagttacctaattctatgcagttgtgagaaaatccagttaagattttacaagcagtgaacactgctccacactattcctcaagaaattctacatcaagtcttttatttcattcacaactcttaattctagatcaaatcatttatactttctatttaagcatttgtggcatcactggtttactcaggttatgccaccactacactgcatcaaaggcttaaatgtcataaatacaaacgcaattgtagataaaattcctcagacagaaaagtaaaactagagcattccaagaaaggtatcctaacctgtccatggtgaggcagaaaatagttgctacatatccaggaagagctactagctttagttctatctttaattgtgttcagttagtggacaaaaggttatttatgccattttaagcagggaggcttttgaaagagctctcaagtatcagagggttgtgaaactcttaaacttgtggtaactgggataggaaactccccatggaatctgtgttatatatcccatgtggcaataaatacaggaaacactttaatgaagcatgcagctaatgggggactttccatgaagaggcagcaggttttgcaaagcacactctactcagtgagctttaagtcaaagattcttccagacttccagaaactctactagaccattgctccctactgactgatgaggctacggaactgttgagttaggctttctaactttattctgggatcattcactattctaaacagcaccattaatacataaacctggaaacttcagaaaggcagcaacatagatttacatcaattcattcttaatttaattgggattgtggaagatacaatgatgtatatgacctacttgcaagcaagcttactttgacttataatgcaagtacacctgacactggcaagaatgcacctcagtttctagacatcaatattcatgagttcagggaagaaagtcaatttttgcccaagacacccagatttcctatagctgagtgactgtcagtacacagtacattacatttaacatcacaaagtacttacaaaaagtagtctgacaaacagataaagacggacaaaggcatggagttaactttgaaccacaaagagctctccaggacagagcttatcagcatggaaaataatattttaataatttccttttgatattaaaaatattaaaagttatttaacttttaattaaataacagggagaggttggggcaatgccataaagtctttcatatggtaaattttgaaggaagtatagtcagcatgaagccataaaatgtttttcagatgagaaggcattttataaaaattgctgaggtagcacctgcaagagactgaaagcaggtgtgtttcatgtgtgtttgatggggccctattgacaaggctggcaaatgttgctcagtttaactaatttgaaatcatgatttttttctctctcactaggaaagtagagtggtgtggttcaaagagcactgtaaataaaatcagaagcccaggatttagtctatactctgctccaattggttatctatctgtttctgttcaacaattttacttgagttacaagttaaatttcgagtactcccctgccctcctccccaaaacaaaaccagcactccctaatacagaatggtttaggcaagagtgcagagcagaagtatgacttaggatcaacaggaaatgcgatgtgcctcccacaaacacgaatgctattgtatgctttattattatacctgtagtatatagaggaaggtaggaaatgaacctgctttacttttaagttgtcatatcgagatggagcattgcttttagttgaagataccacattttataagatccacaaacaaatgggacacaatctgggaggaaggcttcatgagtgaagaaactaaaaatactgcaaggaatggcagaagttgcattcaagtgggggcatgcaaggttctggaacatctaagcaagtatcataacattttagctagagaaatttgaagtaacaagaggaagaatactaactaaaaactgtctcaagatggcttgtgttaagacaggggttcacaaattacaggccacaaacatcttacttctttttatttacagattatttatgtcctctttgctgctacagtagcagagttaactagatgccacacagatgccacacatatttacagctgaacatgtttacaatctatttacaggaaaagtttgactcctgccttaagaaatagccaatccatcaatcattcactcatgtgttcattcatttaataaacaggtttcaaacatatacaatgtgtctaaaatgtacctggcaacatacagataagaaacagtctgtttcttagcctacccaccaatttccataaggccaccagacgcaagctaggtgaccattaatagaggacatcgtagaggggagtaaatcattgactcaatgactataaaggtttttttttttttccaatggtaagagtctttaaaatacaatacttcatggagaaaaagtccatgaaaaattggttaatggaaatagatggagaagtaggaggtggcagtcttcaaggtacagaagagtcaagttcagtgatcagagaatgaaaaccagacaagttgaataaacatgtagggtaggagtgaggaagtacagtatagatgtctggaaagatgagaaacaccatatcgtggaggtcattcaatgtcaagcttaatattttctaggttatttggtagctaataggaagctacaaagtctttcttaaaagagatagtataaacaaagtgaagttcaggaaagatcattttgacagcgatatgtaggatagattgcagatggaatatagaacagctgcagtctaggcttaaaataagaacatggaacactaagaattggatgggaagagagaagcagacatgaatgtgtatttcacatgaatgagaaatgctaggtacatagcaactcaggcatatgaggaagaaataaggagtagaggctgggtataactacgggcttgcccttgagtatgtatttctttctcaggtcaggagcttcctctacacagggcccaaaggaacacagtaaacaccattttgatttgcatcaatatccagtgaaatccaccattggttggtaaaaagtggtgtccttcagaaaaggatccttgacaatgactattgctatacagaatggggtttgggttcagggagaaagccatcagtttttccagagtcctagtgtggaaggtaacttcagaacagagcaaaaaaaacaaaaaaacaaaaacaaacaaacaaacaaaaacaaaaacaattgcagacttttgactaacatggtcaaacatggtagaaatagggaaaagctgtgagtctgtgggtatttgggtgccagtggcagcaaaaataatttcagtctccattggttggtgagtttcaggctgttaatataatcatacagtttggaactgagtatggctacacatgcaggtaaaagatctcaggaatcacagccgctcatggaatacaggacataattataactatttgtgtggggagttcaaatatgtctttgtaatttaggctggaatgtatatgccaacacatttgtatcttgaatatataaaaccatatttgtgtctgaatcagcaccatcaataaaaaataccatattttcaaaatgtttatctatttataaagttgctccattattctttgactataatcttggatttaaaaggaaatattcaccctctgcccctaccttaaccaattttgtctgatggaagtgtttagcttggagaaaggtggtcttgtactgacactgaaaacattgacccagatggtcatttatgtcgcacttctaacccgacactacaatttggggaagatttttggccaaatcattagaatgctgccctgtgagtcaataggcttaggccaccatttacattttgtttcttcagtttttttctttttctttttatatatccatggattcctgtacacttttaatagcagcatattacaatcaggatattacagtgtaaagagccaagtctttggatacagatggacctaggttggatcccagcactactacttattaacagggaaatattgagctagttctctactttctctgagcctctgtttccttctctattaaatggggataataatacttgcctcaaggtttgttttgagaattagtgaggtaatagatagtacttggcatttattagacacaaaataaatattcattccatttcttctttaatactctttgtgattattaagctatctcagctggctgcatttatatttatgacattcaaaatatgaaagcattgttacaaaatcccaaatgtctagaattcagataaagatgttctctcatggaatgattcacatggaaaaactcattagatacgtctttccaaaataatcacattgataaactatgtattaaatgattttagttaaatacctacaacacattgtggaccattactaggtgctcatttattttaaggacagaaacaatacacacagggagagttagctgaacagcaattaaacacatttcatgtttcctgtgttgtacatcagcagtatttagagcaaagccttgaatctcatggggggccattcacatgcagtctgcagctcttcaacacctaaaatcttcatacaggatattatcattcagttctatgggccacatggtacatttcaataaaaaacactaaagcatggtggtcaaaaatacttgctctgtttttagacagttgacataactctttaacttgctgtgtgctctttggaaagttacttgtccccatgattcattttcttaatctgtaaaatggggatagtaataaatagtgtttacctccctggattattgtgaggattaaatgaaatactaccacaaaagttcttgatacattgagatcactaaataaattttatcattttttcatacctgcttccaaacaggatttgtagagatttatttcatataacaaatatataacagttaaaacaatgtggacaaaaagaacaaggatcctatagtaaaaggtggtaagtgtggaagtgaagtcttttactgtgctaagcccaatccagagctaagtcccctgagtccatgtccccacttaaaattttttcatgtatagctcctcatctgtaggaagaagaatattcaccctacaatgcatgcaaggacctccatgggtgacttctgcccacgtgggttgctagcagcactcactctttcatttctaaaattgaaacactatagatcaccattcattgtgtgtgtgtgtgtgtgtgtgtgtgtgtgtgtgtgtaagattctacgtttctgctctgcctcttgtatatctgtatatagtccctctctatctggaatactttctcctctgtttttaatcttccacaagtgaccaaacagtatgaaaaaggcttgagaaagtccgtgatcacattggaggaaggtttccaaaaaggccaacatgctgaaggcagtagaggctactggtgaggcagcagtttctagagagtgggcagtcaaactcctcaggggatctctatctggaaaggaagcagtccatacagagaaactcacagtgcacgaagccataaatatatacaggaaattggaggtgagtgaaatccagaggggtttgtcacttccaagcccgaaccactaaattaatactgaatgttgatttatgttaatgacatttagtaatgtaattctctgtaagagcatctgtataatatttcagatattcccaggggtgcttagagaaggggagttagtcgaccatgtaatattgtgtaaaattaattaaacagagattttaatataaggaagctctgaattggaaaatacatctgttttgtatatgcacttttttccacctcacctgcagtgcttaggtttgcatagaatccctgtgttaaaagaatctggggtagagaaacctatgatcttatgctaatacagaaaataaagttataaggcttgagggcaggattacagctatgaaagtcatttacatatgttcattttcactaaaataaaacattacacaatacaacatatgtgaacatctataaatattatattagtgataaatattactatattactgatctctatcataatagttatttattttagacaatttgaaaattgcatttagacaattacagatttttaataatataatgagcaaacctgccactcaaaacaaaaactaggaagttgaccctatgctcctctataactccaaacacataatccccctcaatccatcacctcaggcaaccaatactctgaattccacatttatcactcccttcttttccatgttatgcactatatatatatatatatatatgcctgtgtatgtgtgattttttaacttaaaaaaggtaataatgttgtatgtaatcatttggacattttttcagttaacattttattgtagttattgatacgttttgatatacttcattttagtttattatttcaattttgtctcattttctatacctttcagtaataattgtctaccctttttcccactatttttaaaacaaacacttcagcacacatcacattcattgaatttcactcctcaaatacgtctgtcatgttggcattatcattctagacttttaattctgtgttagtgctttctcttttctttgctcttagcaatatttataacagtttataacaaggaataaaattactttaaaaatatgtttcttgcaacatcccctaagattttaaacaattttctcatctagatacttgatccaaactgctccctgtatgggtcttttcaaagtttcagaggctttgtgtgataaaaaaaaaaaatgtcttcacatttcaacaacagttagccagatatcacactctagatcctaagttattttaatactttacaaatagcactccactgttttcttgtatccaatgttgccctcaaaaaatctaaggttaatttgattcttgtttcttgggtgtgatctatttactcctattcattctcctttcattcaattaatatttactaaatgtctactatttgtgatgtactaagctagacactggggtacaggagggcacaagaaaggtgtagctctaagttcttggacgctgacctctagtgagatgcattgaagacttctaagaatatgtttttatggccaatcttaaaagaagcattaccttcctttcattcttttaaagattcagtgtttataatctctattcctgtagcatttaaccttacctaagttgctacttccagctctgctccttctgtaatataattaacctcacctgaagtgatttaaaattcactgggcttacctagactagattccattttctcacagctgttgaaaagcaaattcacatacaggttgattttatataaggagaactcacaatcaggtgtgtcagtggggagggattgctgtattcaacttcatgactctgctctgaattaagaaatatagaaaaggcacggatactgttatgcttcataatcctattttcttctttctgggcaaataaaattaggctttgtggctggaaagaaggtatatgcagcttagggaaaattatgaagcagaaggaaatggagcgaacaaaagataaatattcaaaacataaacttgccctggaagtctcaaatgtactaaatactctatgaattgtgtttctttccataaaaaccaggaaatgataatggaaaaatatatgtgcatgtccttcattagcatacctttccagataactacatctaggcttaggcacagattcagagaaggcaaaagaaaatggacccagagagaaaggagggatggcattttggatttattagggaagctggtatatccttggaaactgtgtggaatttatttttaatgaaataacacaattcaatatatatcttcttacagaccatcattaataaaatactacagttctgggccttctgggaactcagacatgatagcagcagataattgcctttgagaggaatatcaacaagcatgaaatcttctttccaactaagttagactttaatattggaagccttgcacataacacaacatcgatgacttatatccctctgcctgcctgaggatcacctgttccaaagatttcagaaggtgtagtgtatctctgttttaaagggaaaggatacacaatgttcttaaagagatcaagaactacccctttatcctgtgaatctggacatgtcctttgacactgatgtgcacatgagagaggcaaactttctagctgggcaagttttctagttctttcatttgcaactaagacactaaatactaaaagagagacccctgtctttgtgtgggggcgggtgtgtttactcaatttccctctgattcatatttccctaaactgtacatatcctgttcctactcaaccagtagaaaaaacattttaaataatgatgaagaaagattagagaatatataattcaatgaatgagtctaaagatgaagggaatgttcattattctgtatcatgccaatgagagatgacagagtatataactcttaaaaaaaccacaatatcttcaataaatacaaactttaatagtcttttaaaacaatcatagttgcttacctcaattaacagagcagtacttggtgtggtatatgagaatttctgtcacaccttctccaatatggcacttctaattttaaaaataaactattctagataggttgtttataaagtaggtagagatttcttagaataagttatgaagatgaatatgttaaaaatatttgacaaaataattagattttaacaaaaaaggaaacatgaaacagttatattttatatgggaataagaagaatatcaagcagtattgtgtctacattatttctaattttttaaaattaagtattgaagatatagtaagaatgtttgtaaacactgttagcgataaataattacaatgcaatgaacactgtgtacctaatataggtacccaatttaactaatatagcattgagaggtgaagccagctggacttcctgggttgagtggggacttggagaacttttctgtctagctaaaggtttgtaaacacaccaatcagcactctgtaaaaatgcaccaatcagcactctgtgtctagctaaaggtttgtaaacacaccaatcagcaccctgtaaaaacacaccaatcagcactctgtgtcttgctaaaggtttgtaaacccaccaatcagcactctgtaaaaatgcaccaattggcactctgtgtctaaaggttttaaatgcaccaatcagcactataaaaacgcaccaattggcgctctgtgtctagctaaagatttgtaaacgcaccaatcagcactctgtaaaaatggaccaatcagtgctctataaaatggaccaatcagcaggaagtgggaagggccaaataagtgaataaaagctggccactggagccagcagcagcaacctcctgggggccccttccacgttgtagaagcctttttcttttgctgtttgcaataaatcttggtgctgctcactctttgggtccacacagtctttatgagctgtaacactcactacgaaggtctgcatcttcattcctgaagtctgccagaccacgaacccatcaggaggaatgaacaactgtggacgcgccacctttaagagctgtaacactcactgcgaaggtttgcagcttcactcctgaagtcagcaagactacaaacccactgggatgaacgaacaactctggacgtaccacctttatgaactgtaacactcactgcgaaggtctgcagcttcactcctgaagtcagcgagaccacgaacccaccagaaggaagaaactccagacacgtctgaacatcagaaggaacaaactccggacacaccatctttaagaactgtaacactcacggcgagggtctgcagcttcattcttgaagtcagcaagaccaagaacccaccaattctggacacagcatgccgatcacttttaaggccctcatggatccattactgagatcagccattactcctacccaccaaaggtataaaataaacatagtgctttatcattccctcactgttcttcatagttttactacattggttaataacctctaacatcctactttgcatgtttttaaagtttgtgtaactagacttgcttttttctctcagtgtcatgtctctatgatagaatcgctcttttatgcatctgttgtttgttaattctcattaatgtatagagtatcccattatgtgaaaataccccattatccccctctattcaactgttcatggacatttgggctttttccactattttgctattgtaaacattgctgctgttaacgttcacccctgtgtctcctgattcagatatcctgggacacataagtgtcccttaggtttatagctaagaatagaattgctaagtcatagggcatgcatatgttcaattttactgtaatatggcaatttgtttcccaaatacgtttatttgaaacatggacttttccaattttatttgttccacatctttgccaaaacttcatattacatgacttttaatttttgccaatcctgtatctcacccttcattttaatatgtatgtccctcgttattaatgaggttcacaagatatgatttctcatctgtggtatgcctatttatggtatttccttgtgtattttgtggtttttgactctaagttgatattccttgaagctttatctgaaggaattctttgatgcctgagtcaaatgtgaactaaatcagatataatttgcattttctcctgccacatatttagaagctttaccaaacttcaccaactgtaaatatttgacttgagggttttctctctttctctctttctctctctctctctctttctttggatttcccaagtagaatgaattcaggatgcaaaccataaatgagaacctacttgtggttactaaaattcctggtttttgtttttcttcactcattgtcaaggctcaaggaagacaattatttttgctataacctggtatagacaggttatttgtaatttaccttaaaatgtagctacagccctttatgtctttagaatcttgggcatgtctccttagatgctcacattaaaccagctttaggagattgttatctaaagtaattatgttactctaataataaaaatattgaatggcaaaacatatgaactattcttttagcttatatttataaaattatatattttatatgccacttatcaatgtatctaggaagagctatgttataaagacaagataatgtcagagaaagataatgtttgtcttcaaatattattactttacaatttcagagatttctaaccacagattggaagctacatatcagagttttaaagttttatatcataaacattcttcaactctcctgacctggctgggttagatccccaccttcaacaatggtttaagaattatgtcttccataaatgttgacaaccatgcacagaggcatcattcccacctacccaagatctctagacgtcagcattcctaaattcctgcctcatctcttagaggattcacagtcagccccacttagtgttgcatcaccctgcagggagcctcatcatcttcctagaaaaccagccaacctagcatctcaacttcccacacgaaacaaacaaacgaaaacctcacctttcataaatgcatccagaactttgcaatcataaaatctagaaactattttgcattcaacagacatctagagttgtattatgtagttgaataatatttttactttgaattacctatggaggacacaataaatttctgatttgaggggacataaagtcttaatgtagtctgatatgtttctaatatgaggagaaataaagtcttaatctggccctggtttcatgttccaacattccatgcttccttttcttgatgtctggatttggactactcctaaattgcccttaaagagccattacaccaataatagttacttatttttttttagtgtctactatctgccagacaacatgtatgtgttttacatacattttctgtaattcttacaatgcttcatgatggctcaatattgcccaactagtaaatgcctgagctgtatcctacctcagctcattgcttccacggtttctgccttctgctgtacgatgctaccacacattgtgagaaaatagccttcccattgttcgcatccagcagatgactacaaaattaaactatttctttcagcacaaacatgtttagagttgtttggcaaataataaaggaagaaccttttactctgaaatcttaattcacatctatgcataatggatgttaactccgaagccatgtattatttaataattatctagttatatcactttgtgtatcaatttatcaagtctggaataaagaaatggcatgacaaatactttcagcttttgtgtttatgaacatcttccattgttctcctgctattaaaatgctgacatatacacacagagcagaaataggttttctttgaatgatacataaatgaaaaaaaaaaaagagaaaacttcagaatggagtttacgatcacagcccttgtagcccttgacagatacttaagtctgccatctcctaaaccttcctgtgctcctgcttcctccctgcaaaatggggataatacacatctgacttctcctaggtaaaagctattcaatgtagacataaattcaaagcaatttggtttcttcagagctaagaattttataaacaaaagacattatcgtgatgctcttcttattattcaggaatgcagccacagtatgggggaaaatccagcatttcacgtcattgaaaaagcgtctatctcttttattcttctatcttagtagcattagtgaaaaaaaaagtctgatatacttgacaagtcagaactattgatacagatgtaaaagttatctgtttgcatgtactgatccaataatacacgactcccagacatgtaaaaccattaaaacttagatgtgggtaattcagaatcatttgaattcatctttaatttgtttgcttattgacctattagcttaaatctagttttatttttaattaactttattactatataatgtattataatttacaaagttttactgtaaaattcaatgaaatgagaaatttataaatccaaataatcagcaccacactgattaagatacggaatattttcatcatcagagagtttccttgtggccctttacataggcccagttttaacttattagaaattagagcttatatctaaggaagtggtattatcagccccatcctgagattatctaagggcttagttataaatcaccttattacttataaactcaggtgtgctcttacgggttcatcagattcaaaacttcagtgcctggattcctgtcaaggggatgtgaatcgggaaatcatctgtttttctgttatgatttatcatttccttaccaaggccttccctgtctaacggccttattattctgtcttgtccttgattttcccctttttccttcttttcacaatttgtatttatgtttgcgtgtgtgtgtgtgtgtgtgtgtgtgtgtgatttaatcacctcatccacaggactggagacctttcagaaataggaatcatgttttctttattgctgatatgcccttaattaaagcctgacccctccttatcacatggaaattctttataattatttttgaatataccaataaatacctaatttatttatacaacattattaaatacctactctaggcacgtgggctacattgtacaaaaatctaatagggaaaaataattcttagtaagaaaaccctattttatgctgaatccataattatgtccctataaaacaacaccttggccaagtgtggtggctcacgcctgtaatctcagcactttgggaggccaaggcggatcacagtctcaagagattgagaccatgctggccaacatggtgaaaccccgtctctactaaaaatagaaaaattagcggggcgtgatggcacgtgcctgtagtcccggttactcgggaggctgaggcaggagaatctcttgaacccaggaggtagagcttgcagtgagccgagattgtgccacagcgttccagcctggtgacagagcgaggctccatctcaaaaataaacaaacaaaaataaacaccttgactattgccatctttagtcagtgaagatattttgcctattaattaggatctaattgacaatatgcatgagggaaggaaggctacttgagaaaaagtataaaagcaacacctttaccctggctttggagtcgggcatgcctagatcctgtctgtgctattcactagctgtttgctcacataaaagtcatgtaacttccctgagctgtgatttacacattagtgagtagaaatcatagttccacctcatatgggtgatgttaaagttgaatggaagagacgcataaggcaaggtatgggagagcagcaggtgcacggaccttccatgctctcttcagttaaaccgcattcccaacacctggaggtgttcatcaactctcttctctccaggctccagttccccctacccttccggaggtcagtgggtggggctaaaagttccagccctctaatcacttggtgtttctggtgaccagtcccatgttgagattatctaagggcccagctataaatcaccttattacaataaactcaggtgtactcttaagggggcttgttatgaataacaaaagacacctgatcactcaggcaactccaagggttttagaagctctaggccagaagctgcagacaaagatcaaaaatatttcttatggcagtagtttaatagattgttttttcaaatttagatgtaggaaatgtaacactatccccaagggtaaggctatgaatggtgctgagggagaatatgtccctaggaacttcttaatacttagaacaaccttgtcagaaagtcatttgactaatgaatccctcagaaaaagtctcttagagtgatgaaaacgttgtgtgaaatcacacagccagcaaatagctgagctaatatttgaaatcaaggaaatctacttcaatgtttactttcttttaataggtaattcttatatctgtcctgtacctactatgtgggatgtattctatgccctgggggcaggaacagcagtgaaaaaacacaaacactgccctcatggagatccagttctagaatataggataaaaggacatatatttagtaagcacactttgtattatctcattaagtccttacagtactctcagagttcagcagagaaaattacattattcccatttcatatgcaaggaaaatgaggctgaaagagagttattaagctggtaaaccagactgaacaggcagtacttaagcctgcattttctggttcaagatctggtgttttgctggttgccaaatcaatgaaaacttcaaattttatccttcaggtaggagaggtggtggtcatattaacaacaatatactgaaccacaaggcaagactaaacatttatccttaagatggagacgagggatgggtaacaagaggtagataaatagcgatggagtggaatgcaaggcaagatcaactgtcagaggtgaacatcaggccttaccaggaggaaaacaccagcctgacttccaacttccagcaactccatctttctgctcgatgtctttcttcagagtttggtctgccccagtatagcagggcaggtcaaaggtgccagggaattaacacccattctcctctcccaagcaaccttcagctaatgactaatggaagttagtagataaataccctttgccccttagaggggataactctgaggaaaaagctcttatactagctgcaggtgttccccagcaggattcaatctcagttactgaatggtaagttggttgataacttgtactaacctcttttttttttcccttgtctcattcccctatcagtgttttttgggattaattcccaaataaatttcctgcaatataatgttttcatgagagtctctgtctgacggaaccaagactaagacaccaatggattcgcccaggtaagggtagccagtcagtgctcataggattaacaggtccataccaaagccatatcaggtatatctgaagatctctttccaacgcaatgcttcactttgcgtaaagactatgaaccacagtttgccaggcctttttctgatggaggacttcactgtcagtaatctctaattctgaaggcaagagatatgaaacgtagttactgcttacaaagcaaatggggattgttttttccatcatccaaacagaatcagatgacagtgagaaaagccttttcctcttttttccccactgccctcactaccagtgttctctctcccttccagcctccctcttttctctcctgcctccctcattttcttgctttcttcctttattccttcagtaaagataatcttacctaaattatagcctttttgaaagaagacattcctttagataaaaaggtaggcagatacaagataggtgattaacctttcctcccttgatgtcttttgttttctaaatccatcagaagatgtatgggggtaggtagaggtaacaggtaagaaataaattattagtactgagctagctgtacttagaactccttgttattacccagtactatacatatagattcttattaagaaagaaaatcctctgtgaaggaaataatccatttcattttccaattgaacacagtgtagctaacagaaataacagaattaactatagaattcccagccccaaactgttgtcattttcttctttagtaaaatgaacacaagtgcagagtgtattaatttcattacaaggtagaaaagataaacttgccccatctttttgcatttaactcccatttggcatgaggccattgctctcacattcattagattaccagagttcaaacaatcatctgtcttggcacttgagaaaaaaacttagacattcttgttttattaaaacatggaatcattggcataggaaacaaaattaacaggtacttgataagggtcccagcccaccatcaaaactgataactgtccttatttgaaataaacagaagaaagcccttcatactagtccttgaagtaagctctatgatcataaaatagaataaaataggtaaactatgtagttataagaaacgaaggagataactcaagtcgaaaaaaaatgtattagtgaatagcttcatcaattaaattcagtgcaaggcgtgctggaaaatgtcactttattgtgattttacccaatcactggcatgctctctttcaatgctcacatattagaagtttagaagagtatgtattcgttgccaagaagatggatattgttgcataaagtatatttcaaaaccatttcaactatgatattgaagcaaatatatgacagtaaatcctaaaataacagaagtgaaaaaaaaaatcatgtccttgctgcttaaagtggaaagcctggtctccagggcatatacccatatggcaagttaaccaacaaagcccacacaagtcctgtaatgtcaatttcattgggtggtaaataatttaaaataccatttatatacttaaacagacatagtataaagttgaatgaaatgttttcatcacttcttgaaataaaaccatagcattctgataagtttttataattacagttggttctttctagccatagctcagacctcagcagggcaaattcacactcctctgtcatggatacttttttggaacaggacttattaagcttagttattagtggtataaacatttcagcaacctttttctgtgttataaattaatattagatcttaagtttggccctttggtcttcaatatagattcctatccatttgtcttggttaaaaaaatgttaaaaataggagtatccattgggcagaaggaaactagggacgctaccataattcacagtgagctctgggtaacagaaaactcagggttccatacaactagttatggggcacttcatttctgagactccatttcctcccacgaaatgtagaagattgatgatttatttaacagacacttatatagaaattaccaggtgccaggtgctgttataagcacttttttatgtattgactcacttattctttatgacaaagctgcgagttacaagtgctatgaatcatatgcaaagtaaatccaagtaaggaaacagagatatatgggactattttagagagtctagtcagaatattttattattttatttactattttatgtgtgatacttggagttgacaattttgaataggaagtaatatttaagaagtcctgattaggccgggcgcagtggctcatgcctgtaatcccagcactttgggaggccgaggcaggcggatcacagggtcaggagatcaagaccatccaggctaacgtggtgaaaccccgtctctactaaaaatacaaaaaattagccgggcatggtggcgggcacttgtagtgccagctacttgggaggctgaggcaggagaatggcgtgaacccgggaggcggagcttgcagtgagccgagatcacgccactgcactccagcctgggtgacagagcgagactccatctcaaaaaaaaaaaaaaaaagtcctgaccaaatcaaagggtcatccatgcagttatctgggagaacaatatttcaggcagacagatcaacaagtgctctgagagagaaactaccttgaggttttgagaactagcaagttggccagcttcctagagagaacctagtaaaaagttgaggagtgggaggtaaaatcagagaggttaagagttcagatttactctatgtctgatagaaaaccacaatgattcactatccttcaagatgattttgcaagtattttcctaatctagcctacactcctttactaatcataataaatttatatgtaaaaagatgatgccctgggctcattatctttgcctatccattcttctcaggaatgtttgtcaagtaactcatgagtacttccttcctaataatcctggacttaattttctaagaagagttctatcacttggcatgtaatgagtcttgataatatgtataactcctactaactcctatgaaagaggcagtaaaagtagaataggatccatatccttcaatatcttcttgggaggataagatatataaaaataaaaactatttttcacatttatttatttttaaattgacataaaattgtatgtattgtgtatgacatgatgttttgaagtatatatatatatatatacatatatatatatacacacattatggtatggataaatctagctaattaacacatgtattacctcacattgttatcatttttatggtgagaatatttaacagccacattttggattttacaagaagacattttattgttaactatcaataccatgctgtacaatagatgtcttttttttttttttttttttttgagacggagtctcagtctgtcgcccagggtggagtgcagtggtgcgatctcagctcactgcaagctccacctcccgggttcacaccattctcctgcctcagcctcccgagtagctgggactacaggtgcccgccaccacgcccagctaattttttgtatttttagtagagacggggtttcactgtgttaggcaggatggtcttgatctcctgacctcgtgatccacttgcctcagcctcccaacgtgctgggattacaggcgtgagccaccatacccggccaatagatgtcttaaattcattcctcccatctaactgcaaatatgtattatttggccaacatctccccaaattctgtgatctttgtacctctctttattgtgctattacacatgtactccaataggctttaataaatgtcatttacgttcagtagcaaaagtcatacattgagaataaaagaaaattattgttggagttaaatttgcatgttaaagaaatgccattataagtgccaggttgggaactgagacagaaaagatcagtcagtgttatgattaccctggctgatcaggaactggacagaaattatctgcataacccatgttatgtggaggtcagactatttaatctaaggtggattacagcatcaatgatatatacggggactctgttacctgacactgtacctgaatttagaaggcgttgaatgaaaagtttggttttatcagttgcaaagagttagtggtaatttaatatacaaatatattcattttactttctagcacaagtttagcagaaatcctttttataatctggttatgagtaaacatttctatagtgatttcctttctttggttctcatttccataaatcttacttacataacttgatttggtataaaaaccagcttagatacagtttggcaaaaatgtaaaataagataatttgttaacagggattaaaatccattcagaaaagaattaagcaatataggtaaagagaaaagagaggtttttgaatatgcagttggggccaacagtctgttataaaatctcacagcatgctgagaagtagaaacctatactagatgaatagaaactgtatgttagagcaggtaagaaggtgagtaaaaacgagactgagagagagaaggccaaaaaagaggctctataacttatataattttttgctttaacaacctgcatatttctttatatttttattgattcaggaaatgtaatttttgaaggatggcatgcaaatggtgtctaggagattggctaagtatctcaaggcctttcacttaaccccttttcgtcttacattcaaattacctgagtgataaaattcaaggagactctcattccatctcagttcaatcacagtcaaaaactccatgtagcaaaaagatatatttctgtctttgtaggacaaaggggataatattattcaaaggcatttgcccaagctttggggagtttggcagcatcttctcacctcctccatcatcagtaggatttagcacatccaaatatcctaccagaagagaaaatctgccaaagaatttttcccaatactaaacccccaacaagaattaaatatgcattcttctgcaaatatgaggggcttgagaaaatggacacatagactagcaaacctttcttctggggacttaagcaacataaagcaaaaaccttaaaagtctgtgtagcctttgacctgagtcaaattctaggaatttatcctagggaaatagtaatgaatatgtgcacaaatatttttgtcataacattcgttatgaaagtgaaactaaaaagtatataaatattggaagtgttagactgattacataaattatgacccttgtaataatttgtagatttacatgtaaatattaggcaaataaaaataattacataactgttaaaaatgatgagaaatagaaacatagggaaaacatggttacaataattcattaaagaagaaatacaaataaacagaaaacataaataaaatgttcatcctcagagtaatccaagaaatgcaaatttaaacaacgaagtgaccattttccacccactgtgaaatactatggggttaatacttcctgtgatgatcagggaaggattctggttggaactggcttagagtattagaaagagttcctaagaaggcagagttctgaattacattaggcattatgttaaattatgggatttgatttacagatgtttaatgttcattctattttcagttctaagattctacatccgacatatttgcagtgggcagatttttaaaagtaatacctattttgaacatattgaaggcatctgttgaagaatcaatataaataattacttaactaataccatacttgaagtagtgcttagtttataaaattaaaacgaatggtctatggtgtccaaaaagcagtcagtttaattttgcagcattattttgttggaagcaaataacagtggcaggtccacctacatggacacaatggagctgaccacggaatgcaatgggggtgtctgaagcagacagagtgactctattgtgaccctttggcaccggaaagaccagcccaagatacaattatacctttgcactatagcctattttgtgaagagaattaatttatggggattcagaagaacttggatccaagtgctagctctgtctcttatgatctgtgggagctcaaagaacgtatgaattttcctaagttccagttccattagtgtgcaggaattggctcatactggcctgtgagagtcaattatgaacacctctttccaggtccatattcaatgatgttatatgaatagcttaaaattaggcatggtaggtgaatttacatcacggaaaccagcaaacactaataaccagggctgcctctacccaaaagacctagttgtaaaacatttaccagtatatcactggtttaaacaactggtttgttggagagttaagaataacatgactaagggatgtaaaagtgccttgtaaaacaacatgcattgtaaggtatcgttaataatattctatgcatagtgttttgatagctcaaaccttgaacaaataattatcaaaggtacccatgaacaaagaagagttgagacaaaagggtaattaatgatggttgatagtggctttctcaaacttaaagcttaatgcaggtgcaggaaaacattaacaaaagatgaaatttaagagaacaacacgagtaaggtaaagggagcatgtaagaagttctgaaaaataaattaattcaacatatgagggtgtttgaatgttacacagaactgcaaataattggaaagatatattttaattttttatgttctgcaaaagtctgaacagatcttttgaaatcattttttctgttttttatttctttcatggacattgaatcaaggtgactgctcctaaacaccaataacattaacatacggaaatgtgtttgcattattaataatcatatgtacaatgtttatatatgaaaaacaaaatataatgttatattttatgaataagtgaaagacatgtagtgacaaaacaagggtacaattaagattttaaatgttcttttttttcctttatttcttaaaaaccgagataaatgtgcagactgtacagatttgttacataggtatatttgtaccatgctggtttgctgcacctattgagccatcctctaagctccctccccttacccccaacccccaacaggccctggtgtgtcttgttcccctccctgtgtccatgtgttctcaatgttcaactcccacttatgagtgagaacatgtggtgtttggtttttggtttctgtgttagtttgctgaggatgatggcttccagcttcatccatgtccctgcaaaggacatgatctcattcctttttatggctgcagagtattccatggtatatatgtaccaaatttttttatccaatctgttactgatgggcatttgggttggttccatgtctttgctattgtaaatagtgctacagtaaatatatgtgtgtatgtgtctttatagtagaataatttataatactttgggtatctacccagtaatgggattgctgggtcaaatggtatttctggttctaggtccttgaggaattgccatactgtcttccacaatggttgaactaatttacactcccaccaacagtgtaaacgcattcctatttctccacagcctcgccagcatctattatttcctgattttgcaataattgccattctgactggcatgagatggtatctcactgtggttttgattcgtatttctttgatgatcagtgatgttgagctttttttcatatatctgttggccctataaatatcttcttttgtgaggtgtctgttcatatcatttgcctaccttttgatggggttgtgtttttttcttgtaaatatatttaagtgttctttagattgaaaaaaaggataagatttataaggaaagactagctttttggcatttaagtgaccaaggcctcactagggcaacacaagcaattctaaaaccccacccaggtggatacagttaatgtcatgcagcctgggatctcctcccttatctattttgtcattttatgagtacttatagccacacaactaaagaaaaaacaataacttaggataggcattatgaaacaaagaacaaattgtattttcttttatttgtatttcctctctcttttctttcccccctatttgttgaaaaaagtgttagtatgtgaaaagaggaatagtcgcagttaaaacttcatattatatataaatctaatgcagagtagaagataaaacattgaaaaaagtgagattagaaaataagaaatcatcatcaaggtgtcaaaaaacagcgaatgacaagtataacaaaaatcatcaatgattttacaactttttgccatgaagaatctttccagcagatccgtacactgcctcctatcttctctgccccacttctcctcccttccttcttccctctccctccttccctcccttccttcctctcttcttttcctcttaggtatctgctctccttcactctctcctccaacacatcatctctgtttagatcagaattaactctacaaaggtccttttctaaggcacacatctgacatgacatgcacacaatgagagacaaccctttcccccactatatcccaggctatctttcccatcacgttttttctgtcttctttctcagtggaccccctgcttcagcaacatttcaacaggatagttcccaaacaccttacacttttagccttttcattgaaaagaaggtagaatgtgcagtagaaaaagcagggttttggcaaaatcacatcgggtctctaccacttaacagttgtagtatgaaaagcaagttactaggcttttcaatgcctcagattcttaatgcataaaataatgataccctatctagggtttttgtgaaaaataaatgagataacacatgtgaactttcattaagataactttgataattagtcaactgtagtgatgataaaggtgataatgactgtgctggctgaatatttcccctctgctgctccagatttgcctcgtacttttcccactggctctgtattccaaaatgctgaacttcatggacttaattaatgggctcctttctctttggtgtctggttggagtagtgcaaagagaggttcctgtaggagatgaatggagaggaatctttggagtatttattcccgaggctccctcccagctcctctacaggatggcaggggttgcattattctgtcaaaggctgcagcttctataaggtggctatttctcatggctacaccttctcttcaggtctgacagctagctcttctggctctttctgttctagaaatggtaatgtatatcattggggtgccacctgtcctgccaggattctgacaaatgcagtaattatgattgttgtctttgcccgcaatacctttatttaacctcttctaaacttatcgaggccctaccctgttctcaaagaatgactaaaatgctattgttttaaataattatgacaatgccacccctctcctttttttttttttttcaaaggatgacctcaacttttcctggacgcccagaataatatgcatgaaactttaatctagtttggcaagaagcagagtttacataatagtaatttggttcctgcctataaaattgtgagcctgttggagatcagggactggatcctactcaaatataccctagaaacacttgctacagttatttgcacatggaatatgaatataagattttttaaatggaattaaatcctttttttggcatcatctctattcttctcccaattccttaagatgaagattaatttagtctctctgctttctttaattatctctctaattctgtctttacctatttttttataccaaaggacgcccacaacctgacccaataagccaaaatcttttccccttaaaaaccaagtagaagttggtaacactcatgtatgaataacttttctttgctaatacacattcataatttttgccccaaatatctttaaaaatatacccctatatctcaacttactttcttcaaagctgtcttttttgtttctttctttcagcacatgctaataagtaagctttctttcattgcttatttctgtacttttttgtattattaaaacaatatgttgctcttttctataaaagatgaataaatatattctccaaatgattcgtggtagaggtttaaagaaaaaaaatcagcttactttattaacttaattttctttttaaaaaattattaaacctaacaggtagtctatttcaagcatttgaaaactgaaagtctcatagatgttatttactctaaattatattactaaaaagaatattctgtcagaaatgaatttctacaatgtaccataaaatgtatgtgattatattcaaaagaaaaaatatatatgaagtatgagaacctatagcactactgtgctgagctaaagcttggctagtgagaggctaaatgttgcctctccctggaatatccctggaatatttcttttgacataaatttcttttgaaatattccaggcatacttgcatcacttgggcacctgcattcaggcttgacaatcagctctttattgtaatctcactttgtgtaatcattttttgccactgtaggtatggcaaggctgaataatttcatccataagtgagctgcagtgacttttagagtagaaagtagtagctactgaaatgtatggaagaatgtgactgctgttaaaactagaggctcagccgctttgtgtgtgtgtgtgtgtgtgtgtgtgtaaaattccagaaggactacacctttgagcttgccatataaacctttgactgaggaatttcatttggagcaagccagcggaaatttaattttcaattaaatttaaaaagatctaactcaataaggagaagtgtgcctttctcgttaggagatatagaaagaaaacactgaaaaccaaatccctgccaagggatcttattgtagaagtctttgattaggttcactgacattttaatattctgcaagtttaaaactttcaaagaacactaatatatattacgtaacttgtatatttaatttaaggcattttatttcttattctctcttgagctttagcaacactgtattattattcgacattgttatattaatatgtgtcctctcaattgaaatagaattgggtccttcaaagagagtgctcattctgaaacctctatcatagttaactctaaaactgtgtcttcattcctgtcttctcaggggagtctgggcccatcgcctctagttagaggtcttactgtcacatcaaattcaatttaatttgttatttctagtaccaacctcaccaattccttcatgtaggtagcttttcctccatttaaaaatgtattaaatttacctctatcactattagatttgtagcatttaccacataatagaaacacacagacatatacatatacacattctagaagtaaaaggaggagagtaaaatagaattactttattgctgtgcttgttttagttatccattgaaaatggttttagaagtggttgtttttagaataagacaaacttctctttctatcaagtttccagacattggtgtcagggcatttttatctcttccttctcttcatttcccacctccaatcaatacttaagccttctctatggtttttatatgactccgtttttcttccttcctttttattttttatttcaccaaccgtgtgtagactaaaggttacctcattcctttattcattcaaccaaagagcatttattaaatggctggctattagcaaggtattaaggtactttaattcctaaatatgccaatagctttctaatttttctccaggactctagttccttcctgcactaccaatgcattcatatttttcttatctttattctaattccttgttttcaaaattcccttgacatatcgttgttcattggatagaatttgaagttttgacttacattcgagatttctggaatgtgcggctgggtgcggtggctcatgcctgtaatcccagcacttagggaggaggtgggcagatcacttgaggtcaggagttcaagaccagcctggccaacatggtgaaaccccatgtctactaaaaatataaaaattagctgggcatggtggtgtacgcctgtagtttcagctacttgggaggctgaggcagaattgcttgaattcagggggcagaggttgcagtgagccaagattatgccactgcactccagcctggcagccagaaatccaaaaaagatttctggaatgttgctactacctgtcaatctttgcctttcattatggctaaatgtatttaattgatgaccatttccagccagacattagcttgctattctctttatgcatcctctattttcttcatttctatataataaaaccatatattcagattaattaacagaacaggtgaaaacaactctccctactctatctccaccagattctgactatgtatacttcagaaaatttgctttgacatttctagacaaacatgaatccatctgcagcattctccaaccaaattgttcttattattatttcttatttgttctttaaggaccaagttaaatatacaacaaggataaacatgtttctagattttataaaggtactgtgaaaaagctattttaattcattcttcccaccaacattggtccaggtaaaagaaatttccaactgcattgtgctactgatacttggcttttagagttcatgatgattctatagtccagacactcaagataaccaccagcaaaaatcccaattagtctcttaattcctgtgttgggtgcagttactaaagaaatctccaactgcaggggctaagttttataagaaagaatatatgatactactacatttttgtttctagggctatatgtatatccctatatatagagatgcatatataaatatgtatgcacttatgatagtttatagtggtgcataaactatttatcaagataaggaaagaaggaaggacataagaaagggaagaaaagaaagaaaataatttaaaaacaataaaaaaaggagggaggggcaggttaaggaataattgaggcaaagagaaaaaaaagatagaaaaatataatgagccagagtaaggttatagaaaaaaatcacttatgatatggaaaattcacttacttgtaactcagcaaggcagggctgaaaggctagccataaatgtgtaaagcactattcaaaggttattattgctccttaatgaatggccctatttggaggcaaatgattacacagaattaaaagcacagacgcacatttctcagctcacctaagtccctgtgccaagattctggttatcacagaggagaggtttctaaggccacagcacacaacttaagaaaggaagcttggatttgttgccaacacttgcaaattttcctaagggtttctgctaatttgcagcacatagcaaaacaagtgtgaaagtatgaaatgacgcatgctaaagggaaggttgaaaaagcggggagaaggagagaatggttctatttcaggaggatgcctgatttcattaaaatcaactgttaaccttttccttacattatatttactgaatcactataattttacaaataagtctgtatctcagtcttatccataaatctttctgtgaagcaagcagaccataagattcaccccaatgaagtcttctttgttggccaaagcattctaacagaataaaaacttgtaaaacaatgtgcatttgaaatagtgtacagaaagcccagtccttgactgggcaaagtaactcatggagtagtaagagtacagcgagagggagggagggagagaaagacagaaaagagaagcagtctgactattttactaatttgcttaaaattttttcaacaaccctgttatctgtaaagggaggaggcagtgctgagggactgttgggtaaaaccaacactcgtctaggttcatatagagtcagtaacttacaaggtacccttgggtacatcatttatctcctttaaatttcagctttttcatgtggaaagcaagaaaatgtttatgaatattgtaaatattttcctctatatgtttgcttcactgagatcactttacagagcacttaatacattgcatggcaaataagaaacaccagaaatatcttgagtattatcactattattagtttcaacgtggactggtagatttggaaaagcctccagaggattatgcttttatttctacatcagggaactcaggaccagggatgcttcctaactttctcaaagtcattcaacatggatgaagctggaaaccatcattctcagcaaactatcgcaaggacaaaaaaccaaacactgcatgttctcactcataggtgggaattgaacaatgagaacacatggacacaggaaggggaacatcacacaccacggactgttgtggggtggggggagggggagggatggcattaggagatatacctaatgctaaatgaccagttaatgggtgcagcacaccaacatggtacatgtatacatatgtaacaaacctgcacgttttgcacatgtacccttaaacttaaagtataaaaaaacaaaaaaaaaaaaacaaaaaaaaacaaatagaaagatggcctcctggtccatagtctacagtcctcctggatgacaaagagaaccactttctttgaagttcataaaaagggaagaatttagaaaataggccccacagtggtttatgaacttctagcatttcctttaaaagcttctacaaacattattagaaataaatttctcctgctttaatgccatattcaccatattaccatatgacactaagaacacaggacaggttgtcagtaatcaccccctcccttgcatcaccttaactcccactgggcacctgtctaaggcatcattttcatgtaggcattatgtgaaaaataaattttgaacacatggctcatgtgtttaaaatgaaaacttcctgagaacaagtgaaaaaaattcatgttgtataccccattgtggatggtaattattttctgtgatcccgctacaggatcatttgcttgtccaagatacatttacatagagttcagccatctcatctttcagaaacaaaagccaacataattttaacacccacttcacatttcctttatgaaagaagaaatcagatccatcctatccatttcttacgatagcaagcacaagtgtacaattttacaatgttttatcttgaactttgctgtggatagttatgtacatgagtcacttttgttgaatctgatgtggatttttgaatagtgttaaatgatttaatacatttccctgttgagactctgataaataatactcatattgtaggaagactttaattttatatttcatataaaatctggattattattacaaagctggcttaacagatgtgcaggggtgtgtgtgtgtgtgtgtgtgtgtgtgtgtgtgatgtttcgaagtcattgtaaaaggaaaagagagcatcaggatcacacactaataatgtccaggttattatctggtgcagttactcttctcctgaacccaccactagaatcacagtcattgcatattagagtagaagggacctcagataccatctagcccaacaacctctttaaactaatcaaactgaggctaaaggacatgaaaatcatacatttcacgatagagagggagaaaggcagggagggtgtgagggagggagagagaaataaagggagaaggaaaggaagagggagaaaggcagggagggtgtgagggagggagagaaataaagggagaaggaaaggaagagggctgaagggagggagggagagagacagaagaagagagggatggagggagagaggaaagaagaaaggaagaacaaaaaaagaaagaaaaagttaggaagaaaggaaggaaggaggaaaggaggaagggaaagagaaaggaagaaaggaaaaagtaacagagaaagagaaagaggaaaggaaagggaaaggaaaggaagaaatagaggttataatttgattcagccttcttaaaaatttattctccatcttattttataatttgtatatgaagaaattacgaaccaggcaagttaggatttacatgaactactcagagttgaacagttgtttactttatgtgggttttctgctaaagaataacaagccacttgcatattaaaataaaaagtctaagagtcattaacagaactgcacaggcataaaaataagaatgttcccctgctcccctaaaccagctgaaaggctgtttagatttttgctcactcatagaacaatcatacaacaaaacaaaacaaaaatgagggccagagccaggaatcccatgagatttcctgtgacttaagtcctgacattaatgagagcatgagactgctgcttcgtgactgccagtggctcgttatcaccaagataaaggctgacaaagtatagtaagagaaagtttgttctctattacaatctgtatttgaaagattcagaacaacaaacgcaataagggggaagtgcactgtgtatgttttacttgctttctattgcatcattagttttgacaatttactctgacatcttgtaattctgatcatttttattctgataaaatatgaaaactcaatcgtcaggcaaaaatttcaacatgtttcatagaatacttttgcaaatgaggtaaaagtgcacaccttcactgtagttagttgatgaaaaaaaaggtctggttccttaccaattgctttcccctcagtgtcaacatgcacaacgaccaaaactggctgacattagagaagttactaagaattcacaggtgcctacctctgaaggctgctagctgcaaaaacaaattcttaagacaagctagaacttatcctttttcctttaaatgtgatagcatatcattataaatcaggtattaggagagccttctaaacaaataaatgtatggatttttttttaacaggcatatgaaaacatgctaagattagttatttaaaaaccaggcaactccagagcaaagtgatatttaataaaccacatgctccttttttttaggatctatttcaaaatctatcaagttttctgagtggcaaaatgattttatccttggtttttctcttcaattcttataattgtaacaaaaaacacataacttacaatatactatcttaaccatttttaggtatacaattcagtggtatcatgtacattcatatagttgtacaatcatcaccaccatccatctccagaattctgcatcttgcaaaacttattttatgtattaaacaagaaatcaccatttccccttcctgccaaccaccattctgctctctgtgtctgatttcaacaactctaggtacctcatataagttgttgcataaaccataattaccttcctttttgtagccaaataatatccatcatatgtagatgccacattttgcttatccattcatctgttggtggacacatgggttgttcaaacattttatctattgtaaatgatgctgctatgaacatgggtatacaaatattcttcaagatcttgcttctcattattttgtggtatgtacccagaagggatattgctggataactggtaaatctatctttaagtctttgaagaatcaccgcattgttttccacagtggctgtgccattttaaatcccattaacagtgtacaaagtttcaaatttcttcaagttcttgccaaaacttgttatttttttattaaaaatattgatttcaatagctttaggggtacaagtggattttggttacatggatgaattgtataatggtgaagtctgggattttagtgtacccattacctgagtagtgttatttgtacccaacaagtagtttttcatctctcagcccacttctccctcccctcttctgattctccagtgttcactacattatactactttgtctgcctttgcatactcatagcttagctcccacttgtaagtgaaaaaaaaaaaaaaaaaaaaccttgttaatttgtttctttaaaaagcagtttagtggtggggtggtatctcattgtggtttgaatttgcatttctctaatgatttatgattttgagcatcttttcatgcttaatgattaattggccatctgtatatgttcttttaaaatatctattcaaatcctttgcccatttgtgaatagggttgtttatctgaaagcccaagccagggcaattaggcaaaaacataaaataaaaattaaaaaacatgcaaattgaaaagggagacgtaaaattattcctgtttgcagatgataggatcttacatgcagaaaactctaaagtttcttcccaaatctgatagaactagtaaatgaattcagcaaaatagcaagacacaaaatcagaacacaaaaataagttgcatttctatagtactaattataaatctgaaaataaaattaagaaaatagctccttggatttttaagagtttttattaaatatatttggtagcaaaaaagaggcaatagcaatgacataaaatatgcatttaaaatttagattttcattaagaaatctaaatttcataataaaattttaactcaccttaaatgataagttcactttacccttgagcaatataggtttaaattgccttggtctaactttatgcagattttgttccacctcctctgcctctgtcatccctgagacagcaagactaactcctcctcatactcctccttctgagcctactcagtgtgaagatgataagggtaaagatcttcatgatgattcaattctacttaatgaatagtaaatacattttctcttccttatgattttcttaaaatatttcttttttcttgcttactttattgtaagaatatagtatgtaatacacatagcatacagaatatgtgttaatctactgtttatgttattaataagccttccagataacagtgggctattagtagttaagttctggaggagtcaaaattaaatgcagattttcgactgtgcagggaataaataaccctaacccccaccccatattgtttaagggtcatctgaaaacagaataatttaattttggatatgctagggtttatctatcatttaagctttcattttgtggttgggaaagtgacttgcctaagttttcacatgtaggtctttattcatattgtatgctacctgttcctcctttccccataaaataaacacacacacatgtaaccacatgcaaacgtaattaaagaaaagtgatatgcgaactctataggcttaaaatgctttccctccaacttctccctctcagtagctctgtggtaatgaacaaatcactgagctctctgggcttaattttcttcatctgaagaaaaaagaaatggaagagactcttactgtcatcttcttggcacagggtaccacaatggctttccagctgtgctccattatgctgaagggttcaacagattacttctgggactatgctgagggctgagatgtgggagtggtaggggtggcacctgctgtgcaggtggagcttagactgatcctttctgcttcacatatacttcaaacggaggctatgctttgtctgtgttataaattaatacttgattataagatatatttgaagccaggattctgttactaatgttaattattatgatgatcaaacagactggtgctttgaagagaggctgtaaaaatataagcagtattaatattattaaatcaattagtattaatttataattattatttaattcccatattaatagcatttcttaagtgaatcacaaaattgcctcccctatgacatatatttgcactgaatcagagttgtacataagcaaagcagcagcttgttttttaaaaaatatttttgacaagtaagtgaaagagacaggctccataagctttctaccccagggcttcctattctaggcttctagctatcaaaataaaaaataataagactttcagaactttacttgttactgttttgggagtcagaaggtccctgaatttttaggattttatttcgttccacagtccatgaagttgtctatttcatcattattttgttctagcccttgaagcaggtagaaatccatacacaaggctattgatgagctgagaaagtacatatatgtaaatatataaaatatattttgttaaatacacataaatggataaacaaattttaacacatattttccctcaccatgtgcttgcaagtcttcaaaacctgctgcaaaaagaagagagcattgaggggctgatatttgccaatcattttctaaatcatgaactgttttagaaggagattagagaaaatataccttaccaactgtgtatttaatattcaaagttccaactatttgtttaaaacctttagagtccccgaaactaataacatgctggactgttaaaatataaatttgaatcatcttctgatgggggtgggagacacttttgaagggtattaatgagccatttattaatgagtgcaccaagctgattgccctacagcctcccctcaactgggcttcattgttctgtgtttttgccacagtaatgatggatatttgttttacagaaagtgatggttttgtacaaataatatatcctcaggagatcattcaagataggcattaagattttgtgagtgaaaattcttgaaaagttgtttattatagtagagcactgaaaacaagtccagagttaaaaaaataaggggttatttaaataaacatatagtatatctaagcagtaaaattttgtgtctaaaagataacattgtagaaaattatttaatggtatgtggtcattaattatactgttaagtgacaataatcagaacacatataaaaaaagagaaaaacagagagcagaaaaggaatagaaggacatgcaccaaaatcactgataatgacaaattcttcgacatgcatttagaatattaatcaattcacgtgctagttccttctatttttagttaaaaaaagttcactcccataatgcagtagaatggataggaaactatcaaatccctgtctcagtaactccaggaccttgggtctttctcttagctccctctccagcctgtctacttccacttctgacacagtcaaaatgtttttgatgacaacaggcaggataatatattttaaatgacgtctggatgttaatactttccaaaatgatcaatggcatcccattatattgacaataaatcctaaactctttactgcagcgtgcaaggtcctgcatgaaatggcccttctaactgctacctcattctgagatgctcttgctggagctcacttggctcctatcttccgatcttttctccaattcagggtctctgaatgcactaccattttcctggaagtattcttccatttgtttatccatgaggacccagtttaaatataatctcaaatacactcacaaccttagctaagggaggccatgctgtatcttgtaacactttctataacagcaccttagtttttaattattttatttgtccatccgtacctttacagaaaaagtgttatactatatgttccatgagagctgtaatcctgttttacaagcaattattatatagtggctggcacatagtaagtgctaaaaaaagttacataaatgcatggatgaaaataatatctttttagtatatttatatgaactgcagttgtgatctctgttatattcagaaagatcaacaagtgtttaacactattcagtttagatttttgcaggatacaatacaccttattaaaccaaagacttgaacaaaattatttccatttatctgctcaacttttcatttgtataaaaaaactgtaaagattgaggatttttatgttttttgattactttatcaaaatcttaggcaaaattgctcattataccactatcacatgtgacaggagtagctatagcagatatgtaaacaatctgctttctctgaccacacaagtaaagccagaaaattatactcttttcataaaattaaacattttctgttaaataaatatacttcatcactatccagtttaattaaagatgctagattaataagcttgggtagtaatcattataatcaacagcattccttaaaaagaacagaattgctatggttttctctcctttgtgattcttgaatttaaagcactcacacacacaaaactgatttctaagaatattttgaacatccacaatttactaaagtgtgtcatcacctcactatcacttaaaatagatttttaaattaaatttgcttcaagagatattaccttttgtgaagcattaattatttttagagagagatagggaaactcaagattacaaagtgttccaaatgaattacaatgagtgaatcccttctatcccagcacactcagcttcaaatcccatgcaagaggccctcaaaatgtctatcaagaaaaaaatatgacatgttatctcctcactgtgagtatcttagaaaaggtcagaacctgtctcaaaagcaatgaacagtggagtgttttcgtccagagagctgcagagtataagaagacgcttttattaggttatatttaagctgttaatgttaagataaagccatacaatataggacaaaatcctttgtattttttaatctaatgtatacattttccttccatacctacttagatgaagaattgtacatatgtacccaattctttgtactaataaaagaaatacatgggtacacatatgcatttatatacccttacagccctttagaaatacacaatttattgcaaatatcaagtacataagtatgtagattgtaactgacctagtgaataaatcactgtagatggaaactattgcaatatagtaaggagttcagataaaaaaaaagctgattcagttatatattgctgtggaatttataaaagaagtcactggggaaatggttagtctgtgaaggactctggcaaggccaacttgtttctggttttcagggacatgaaatgggcagggaggagaagtttaaaccaagccctattaggaatggctgcagttcagtggtgttcagtcccatacttttcctttaaagacattatgaaagccaacacagtcctaggtgctacatttaaatgtcataatgaataaaatcaaagcagatcactttaacatattttatttgttatttatccagtaattatgatagtaattatattttaaaatgtggcattggcctgaataataagcatctgataagtctgataatatagaaataatacactacataattattaggagataattattccataaggttagaaaaatttcccttaattatgtaatacatagtttgtggttccctgcagaaacatcaggttgctatttcactttacgtgatgaactcttatagaactctcacaatccttctcaaatgtggtctccttcaagaagacatccctaacaaaatgccattcctactttcaatagtgtgtcattaccttgtgtgcaatatctgtgtaccatgtataactttttattgttactcatgtcatactattaggttgtttacatgcttgttggatctactaaactgtgagtatcttgaaagtaaagactcagttgtattcatctccatatccctcatcctgcagaaaaatatatagcaaaaggtaggttctgaatggatttttatgagtgaactaatcaatgaatttgtggccatcttctcagaaaactctaatcattaactccttgggtggtaagaaaggggactgaactatcattcttagacttgaagcactaaaaactaaattgaaccacaatttaaggaagtctaagagaggttccattttttcccccagtggataactactatttttaatgaacagagatcaaactccttcaataatttatttagacttcctaattttctggtgtcatgagcatatgattagtgttcttgttcagtaagaaagcactgaatatttaagaatccaaaaattacaaggacctagaataagtcctaactctgccatttattacttatgtaatgttaggccatgtactttttttttttttttttttttgagatggggtttcgctctgtagcccaggctggagtgcagtggcacaatcttggctcactgcaacctctgtctcccatgttcaagacattctcctgcctcagcctcctgagtcgctaggattacaggcacccacgaccacgccaggctaatttttgcatttttagcagagatggggtttcaccatcttggccaggctggtctcgaactcctgatctcgtgatctgcccgcctgtgcctcccaaagttttgggattacgggtgtgagccaccgtgcccagacggcaatttacatttatacctaagggtcagttgccttattttctcatctgtaaaatggataagattaatctcttaaagtaaatggcaagattaaaagagaccatttagattgggggcttagcatataggaagcatttaataaatgcaaatgatcagaggctgcagcctcttgattataagggaactttcttgattacaaggaaatttttgattgcaaaaggaaatgtctgtgctgtttcaacatttaacataatctttaatatggtttgaggtagcctttatatcaagttaaaaactgtctttgaaaatgtggaatgaatatttttgatttcaacaaatgtgtttttagtaccaatcaaaatattcatacacatttttcctcctttgatctataacatgatcaattactgaagtcattttctaattttgatcagtccagagtaagtccagagtaacatttccagagtaaatccctcataattaaagcatattattattttactaaactgcagaattaatatgtcatatatttttttctcctttgtagtcttttatgttacttttatagttcgtgttgttttactgtcagatttaggctaacttaaggaaatgaatagggatgtttccatcattttttccgatcagcaaatagtataaaagctatttgatcttccagctttgcttagttttgaaaacttcttgaatttttgttttttctcaaatgtatatgctgtgtaaacaaagaaaaacatttattggatatttattgagcagtagttcacaaacattatttcatttttgcaatactaatctatatttagtaatactattgccattttccagatgtggaaatagattcagaggggttatttgcttaatgtaagctgttgtataaaggtaagactgttcataagcaagtctgactccattagtccatcttgtccttaaacatagaaacggaagaagaacaagcctggccaatacatttcaatctcctataagaacaaagaaacaaatgtggagatagattaaaaaaaaaaagaaaagaaaatatcacttctctattttacagttctgaaataaaacatattcagccaaaaataaaaaaatcagccttaagaccaatgacattcataaaataatcctttgttttaaaatttctattctgaagaatctaaatttgcaacattgccaataatagaaatactacaaaagaacaaagttatgtataattttatcggtaaatataaatttattttcaattttaaaaatatggactaagaaatggattataaaaagtaataagtaaggtggctgccaatataaaaggttggcaaattataattttaaaaagtgagaaaataattgcatggtagaaaaattgaatataaagaaaaaataaaagtcaccaacatcaaatgacacatttgaatgtttggcagtgctatagtatatcaaagttaagaaggccattgcctcaactgaggaagaatagaattcatctttttgtatagtttcttagagtcctagtattacaagtttgtgacttcacaaaggaagtctcattgcccaaagaaaattatagctccaaaatatccaaacatggcaaaacgtaaaaataaatctgcatttccaaatactctagaagtaatatttcttactgtaaaacttatttctccttcaggcataagcactaagtctcttcttaattacaaggtcaattttagaaagcagcaggtgacattttcttattgataattagcaatgccatttatagtgaatagaggaacattccttcatggttatatagtttttaatttaaacttgctggctcactaaaagacttgcttcatctatggttataaaacttttaatttaaacttgctggctcactataaagattcgcttcatctattgtacaaacacatttttttcatatatcacttcccatctaccatatgcataccattgtttgtaagaaagacaataaggcagatcaaggggattaatttacagctattgctggggaggggccagggatttctgtatagatacaggtcacagggctgaactatagtaccatttgttctctataaaagtaatatgacccatattcaaagagaataggcataaattctgctaaagttcagaaaatttttaccatcactcctttctttctctgtgtcaaacccataggtttgcacaaagtaagatagccctgtatcataacatttatggagaactgacttggaatacctttttctgtattcatcattcttttgtggccatgtcgagagggactagattttcccatcaggcatgtaaatttctcatgacttaagaaacgaatgctgaaaaaatactaaaaatactaaccaaatttcaaagattcctgaaatgtttaaagaaaataatatagttggtgattgtataaatcacttaataataagccatttaatatctcccaaggtaaatactaaatggctttccttttgcccaaattgtcatgatcattatacagtagaacaaagaaacaaaaaaaattcaaagttgtagaacacaaaattaacacagttgcatttgtatacactaaaaggaaattaagaaaacaatttaatttataatagcatcaagaacaagaataaacctaattaagatgaatgacttgtaactaaaaactacaaaacattgctgaaaaaaataaaaaaggacatcaataaatgaaaaaacattctattttaattaatcagaaggcttaatattgttaaaatgtcaacactgcccaaagcaatctccagatttaatgcaatacctataaaaaacccaaaagcattttttttgcagaaaaaaaaaaagccatcctaaaattcatttggaatttcaagggacaacaaatagccaaaaacgtcttgaaaaaaaaaacaaagttagaggtctcacactttctgattttaaaatgtagtaccatcattccttggtaaacatgggggattagtttcaggaccaagggagtaccaaaactcactcatactccagtcctgtgttcagccctggagaacccacatatgtgaaaagtccaccttctagatacaaggattttacattccatgaacaccatctgcatttaattgaaaaaaattcatacataagcgtaccacagctgatcaaacccatgttgttcaagggtcaactataccaagctacaataatcatgacagtgtggtccttgcataaatacaggcatatagaccaaaaaaatagacaactcagaaataccccatctcatataaaaccaaatgattttccacaagagcgacaagaccattcaatgggaaaagaacaatcttttcaacaaactgggaatacaggatatccacatgcaacagaatgaagatggacccttaccttacctacaccatatatacatattaattcaaaatggatcaaagacctaaacataagagctgaaactataaaactctttgaagaaaacgtaggggtaaatcttcaggacatgggatttggcaatgatttcttggttgtgacaccaaaaccaaagacaagaaaagaaatgaaataaaaaatgacaaatggaattctatcaaaattgaaattgtgcatcaaatgacactatcaatagaataaaaaggcaacctacataatgagtgaaaatattttcaaatcatatatctaaaaagaggttaatatccagaatatataaataattcctacaactcaacagcaacaacaaaacaacctgattttttgaaagaatgggtaaaggacttcaataaaggacttaaaaagaagatgtgcaaatggccaacaatcacatgaaaagatgctaaacatcacagtcattagtggaaagacaaatcaaaatgacaatgagctaccaactaatacccgctaggatggctactattaaaaaagaaagcagaaaatagtaagtgtttctggggatgtagatgaattgaaaggtttgtatacagttagtaggggtgtaaaatggtacagctgcaatgcaaaatatattatgggtccacaaaaacttaaaaacataaattccacgtgatctagcaattctactctgagtatatatgtgaaataactaaaagcaagattttgaagagacatttgtatatctatgtttatagcagtattatttacaatagccaaaagatggatgtagcctatgtggccattggtagatgaatacattaataaaatttggtacacatatacaatggagtatttttcaggaaaaataaaaaggaaggaaattctgacatgtgctataacgtggataaactttgaagacatcatgctgaataaaataagctagtcacaaaaggacaaataccttataattccacttattatcaggtacctagaatagtcaaaatcatagagacagaaagaatgatggttgccaggggctgggaggaaggagggatggaaagttatttgttcatggatacagatttccagttttgcaggacgaaaagagtcccaaaggttgatcgtggtaatggttaaacaaaaatatgaatgtatttagtgccactaaactatatacttaaaaatggttaaggtggtaaattttatgtcatgtgtattccaccacaattttttaaaaagtttccttttttgagtaaagcttgaaatggaatatacagttaaatattaagagaatgtcctaagactacatgtcagaacagatcccatctttgccaaataatcctgagacactctaggtctaagaaataagggaaaaaaaattaaacagtaaacgatttagaactagaatattcaagttaatcatcaataacctaaaacttcaaaaaaggaaatgaacccatgaaactgaattatcagtgaatgtcctttgtggtttctcagccatggttaaagaactacatatgcatctttaaaaattaaatcaattaaggatgctacctgtcactaaattagcttacactctgttcagaataaaatttccagggtgattagtggcatgatttataactccccatggtaattcttagaaaggaaaaatcttatagtagctctacatatgtataaaatattcacatgtgaagaaaactgaatttacttctactctatgttttatataaatatgagctgttttagaggactaatctcatttaaccaaaatgtaagtgcttaatagtggtgcttctcggcttgggtgaataaggtgtataatatctaaatctttgttcgttttcaagatataattcagagaaatagaatgatggagtgttttaaaattattatctttaaatgtggtcttccaataattaatttcagaaacagctacatcgactgccctatttcctaaatcaggtttaaatagaaaaatcatgaagtgcctcactcagagggtgtctctttttcccagatctctatcaatagtgttaagactggtattatgggctcatgccaccaattcccatccattgcctaccccttgtccacattgtctgtcatactaatttataaggaaattaagtcacttggtaggatcacctctatataagccatgacagattgtgaaaatgcctaaaatattttttattcaccttcatgaagaggaggaatctctttcccaaccattgaaactaggctggtttttcagctcactttgtgtagaagaacatgaaggaagtgaagttatacaacttttaggcctagcctgcaagaggcctttcagcttctactcttggtttgctgccaccatatgaataagtccaggctagcctgctggagaatagacaaaatgtgggagaaccgaggtaccgtagccaatagctagacaattgccagacatgtgagtgtggtcgcttggaatcagtcagtccccagacaacacaacaactaacagcacatatatgatcaggctcactgagattagcagaacccagccatgtttaaaacaactgaccagcagaatcatgaactaaatgaatggtagttgatttgaagtcacaacatttatggtagcattttatgcagcaatagttaattaacatgtaagccgacgtcatttaagtacatcaatgtaataccaaattaattactactttttgtcctataacttgatccagtattccagttattacaacaaggcttgatttctcttttatactctgtttagccaggtgctatgtttagctacacttgtgtcaatgagttccatatgtaagaatcaagatgacataagaggcagtgttgtgcagtagttaaatggtcaggccctggaattaagcaggccttgtttgagtcctttcaaccatacagtggttcattggtcttggataagtatattaatttctcaatttttttcttctgtaaaataaggatagtaatacctgccttataaagctatagtgaggaccaaataatataacatatttaatgtctcatgtacagtaggtcttaaacgggttatttttaaattttctaccacagtgcagggccctagtgtttttgattaatacataattaatacataattttcaacttctttaactcccatggtttcttttaagtgtctttacattctgcactttaacaatacaagtaaaactcttaatagagcttactatgtgaaagaaataattgcacataagtatatattacatattaaatatatgtattatatattatatattatatatgtgtgtatatgtatatatacatgtgtatacacagtatatatgtgtgtgtgtatatatatatatataaacacatacatatacacatatattggctcaattatccacacataagctctaagaggtagaaactattataatattcattttagaaaaggaagatgtctaagagaggataaatcacctgctctgatagtactaaagaagtagtggaggcagcctggcactaaagctcatgctcgtaatactgtgctatgctgctggcctttttccttttatcatggtctggaacattcctgtcttgcgactgtgttgataagggcaatatccaacaccatagcgtttgttaggggttacggggaagtaacttatctagtagaaatcaaatccaatgaaatctacattttaaaattaagaacaacaaaatcaaagatcttgtctactaaagcatcttctccaaaatgtagtgtcttcatactcattgcaccagctgcctatgacctgtgttaatcaaatatgttatcacaccgtattgtccagagaagccaaaatgggaactctctcaaagagaaatttcttttgagtttgactatatttttgttgttgttgttattgttaaatgtagataaattactttctttttgaaatgcctattcagcttgcttctttttgagatctactttaggcgtattttcaagattaaattcatctataactataatttgctttgcttcagagaagatagagtcatttgttttgaagtggaacacattgaagatactttgaactgtattactgaaatcagctacttaaaatgaaattcttctttctgcctttatgaagataaaatggcagattaacagatgacacacacatgcacacacacttgctacaatacaacgacaataatttatcctagcaataaacacttttggggaaaaatgataaatagcacatccccctccaaaataaaatatccctccctataggtttgcctataacatattaatgatacataatatataataaaacatttagtacatgtactgaagtagacataggacgtgtaattccagaactaatctcatatatctgaaaaagaagtaacattttgctcatgtttttaaaataaaactataaattcagtaattcgagagttatatttacaacctattaatttggaaggtaaaaaggatgaaatgaattttgcatggactagcactactctgccaccattggtagaaaagcaatcaaaacattgtttgttttgttatttgttagcttgaagggagcactaccaatagaagtttttaaatatgcaggtatactgtgctgatgttttcataccctttgccatgtttgtaaaagatggggacagagaggttgcccctgaggtgcacatggcttaaatggaggtttagtgtccatccaagaggatggagctcaatagatatagtctaaggttgtttaaagggaaattgcatcgagcattctttaccctgtttttatgcctgtagcatttctggttgtttttagagtgagaacacagattatcatctacctaccaaactcccctttaacaatcaagatacacttcagatgttacttctttctgtctttcctctgaaactgaaaagcatgaggtcctgatttttactggtattcttatttattaatattttactataatttcctttcaaaggtgtagctatcatataccataaacgaagtctggcacttagcatatagaggcattttagaaaacctaatatctggtttcatacctctcagctgctttggatatcaaataaatcatctgtttctctcctatttattttactctcatttaaaaaccgcacatgagcacttcccatgcagtaaacattaggttagatgctgcaagggatacaaatatgttaaaacacaagaagacatagtctagaggagttgaaaaacacattaagagctcccttctctcctgagcactgctatagatggataatggggcactagaggggtttcttgcaagtggtccagcccacctgctctcacacatgttcctgcttaagagatatgaaggcccggtgtgtatgaatacgatcacttcactactcaaacaactagctattattacttactgagcattcattgtgtacttagcacttgatgtatattctctccattaatcctcaccataatcccatgagggataatcttcattttacatatgagaaaactgaggttgtttataaaggttaaatcatttgcttaaattctacaattaatatgatacagatggatttttcacagatttgtctcattctaaaatctaggcttctaatttctatctaaacttgtctcttcatcaataattttatgctcctattccacagacttttaaatgaatgtcacattagtctaaatcagccctctgtggcataaggacaatgtgttcgttccaaaggtattcctttgtgttatgcatcaggtgaaaaagctgtgccaggaaacatcactcctttgttagatgaggccatctcctcttaaccactttaagatgtaggggaaagctcctaatatagagctcggcataactgataatattatatgaggacattcaataggtcaacctcccctactttcttcaattgagacccttgaaatcatcaaattacattctagatcttattctttatttctgtaaacagtatcacatctgtttcctttgcagagtctctgtgtgtaatacagtcagttgcacccaggacagtagcagcatgaaacatcttcgatcatttccccaggattttttaacattgcaaaatattccttaatcataaaaaggtaatgggttgaagccagttatagccatgtatcactccttaatttaaaatgatgcctcacctaataatgcaatttcacagaacagtaaacaaaacagccatctgtttggcttttatatttcatctgaggatcaggaacaagggtttctgatatttgagaggattctttgggcaatctttgaggaaagtggttaagaaaatcacaatgtgaataataagcaaaggaggaaaggggatcttgcctgccttcatcctctggctgacgaagcagaatcactgcttctccacagaggaaggaaagtatgagattgtattagactgtgtttccattttccaaaagtaggttattttcatgtctaatcaattctttggttcatcaggatggttaattgctgagaaagtcatctgatcaaaacaaccagaccttaacaactgcttggcaatgcagcggggttttcagtcattgacctcaattgactcaaaaatgggtgatttacttagctttaatcagagcagttgctgctattataaagcttgactctgcttttcatcagtatcatggtgggttcagacgtagttgctgctggttatatggtaggtgcagaagatttggaatcagacacacctggatttgaaactgcctctgtcagttatgaatgacttttgacaacttacttgaatttttcaaggatgggttttctcacctgcataataatgaaattaatatctactgcatttagggagaatgtaaagtagtattaagtggtaaacttttagtgcatcctagttccctttggttatccttacactcaaaaggcctagccatataaacaggtagctctaagtgaacatgattctttatcttgacttaagaatctaacttgttaaataattttggttgaaaataaagcatactgtttacttacatacttttttgacaattgtatcatagcagtgaaaaatagaaacagcactattctaataaatcatcttaacagctcagtaaatgtttaatgtttgcttagcacatttatctgtttaaagaaaaatgaaatagatacaaagagtattctgctattatcctgccccagcaaacttgcagaacacattgcaaagacactgtgcattaataagaatatattgtatgctctggacttttttcttcctaaaaacctcacaagagttttaaaattttagattaaaaaaatagtgatagggtaataacaaagcccttttttcttccctatatggtataatgacaatgtgttagtcccaaagatattcccttatgttatgaatgaagtttaaaagttgtaccaagaaacatcaatctctctttggtagttgaggtccatttcctcttagccactctttaacatctaggagagaactaccaatatggagctgtgcataactgatgatattatatgaggatgttcaataggtcaaccacccccacctttttcagttgagacacctgaaatgctagaaatgtctaatgactcaaggaatcctttagttttagagtagaagatggcagtaaaaatagtcttcaagctctcatacactaaactaattaccatactcatcaccactaaagtacttccattttctcatttctctatcttctcttttatggcttcttaacctcactaaagatgtagcccctggtgttccaacagactttgaatccatgcatataaaaattgagaagcaggaaaaaagagggagggatgtaagaaactgaagatagcctaggtaggatgttatgagatttgcagttcagtttcacaaatatgtaatattgggtcactgcttttgcaaacccctgtagcacctatgaagatgaattagttatgtcttcagatttcctatattgaattagatatgtgtgtgtctaattctcagaaactaccaggaagaatcataagtaatccctaagatggggagtcagggagagggagaggctgatttccacgcgcgcgcgcgcgtgtgtgtgtgtgtgtgtgtgattctggatattttgacgagattcttagtttcatttcaatgattgttgattgatgacagctgactggagcatagtgtagaagaagattctttcctcataggtttggcagaagagggtcctggtcaaagtgccagccatgtgacttaggtgggtgaaaggtaccaactttgttttcaaaatttcaatcccagtccctacagcataaaattcaatcttcctagtatggcatataagatttgtatagcatcctatgctctgtcatagcacacaagcatgacaaagtacttataattgacaaaatacaccatactgtttcacttctatgagcctttgttcacgtaactcttttcctagaataatttctctttcattccaatatcatcctcctagagaaaatctccttaacttttaaattcaaaatcaaaagacttttgtcttcattttatttcaaatagatatgacttcttttgttttacctatatttttcctatatgccatcagtatactgtctttaatgaatgggttgcttacactcaatgtcatattacatattagttatgccttgctgggtgacaaactgacctaaaactgggtagcttaaaacaacaaatgcttacttttttacagtttctatatgccaggagctcagggctggctcagctgatggttctggctcaaggtctctcattacattgtggtcaaggtgttgactggggttgcagtgattctggcacctaatggggactaaagaatctgcttcccaagctcacctgtggttgctgtcaagcctcagttccttgtaggtgattaaactgagggcctcgtttccttgtataccaatggacctctccattgagcttctgagaacatgataacttgcttactacagcatgagtgatgagagagagagagagagagagagagagagagagagagagagaaactcaaggcagaaacaacagtctttcttaataacctaatctcaaaagccacatcccatcacatatgtcaccttctattcattgaaagcagtaagtctggccacattcaagaagtgattatagagaacataaatactaggagtcaggaatcattgtcgggggtggagaaggtaatctaagagactgtctaccacatccagtatcttcctaactagacttaaagctatttgagagctgaaaccaaaccaaactcaatttctctgttttcctgtcatctgcctagtgtctggcacagtaaatattaaagaaaggaagaagagaagaagggagaaagagagagcgcaatcaaagataaatcacatattaaatcccttaaataattggaaatgattgatctatagaacaattgtttggaagaaagaaacagaattttaatattttagtcaagattgaaattatgtagaatttctagcaccatggcccttgattatggcattgacagaaacagaatttgtgattcaataactcatgtataagtctggaaagaatcactaaagttagaaaccaaaagatcagttacggtcattctcccagttcatggcagttccttgcagtatattctgtgactctttcagaaagccctgtggctgaaacactgacatctatggatgcagttttatataataaacagaagttcaattatcttaaatgggctattttaaatgttttatccaaagtgaattccaatttaggctgatttctcctcaaaagcacagtgaaaaagtattcattctctgtctccaacaatacttaataggacattttttttccctttcaaatctagtgctctgtttttacttactccctctctctttccctaaatacgtaggtgatgggaaatcaatatgattgatatatagtcattgccctaataattcattgtatgtacatccagatgagcatttaatcaaaaaaccataatgtaatatgaataaatgtgccttaccatactctataaaagcactgtagggtcatacgaaaagagtgattagctctgcctggaaaggtcagaagaccacacagatgagatattatttaggcctttactgttaaggaagaagttatatactagtttgtcatctttttaaaaataaacaatgactattgggggagatagtttagttatgggtcaaacttgtggaaaacggacactgaatttaattaaaagctcattttgacactaaaagacactatgtgagctgaagttgtacctgaatttcaacaaataatttttcccaatcaatataaatttaatatttaaaataataagatatttactaatatacataaaatagaaatatttcaactgcaatttcaagaaaaagaaaggaactgatgatggaaaaaatcaaaaggcaaaactttccctgttattgctcagagtggcaactataagagtttccacttcctattaactgtgattgattttgtggcaatttacatgtattaaaaataaatctattcacatgggttaatttgattgcagcttcagggctaataaaggacagtctgaatgctttcagatctgaattctgtctctattttctttgcatttatggtcacattaatcatgaatgcagaatagaaaaatgttataagatacattttgtattaactgcacttttaaaatacaggattctgatgtttgtatttaatttctattaatttcccataataaaacattgcagataaaagagacgttgacttcagcttgactacattttcaatttattatcagccatatatactgaagattaatcacaattccactagtagaaaatgaacgttgttaagaaatcttgttttaatttctggagagagtagaaatgaggaggaaatgacagtagtaagacaacaagaatatgcattaaaaaaatcccaatcttggattttcttgaaaaaacatagattcagaaagactaagcatagtaattaattgttactttttagcattcaaaatggctatcatctctcttaaaaagcagtggattataaagacatggaagaggtaacagtagatggtttcatgggaaggcatcattgcatacaattccaagttggaaaagtgtatgttaagatgtgatcttgcaaataggcttcctaaattataaaacccacgcctgttatccctttcctactctcccagctgtgacccttcacccctatataaagggaagatctcagccactgggtgtactccaaaactcttccacttcttatttattacacaaatataatttgcaaagatgcaacatatcaggcatcatgctgagccagaaaagcagataagtaagaaacgtcccctctacttagggacatgcaaaccagaaagagatgaacctcaaagcctaggatagtgctgatggaaaggaaaaaaacagatttaagacatatttctgaaagcaaataaagaaatcttcattaaaatctggatatggtcacaatgagatatcactgcactccagcgagaatggtcaaaaaaaggcaaaaagcattagatgttgacatggatgtggtgaaaagggaacacttttacactgcttgtgggaatgtacattagtacaaccactatggaaaacagtttggagattccttaaagagctgaaagtggaactaccattccatccagcaatcccactactgggtagctacccaaaggaaaacaaatcattatatgaaaaagacacatgcacatgcatgtttacagcagcacaatttgcaactgcaaagatatagaaccaacccaagtgcccatcaaccaatgagtggataaagaaaatgtgctctctctttctctctctctctctctctctctctctatatatatatatatatacacacacacacatgaaaatactactatactactatggaatactactcatccaaaaaaaggaacaaaataatgtcttttgtagcaacttggatggagctggaggccattattctaagtgaagtaattcaggattggaaaaccaaatatcgtatgttctcacttacaagtgggagctaagctatgaggactgcaaaggcataagaatgatataatggacttttggggactatgggttgtgggaagagagggttgtgagggataaaagactacaaattgtgtagtcagaaagaatgactacacaccactgaagaacttatccacgtaacccaaaatgacctgtaccctaaaaattactaaaataaaaaaaattaagaaaaaaaggaaaaaaaaaaaagagagaagagtctccaaaatactgagaacattattcagatagaggacagagaccctcctggttagtcaatcatctgaaccctgattgtgtctggcccatgctacaacctgctttctctataactatctatcttgtaagagcactgccagaataaagttcttgagcatcaaaaaaaaaaaaaaaaaatactggagatgggacttgagaaatgacatttttatccttcctgtaattggcttctatcaaaccagaagtcttctgtctcagtattcgccatacattcgttattctcttatgctctcaaggccaaattttttatcacatttactttaaatgagaaggccaatacaatcagatatgaatatttctcttttgtttctttcctaatccataatttggactcacttttattttattctctagtctgagtcacagcttggatatctattcttatctattgtttttaaaaggtttattgactattttcatggaacacttgtacaaaagaagaaggaggaaaaatgaaacactgatataacccatgaagactatattttaccattctattgttagcttagagtattccaggctctctcaatcgactataacctctacatttttcttccttaaactttcattttacttaaaaaaaattccctgtgaaaagacccactttttttctctttagcagagttaacttttgggaaacaaactttgtcactggtaattttttataataaagaacataaactgagcactcagtatacaaatattaaaacaaactcactacaggaaataattaaataatatagaccagattcaaacaactacagacactaaaggctatacattaaacaaaaacctgttcaattttactgtaaagtaattcaagtcttgtttattatgtcattttaaccatatttcataatttaacactctagtacctttataatgttgttatctaagaatcatgtcaaattttatttagcggtatcactatatgtaagaagaagggttattgtgctttgtggccaagaaaacttctaaattagcaaaaattgtgatgcctcatatttctaggacaaaaacatgccatgtaatagaaaaataggagttgctcacaaacgttctaatgatctctggactgtgaggtttgatgcccaattgtcattctatctgacatcaagattactgtgaaggactgtgaatttaacatagaatgacaatgtaataggagaaaaaacaatgtagattggttactggaatgcaggcttacacatttgtcccatgatcttcagtcctgatggctaggattagaatgacaatatcccttcctggttttgtgtatcaagtagctctctccttggagaatgagtatcagactaagaaggaaagtgatatgacaaaggaccatgtgagactgcagttattatgagcaattggggtcaatggagagtaataaaaatcaatacaaaagataatagaatgaacaaaacttggaaaattgttggataaatcaatagaaagagtgcactggggacgtgagattttagaacagtaaatactcactgattgattgacaggttggtttaacattcttgccacttatttcattttcagtgtttctatttgtgtcggccagcagtgatccgcaatagaaagcagttaccaagattactaacttgggggttttattaatagtctttctttctgttcttaacataataaatagcccactccacagtttctcagaagcttttgaccaaattatccatagcaacaacctgtaattgcaaggacttcaagtatttgttatgttttgtttttcacttggtaaagtcaagacttaaatttactctttatataataaaaataattttgagatcctaagaacataaaatcttaatggaagattagtttctgccaagacctttgcaacctaatagttttaactattggcactgaacatagacatatgtcttaatacctggagacggtgattgtcaggattctggcaggaaatgggacagtctgtttgagagagaagaataaggaagagaatttatttatttatttatttatttatttatttatttatttatttatttatttttgagatggagtctcgctctgtcgccaaggctggaatgcagtggcgcagtctcggctcactgtaagctccgcctcccgggttcacgccattctcctgcctcagcctccagattagctggtactacaggtgcccgccaccacgaccggctaattttttgtatttttagtagagacggggtttcaccgtgttagccaggatggtctcgatctcctgacctcgtgatccgcccgccttggcctcccaaagtgctgggattacaggcataagccaccgcgcccggccaggaagagtatttataaaagcgtgtcggggtatagagaaatgaagaagagataaggcagtactgcatggtagcaagaggaggaagtccttaccaccgcaaggcctgatagggcaagggtaaggaacggttcctggagccttgaaagcatagctctgtggagagggtcatatgatacgagctgcagcttttaataaaggaaaggggccaccctttgaagacctggcagagtgaactggggttcaaatacctcaatgtgatggttacttataggtatcaacttgactgcattaaggaataccaagataactggtaaagcattatatccagatgtgcctattgggtgttatcaaaggaggttggcttatgagtcagtggactgagtggaaaaggtccactctcaatgtagtggtcacgatcctgggctggggcccagataagacaaaaaggcagaggaaaggcaaacacttttctttctttgtcctagagctgggacactcttcttctgcctttgtacttcgtaactctagactcttcagactttggaccctagaacttacacgagcagcctccccactcaccacattcttgggtcttcagcatctgactgagaattatgtcatgggcttccctggtcctgaggctgtcacaattggccgcagacatgttactggcatcccagggtctccagcttgcagacagcctgttgtggaacttctcagcctccaaaatcacatgagccaatttccctaataaatcccttcctatacacacagacacatatacacacagacgcacacacacacacacacacacacacacagacgcgcacacacacccacacacacacatacagatcacttctatctctctggaaaaccctgaccaatgtatctcctctccccctttctcatctcttgatgccatctccaattgttaaactcaggaagccaaaggataagggagctacatacatcagacttcttgagcctatagaaagatagagaacaatgaagaggggttctgaaggacaaacaacatatatttggctcagaaggccctttcataatttttcaatgtagcacaaaaaaaattctgccaggcataatttttcatatcatttttaacagtttaatttttagtgttaacaccatagatccaactacctcctcctcttccaaatgtatttcttacaaagaaaaagactttttttcatacaataattatcaaacaagtgacttaagaatatgggggaagttgtaagtttgaaacattggctttggctccagtaatctagttttctcctttccttgtcacaccaaaggcctagggctttcatgatggttccctttctgattatattgatttctatggctattgaaaaaaattatcgtccagctagtctttttctctcccaaaccaggtgggatggtgaattttatgggtcaatttgagtgagctaaaggttgcccagatagctagtaaaacattatttccatgtgtgtctgagagggtttttctggaagagatttgcatttaaatcagcagatctagtaaaaagatccgctatctaatttgttaaggatccaaatagaatagaaaggtagaggaaggacaaattttccttccgtcttcttgagctgcgacatccatcttcttcagtcctcaaacatcagagctcctgattcttgggtcttcaggttgtgggacttagataagtggtcccactggttctcctgtcttcagcctcagactgaattataccaccagctttcttggttcgtcagtttgcagaatgtatattgtgggacttttaggcttccatgatcacatcagccaatttctagcgtaaatttccttttgcatatctacatatgtcctatttgttctatttctctggagaaccctgactaatgcatcagctattggcaagtagtaatgaggaattaagcttacaaatctttactactgccactgaaggtcatcaagggctaatgcctttgtcttaaatttcagaaagccagctgtggaagatagttctgatgtttaagaaaggaagaagaaaatatatacatatatatatatatatatatataatgagatatatatatttatacattatatatagtgaaatatatatatttatacattatatataatgaaatatatatctatacattatatataatgaaatatagataatatgtgtacattatatataatgaaatatagataatatctatacattatatataatgaaatacagatatctatacattatatatgaaatacagatatctatacattatatataatgaaatatagataatagctatacattatatataatgaaatatagataatatctatttatacattatatgtaatgaaatacagataatatatatttacacattatagataatgaaatatagatatctatacattacatattatgaaatagagataatatatattcatactatatatgtgtgtgtgtatatgtatatgtatatatatgtgtgtgtgtgtgtgtttcatatatatatataatgaaaatgcccagtaagcaaggatcctctggcagtcgttagtgctgttcatcaaatgtttatggttctcttgggcatattgtgtgactctgttcccctgcacactggggtttggtatggccatgtgatatggtttggttctgtgtccccacccaaaattcatgtcggtttgtaattcccagtgttggaggagggggcttggtcagaggtgactgactcataggggcagacttcctccttgctgttcttgtggtagagttctcatgagatctagttgttttaaagcatatagcaccttccccttcactctctcatcctcctgctccagtcatataggacgtgctggcttcccctttgtctattgccatgattgtaagtttcctgagggctccccaggcatggttcctgcacagcctgcagaacgatgagccaatcaaaccttttttcttcataaattagccagtctcaggtagcagtttgaaaatggattaatacaccgtgaaactagctttgttcagtgatatgtgttactctgtgaggaaactttaaggtctgtcgtatgattcacattgccatcaccttccctcccatggggttgagcaatgttccagagagtggcttctctgaaatcctaaatcctgaattgagtataacttgatgtgtacatgccagtagcaaactaaatttgggctgctgttagactctgaaatttggtgttatttttcaccctggcataacagagcccatcctgactgatacaatccttaagggaataacttaataccttgtttttacacagtgtcttgtttttacacagtgacattttgttttcctcaaaaccctgatatttattattttatttttaaagagtaaaattatactcaggagtatgtgcattttgtgaattgaagcatctggaattcaggatgctgaaaaaatttctggaatactaagtatgaatacataagaaatttataaaaaatatttcataagtcaaatgtatataaaaaggtgtgaatactgaagttatataaagttacaggtattcttttaagggcagacacaagacatttataaaacgttcacttccggaaaaatgtcttttagctcttcagaagaatttggaaatagtgcccctttggaaaagcaaagccatcaattatgaggacagaatgttacctctgatattaacatactattggtctcatgaattcttcctatatttttggcttcttaaaccttccagagcttaagtgtagtcatgtcttttagaaataccataggataaaaaaattacacaaaaactctgaaaacaacaaaagtaatttacctttggatttaataactaaaggaatataaatatctcagataatgcttttttgtttcaactatgactaccctatgaagtaggattaaaaataaacagagatcacattagaataaaattaatcagctgaaacatactacatatgcctcaatgattaacaagaatattttatttctatcagttatgcaaatgagagcaaagcattttaaagttttcccagttcacatacttattcagaatatataaaacaatttgaatgaaaatgacctagaggcatatctgtaaaagtgtatatacaagctgctatggtttgaatgtttccccaaaaaagcatgtgttggaaacttaatcccaaatgtaacagttttgaagggtggggcgtaatgagagatatttatatcaagagaaatccaccctcatgaattgattcttgagacttacttcactttcttgccctctcacagtttttttctaccttcctgggacagtgcagcacaaaggccttcaccagttgctgaggcaccttgatattggacttcccagcctccagaattgtgagaaataaatttcacaaaatgaccttagtcacaagtatagcagtataaattcattggaggcttttttttttttttttttttttttttttttttttttttggtgaattagcccattctctcttcaggaagtttatatattaaactaactttcagttaaatacagaagctctttgtataaagagaagtatgaaatctaccactttgttcatctttgatagactttacctcatacttcctttgatagactttagcccatacttcatgttagttctcaagcttcagtgaattaacttaggcacttattgaaaaagcagattcctaggaaatgtgactccagataatttgatttggtggccagggtggaacatcccaggtttttctcataccagttgtctaggcattacacattgagaaaactgctcaagacagggactttgacatcttataagggcattgattttcttcttttacatcatgcatttatagttaccacgcttttcataaaaatctacttctcttaataacaaagaagaaaataacatattatcctattgatttgttttccttgatgaatagtcaattattcttccttgcattattcaagtcacctattacttgagatttattgcaaacaaataactctctagaagtctctgtggctgtaaaaattatactttgataacttattgtgtttaagattgttagttgtctctgacttcactgaactaagatactccctaacttcacccactgttttctattgtacatgctcttcaaaatgtatatcgattcaatctttttattattatattttagaaaacttttctgccaagggcagtgtatttgcaacgtatattttctatttgatttgtttgaattttagtgttttgcctgtgatctcggagggatttcttaaatttcctgaacataataaaaaattgttcagttttgcaaattataaaaaaaaagtttcctatttgtcagctggtcagcttacttttcatttttgtttatttcttctttaaggatataaaaaatacatagcagaaaaataagaaaatagctagctaaataacaagtaaatgaatgaccaaccgaaatcctaccaccaagacataaccactttaagtttttggtttgtatacttctctgattgtttatgctaagagtacatcataatttttaacaataaagaatggattaatgattctacactatatacatatatcaaaacatcacactgtgccatgtaaatgtgtacaattataatttgttaattaaagaataataaaatattttaaaatgtactaatgtgctgtatttgttttataaactttttttgtttccttcttcagtacttaccaactatttttcttttttattctctctattattagggccaaaggaacatatacttccattaaatgcattcatttattttcttgtttttaaacatggactctctttgaaacagcaatcaagagtttacattcaggagagccagaggcttctgctaggtaattaggctcatttacatcttctcttacagtgttgaacaccatcagtggtataagcattcctgtgacagttatatatatatattcttacaaattcatggccattcattagttgaaatcacaattctatggttatgaaggcacatgaagcttttggtagtaaatttgcttcagtgatagaggatcaaatccttggtttggtgtaacttcattacatagtatatattttccatatactcaatattaaaaatattaccccaacattgtttttttatcccacaaactgaggacttttaaaagtgaggttgtaacacacatagactgataagctttaaaataaggagtacttcagttataattttatatagactatggcatgtgcatgagtagaagaggaaaaatgacgtaataggaaaaaggaagttatgcttttataccaattgcctcgcttcatctatcaggtgcctattgccgtgcttgttaaaggttctggctgggtaaatacattagggtaacaataacaataataaaagctaacattccttaatatccttaatggataatgtcatttaaacttatggtggtagaggcccatctggagcaactgttgtggggatgccagctgcaggtggggaggcatggctggggctgcacactctgttgagctggttggggcggggaacaggcgggagccctgacccctactgagttggtggggcaggagccccatattcctgggtgcagctgccccatggctctagactcacgcatccttgtgctgttggggccctggtaagcaccctaccccctcaggcttgatgtgcctgctcctgctccctggcctctccccacttccagtggctgctccaatgtggagtaaagttgtggctgagcttgggtgctgtcacaacctggccaggtgtgagcactcttggggcagtgctgacatgccagcccctgctaccttggccccctctggactttgggtgccaacgagtgtgagagggaggccagggagctgagggtgactcagtgtgggcctgtgggcggccctcagcatggacagcctgagcaccacaaacagcacgttgatggtggcaggaggcagacaggttcctaggtgggagggggtggtctctggtggaacctcaccttcaagccagggacaatctgaagcctgggtctgggctggcagttccaggtggagtccatgacctggagtgagaacttatggtgcttttcccagtcccacccatggctgtccatggatcaatcagcacagactttctcccttctgagcccataaaaaccccagactcagccagactcagactgcctgtggatagaagctaccaactttgggtgtcctgagagctgttccgtcactcaataaagttcctctctgccatgctcaccctccagttgtccatgtctcctcattcttcctggatatgggacacgaactcaggatccaccaaacagtgggaggaaagaagctgtaacatgttcctggccagctcgctgagctgcaggtggtgaaacgctcttagactgtgggagtgaagagtggtgacccttctggtggcccagactttggggttcccaaaaccaaagctgctgtaacactatagccctcctgttctctgctggcactgggtggccatgccatgcaacagaagcagcagtggggctgggcaagcccatgagttgtgggccagaacgaggcagcaggactaaaagagctgtaacacaaatgggctgaaacatgcccccatcaacccattcaccacgctgcaggtgacatgaaagagagaagagctacagtccttcttggagtccagaccttggggctccccaagccagggctgtgacaggctgtatgtaacaccctctttggactctgtggtttctggcatctctgagctttcaagcaccaccatattcccctcatccagacactggtgcccacagtggaagtttcttgtggtatgtctggtccaactggagccttgcatggagccagcacctgtgccggtgcctgaagctgcccaccccactgcagcagccagtatgcctggctgtgtgcagtagtcagaccccacactcacttacttacataccccttgccactctgcacctggctcagccttagcaggtgtgggatccaggctggtagtgcaagccaagtgcagtctgctgggccaagtgggcagaactagcccagtgaaagcaagccatactcaggcataaggtgctgctgtctacagaggtttctggctggtgaagtgacaccccaaggatcctgtgacaaagccacccaagaacactacctcacttaagtaatttagccaaagtcacagagctagtgactgataatgccagaagccagggtccagagcctgtgctcttcactactccacatgacaatgttatcaataataatatacattcttaacatgctacattttatcctttattttcagaagttatcgttatttcttgattctgtaagtctgaacccttgtcaatgggaatggtggtttctgtattgcaaaacaacttatttcctctcacttgatagttgccatgttcctcacattgtcccaaagggctggagatacatggtccctacacctcatcctgaccaccctgaagcttgtgatcaaagccacagaacttgctcatcttccgcagatcaagcataatctgacatgtcttgatttgcctctcttggaaaaggaatgagctagaaaaacaggaaataaactggagaaatagctatgtacacagtagcaggcttgtgaaggagacaaaatagtgtcaccatctatagtggtctatcaacatttaaaattgttattttttttacatattttattgctccctttgttccatcagaataatgtgtacagtgtccatatgcaattacacttaaaagtatattatgtagaaaacagcattcagagctgtcagagaaacttgaagtaatacattttgaaagcaaatctgaaacaaaaatttaagaatatacaaggcaaaattgcacctgattctgcctggtgacaatgttacttattgttggcaacatttttaaagatgaaatcctgtggctataattccttttgtgattctctgttaacccagaagggggaaaaaaacatgattatgggttatgatttactacctcacattactaagggcatctgaattcaaaaaaggagagattctacctgacctcacatataattaattctcctgatctgtgcaaatggttacaaagtaatttgaggatatatatcacaattttgatattattaagcaagacagagcaagatagaacattatagagaaaatacattattttataatttggggaaatttttttctttcattcaaggatcctagggaatgtttatttttcattttaccttgaatacctcattatgattattatgtttatcactaggatatggaatgaaacaaattaaggaaccccttatttcataggttctctgaagagtcatcaaagctaattctgaatgacagatcctggatctgctccattattcattttgaattgcacatgtctctccattatgttgttatgcacattcaagcacatccagtttataatataaaatttcaaatactggaatgcttggccattttaagctgggtttcagaggagcatactgctaacagcacaaattttaaacaaggtccaaatccctaacatttattagctatttgtccttgggcaactattatacttaattaatatccaccatgctgaacaaagccttggctttttctttttgctcttcaccacattcaatcaattactaagtcttataatttctatttcctaaacctcttttgactctattcactaatcttgatcccttttgttattacgtgctccaaagcactgttatttttctccctcacctctgcaaaagccttcaaactggttttccttcacctacttatgctcttttctaatccattccctacagagcagccagaatgatctttttacagtgcaaatctgattatatttcactgttaattaaaacaaacaaaatacaagtaagcaaataggctttctgccttcccattccctttgggctaaaatctaaaattaacaggtggcctgcaggaataccataaatgacaggaagcctctatgctccctctcactctctgccctgcagtcacactggatgccttttatttttctaaaaagtgccagactccttctcatctcaggataggtgttcctttctctgccttaaagaatctgccctccccctcagtgcccaactgtcaatatccctttggctgtctaactcttatgaggatttagattaactgtcactttcttagagaatccttccctgaccctccatcctaggttaggtttgcctgatatctatccccatatgactctggatttttctgtattacttttcataattgcaactgttaggtctggacgtttgtgtccctaaaaattcatatgctgaaacccaatctctaatgcaacagtattaagaggtggaggctttagaaggtgattaatcatgagggctgtgtccttatgaatggaattagttgcttgtaaaactcaaaggtagcttgtttgcccttccaccatgtgaggacacaactagaaggtaccatgtgcgaaccagaagagtgagccatcaccagacatggaatttactagtgccttgatcttggacttcccagtttctagaactgtaagaaacatctttgctgcttataagccacacagtttattgtatttcattatagcagcccaggtggactaagacagcaaccaactgatttttcctctaatgagtttgaagtcagcctggggaacatagtgagatctcatctctaaaaaaattaaactaatagatgtttcaaaagattgaaactgttagctttcactattttgaaatgattaatagaatcttctctcagtattcattaaagtctaaatgcacagctaacattggagaactatatatgttgtcaaacaatgcaaacaagtttataacacaaaactttacattacttgcttgatataggaactcatctctttttattgtgatgcactggatatattgggaaaaatttttaaataagaacacatattgattacagtaaggcagtgaaatatcctttgacatctttgtggataagatggaggattatggtcatagtggatgatttataatttgctgattttaattgatgccagagatagaagagaggtctctattcctgtccttgtaccactcagttttatcaatgaattgctaagcttctctgtggatcatactacctagagctgcaaatgaagggggtacgtgcagggagagagacagctagtctttctactggcaaaactgattaagatctaaaaatatcttgaaaagatagaataaaggacaaataaaaccagcattaaaatgctgtatgagtttgaaagttgtgcacctacaaaatggagaatactttctgggttgacagcaggtagtacaaaaaaccttgcagaatttaatagtcaaggacatgactggtactaaaagttaaacaacagcatatcccaaaacacatttaaaaactgctataagacaattttagattttattaataggccatagagtcagaaagcattctgatgtttaaatttcaaggctcatattttgaactcttactgataagacaaaacgcatgcaaaagaagacgtttgttaaaaaatacatattgcatacttactacctatataaagctatttgctaaaggcaattgcaggggagggacaacaagttcttgatacccaagaacatacagttttcaaaaagaagatgatccagatgcagataaatacaatagaagtgagaaaatggaaaggcctagaaaagaaggtaaatctaaaagtgctatggaaattgaaaagaaagtgatttatttccttctgatcataaagaacagacagcttctaggtggaaggagcatttaagctagccttgagtgactggtaggattctgcatctggagaaaacagtacagcaaatagaggaaagagtgtgatgagagagtgcagccacaatacctagggtaagtttgggaatgttaagttatccagtttgactaaaatgtaggacaagtcagggatatatcaagggaacaaagaaaagcattaccaccagattggtaccacatagtgaagggccataagtatcacatcaaggagctaggcttgattctgttggcaacgacaatccattctgcctatgtattcacattcgtgtgtgtgtgtgtgtgtgtgtgtgtgtgtgtgtgtgtgtgttgggaaggtagattttatttggttgttttaatattggccttttctataacaaatggttttcttgtgtctttctaggctatgaatcaaggcatcacgccacagcctgtctatgtgatgctgttgttggattttgcactagctgtctccactgtattccaaagtttacttacagggaagcactggctggattaacaaagcatctcaaagtcctatggcagacaaggtagactaatttcttacttcttgcatattctgccatagtatccacaaacagtttgttttcaagcaaagcacagaagtgcatttcttttttttaaaaaaagtgattatgagcaatgtttaaaataaatatccataaagccagaaaaggagtttaatatttaatagttggcctgttgccaatgctcttttgaatactgagtactgctacttaaagtaggaaaaacaaagtaaaatgctattttatataatactacctcaatacccaacaagttactcgtctactaaagagtaaaacaaacaaaccaaaatcccattttttttctccctttgaagaatcaattctttattaccatacgacgagtctggaaaatggagatcagctagaatgtttataaaaggcagacttggaatgtttcgactgccatttcttacctgattttctttgcttcaattactagtccccacctattggttcaatattatctactttatgaatcaattctgagactgactgtacagaagtaaacttggtgacaccatccactgagacttgaaattaagtcaccaaatcaggctaaattatccagcaatttctgcctttcttagagttgactatagccaaatctcatttccttatcccctggtccttgcattgcaggaaggagggagtgctagaatgttcttggattcgtaggcacaccattccgcattactcatgcatcacaccataacttagactcccttcttgagatgtcttcttgcaatattcagtcttgtggattgaatttcccggtatgcaagatgactgaaacacatctgaacttgtatacactttgaacattgttctttgggctgtcaactattctctcttgcagtgcttctgaaatgtaatctgtggaccccctgtaacagatttaaggacattccttaaaatcagacccctaagtccaatctaagacccatcaaacagatagggtattgggtcccgtcaatctgcctactcacaaacttcctagatgaatcctctgttcattaaagtctgagtataagtgctttttaagaagtgttctatttaacaaatcatcacagttttaaagatagtgaaaaagagtgggcttttgagctgcagagaacaattaaagcagttttggaggaggccaaggccatgatccttgttgctaaacatctagagtagtagcattaattatgaagatttgattagattaggatccttttgctccttttaactttgaggctcagaaaatgaccaaataaaaatggtacttaaacactgaagtatgatcagtcacattggaattaaacatttctctacctaattagtttacttatcaaatcaacctaacccaagaacattgtttctgctaccatcaatccatgccgtatgtcaatacagtagagtgttcctgactatgggttgaagtatgactattaaaaacataatctttacattttcatgactttttaaatgtatatattaacttggctggaagagattcctcatatttccattttatactctattgtcattataaaaataaaagttaaaccacataaaaatgaatgattaatagttgtatttaaatggcccactctcctcattgattttatcacttaattgtggtgaacagtataaatgagcctgagtcctttccttcattttgaatagaaatagtcttaatttttttcattgtttaaattggtagagtagtttaaaagactacaattgtatcttcaaagtgaaaaaagataaaatttttgaatgcaagtgtgtcaaattgtttaacaaaaatacagttccatataactaaccaataggatcaattattagttctaattcttcaatatttccctgtgtttataagaactctacttgggtataatgtttcaataattcacttacaatgttctttatgaacattactctcaataacattatctctccagactttaaaacaattatctgaagaaaataatcatttcatagaaggaaaagagagaagagaaatggcagtagaatgcttatctcacttctcaggctatagtctaacaccaggaaaataatgtttaaacaatggcattgaatgtgtatgcaaacaggttcgataaagctttacttttttaattgaatcaactcatagattcaataaaacaactgaagaaattcagccaaaccaatgaacaatcatcaaatacacaaattcaggtggtttttataaactctttatcttgccacaaattgggttagtatggagtagaaaatgttcttagtgtatttttaaaccaattattcattaaaatatattatgggagcaatattgacaatctctttagaatgaaagctaactaaatttcggatggtaaatctaagtatctatgtttgcaccttggctacattttgccatcagtctgtatgaatattttggtgttatatctgatattataaagggatttagctacacccagtagcctactaaatattttaaatataggcttaaatatagttgaaataattgtactgtcttttataaaattccaactgaatatgtgcataataatgatcaacatgaagtaattatcaatattaagtactgtaaaaatgtaaaattttagtgtatattatttttaaagcttcttgaccattaaaatatactgcaatagaatattgagcatatgaaaaactctaacattgaaataggtagagtacactaaaaaataaattctcattttatttacatgttttacttatttatccaacattcatatgcactagttcaaacaaaatcacagcaattaagatggatgaaaagtgacacttttttagtcttttcattgagatatgatttagaatattttcatatgtaaactaagtcaatattcagacaattactctcatttactaagcaaaagagtagcaaattttactgagtgcacagtccctgatctcaaggactcacatatcttaagaaaataatcatagtaagtaaaataatagaacagctttcacgaactacatttagtagaaggcttgtgtcccatgggatgttaaaccatgtgtgaaacatgtatttcatagaggaatatatatgggaaactctgcatattatgaagtctactcttaaagactcacaataaacatgaaaactgaaaaggctctgactattcctagaataaaaacacttgcttaattttattaaatacataattttccaattttgttgaccctagaatattctttatcccctacctcatgcaatacactgttagcattctacagggctagtgtccttggatcatggtttgtggataatagcaataaaagtataaattagggaaagtgattgcatacaagaagtgattacatctgttggtcaaggaaggttttaaatatagaaatgcctgggctgggtctggaagaattagtagaaatttgctagatccaaaagaaagaagtacagtctagacaaaatgtaagcatatatgtacaaacatgggtaagagcccagaggtgtggaaaaagtgaaatgtactgagttgaaggagagcagtaagagttaacactgaaagaataggcacgagatagtcatagttcttgtatatcttgcttaaggaggagtttaaatgttagactttattgtgcaaaacttaaaaagtcatgcatatttgccaaatatataaaattgggaaaagtttagacttagcattaagatcaatgactctgatataaataaagataatagatttgagtagaatgatactggaataagaactgaaatggcaatatataatgtaccataaaatttcgaaatggttgttaacatttttatttattcaatattttcccagcattttctgtgttccaaccactatgctagtcactgggatatgagagtgaataaaaaagagtccctactctcaagaaattcaatttattatgaaagatgctcatacaaagagataaaatatagtgaggtgcacacagttccatcatttgacactctgtactgtataacaaatgctcggttaatttttttggatgtgtgaagtggatgaatgttggaggtaatatcagtgttctattaaaatataaagaaacctgatgcaactttctggtctatttgttttgcttgacagtaaaattttaatacagtctttcaaattgtgaaataaataaaatattcagatacatttttaaggtaagactcaaagacaaagaaatttcatgattgtctcttctttgtccttagggatatttaagttaaaaagctttaaaatcactacctagattattgggaatctctacaagtttttcaaaagaggagtaaaatggtctaattcagatttatagaaaatcataccagatttcttgctaatactagaatataaatgtatgttgagccctttatttcattgatgctccttttgctcaagatctttttggaactcctccttggcaaccaccttcagggcccacagcacatgactcaaaaagcttcctaattctttactcagtgtcagtgtctttagagttgtttttctgattagtggtttaaaaaaaatcatttggatggctcttctgaaccacatagatattgcatatgaatactgacccatgcctttaatttttgctgcagctgccttgcagtctgtctgcattcatggctggaatggtgaaatgagaagtccgaaagattaaaatggaccaaggagttggaagtaggcttttaatgagacacgctaaaatcagtcttgagtaatgagagtgtcactgtaaatagagaacaacctctcaaagagataacctagaaggtaagtaagaggctggaatgcacaaatcctgttaagacattagtcatactacttcactttattaactctcagattctcagattataaacaataaatatcaatatataccaacacaagtcacttttccattgcttatatttgtcttccttttatgacactttgctaaaattgtttttcaacttttgcacttatttttaagctgtgtctctgttacctctcctgtggaaaaaagcacacacatacacacaaacacaggccaccttcaaacagtgaactcaaacaaaatttccaaaagggttgatataacacctgcagaataatgtatttaaaagatgagtatataggcaacagatagacattagagggcatggtagacatgaggaagtctatacaagaaaagtaagtctcaaatgttgcatttaaacaggttgttggtatttaggatacatacatatacatattatatatatatacacaatgtacatatatattctgtactgtataagttttgatcattgaaactgcaagataaagacacttaaatgaaataagatgaaagtgtgggaagcaatactgcaaaaggaatcaattcaaagcagtgaattattacagctaattcctttaaataggtttttgcacttgacagatatcatagaaaatggatttttccctcaaaataaaggatgacaaacatttctgaaacttcttttttccttaggacaattttaatatagatgaaagagctttagataaatgagttaacaaaaaaatactacttaaccatctgctagaacataatgtgatacatttttgacacctcttagcttctttagctgaatttcagaatgcaaccattagtattaagagcaggtactaaggattttccaaatcattttgttattcttatcaatatttctagtattcttttagatcccttcactcactttctctattgctttccatttcctgaagttttaaataaaatttcccttctgtttgtcttgtaggaaaaatcatcatgcttaccacatagaatatgagttgtaggagagacacaatgggagacatcggttaagggacaaaagacattaacattttaggtgattgtgagttcataatttttccagaacacaagcattgcatggctactctaatatactagattattaaaatagatatatctttgccctacctgataaacactatttgtataagtgaatatatttttaatattaatccaatatatttcataagaaatatttgatttgcaaagtaatctgagcattacgatgattccctatctaaatactggcatggtgaaaatgaggacaaatctaccctttctctaatgtagttacaggcaagctatactcatataataaacatagaacgtacaatcaaaaccaatgcatgagtgtaggatgcaactaaagtcaagagccaaagagtaaaagataggtatgggttttgagaagggaccacatgaagagcaatgtatttaatttgtaaatctatgctctcgtgacagtctgggagaataggccatgctactctcttgcttacaacccagcaatggcattctactattcataaggacaggtacaaactacttacataaactattatggccttcattagacagccttcatctaattctgaaatcctgtctcccacatccccctgccttgtagagtatactctgaaagtacgaaccatttggcagttcttcacctacaccatggcatttttcttttaaccaggggctatactctctgaccatgatgccctctgtatcaggaaggcactattttctcatttgccaggtggacacatacttttttaagactctgcttagcatattagtagtaccactaacttccatattcccatgtgttctcttatatctcatttttatcttcaaactttgtttctcaaataataactaacattttttaacctgttatggttagtaatttttgagtgtttatcttatgctgtgttgtgttttataagccatatgctattcaatcaccacataaactttattgaggtaagtgctattgttattgccattttacacataagcaaagtgaaaaagacttgttgaagtcaatgctggttagtactaagaccaagattcaacacaaggcaactacagggtctggcctggcttgtcagcctatgcacacacttcttcctccaacctgagttgcttctatactggattgactcatttacagcctcccaagacttttctccattctctctatgtcttctaactcagaggcatggtagtgaatttcttacaaataataaatactttcaagaaagtgaagacaaataaatataaaatgtggaaagagtaccaaaagagaaatttgggcttgcagaagtctcccttgatttcagagctttgtaccattctgactgttcattttccagagcacagacaagagactgttgcagatgttttttgagaaattgcccagtagtctacccatttgaaccagtgccatctttctctatcccagactatgaccttgaatgccagatggagttttttttctgacacgcatgacacaaactgaacatacaaacataagatatttgctaatttgaagcttctagttcaagaagttcttgtaaaaatataagaaatgaattggaacaaggattctttttggagaaaactcttgtgtcgttatgaaagatcactggtcctgctaaacatatatgctatgaaccattttgtgttcattccttgtgggatttattcaaaataatatttggctatttttacttacatgttatcttttcctcacccctttcacatttggagagcctccagaacttggaagcaagaatcattttctacaacccatggagagagagtacattcctgaaactgccaaagtgctataaactagccacttaaatcataagtgaacatgatctcttacagagctaattccagaagcaagacagtcaagttgtgcacatcatggaaatatgcaaagctagagagattcaggagaaaccttgacccatcacagtggtttaaaaaaatgttcatgagctctgtgtatgacagtcttcttgcataagcacagaatcttttccttgcaagggaccaactatatagctaatcacatagtaaaataaaagaaagcctttcaaacaggactgaaatgctggcaaagcacacagtgaaggcttaagttaatttaatgtgactaaactatattccataaccttcaatcctcaataatgtcaccatgtcacaaagaaagtttttgcttgtctgttttagagatggggtctcactttgtcacccaggctggagtgcagtggacaatcatcgctcactgcagcctcaaactcctgggctcaagcaattcttcctgcctcagactcactagtggctgggactacaggtatgtgccactatgcccagctaataaaaagaaaacaaaaattaaaaaaaaaccctaagagatggggtctcattatattgcccaagttggtctccaactcctggcttaggcaatcctcctccctcagcctcccaagtagctggaattataggtatgagtcactgtgctgcatggaaagttttaatgtaaatactaattccaagaatataaaactacctccaaccagagaatgagagcaacattgtatatgaatttcacattaatggtctccttttctttcctgtcattgctattttcttttcccctcatataaaaagttactgggaggcataaattttcattaataacacaactcagccaaagcattctcactgaaaagaattagcaatccaggcagggtactggaaagtgaatctcaatgagaatactttacaaggcaaattacaaaggagactataattatcaatttctttcaatgctgttctgcttaatagtatgtagagagaaaagtgttgggaaattgacttgatgcagatttaggaattggtgggactactttaaagagatcaacaacaaattgctcttttaaccttagatcacaacatgagccacatgtcatatgtctcaggagcatgcaaacaatttgtcagaaatcattctctgaatgtttttaaaattatattttctttttacctaatgaaggatgatttctgcagctggattatatgtttcttaaaggcacaagctcctatatttttatacgtcccaggactaacatagtgacacttgttcacagctcaaaatctacttgctcattaactacattttctgtgattttcacttgtcttgttatttgtctcatgacaatttccacctctgctcacttctgccccattattcaccatgaaaaatatcctgcattttagttacattaactgagtcactgttaatatacttgcgtctctttttcttttcttttttgcatataaacatacactgccaagatctggagcaaaaacttggtcatcctctcactgatcttgttagaaactgaagttccccttccaaaattcacttgccattaggtgggatccttgctacttgcttctcagctctcctggtacctgcctaatgaccactgacaggctcacctaacttttgacagacaaattctcattctcccatatcctacttctgaagcttcctagatcaactaactgcccactcttgaaggtctgccctggctacaaatgttaaactcattgctcaccttgaactttgctcaaaaaatccatactctaaaaattggagaatagaaaatctacaaaaagctatgaagcataaagtagtacgtgcctatccttgtaggatttgagatacaagaacaagctgttaaaggtatatagagcccaaatgtgaattatgattttgcattactaaattccaatgcaacatgatttattcaataattatccataaaataaaatcctggcatcaatgaatgtatgtatatactctattataataattccaatagtactctacaaaattattttacattaatttgcaaaaaataaatgatgcttaaattatgaaaataatgatattagtaaacttcaaaaggcaatcaaaatatattccaccatgatgttatggttctttcatctgatcttctggaaataagcatttaaaaggatgggaaggagaaaacttaaaaaaaaaaaaactatgcacatgctactattttcttgaatcttcacaataaccccaaaagttaggtaattacatactcattttaaagttaaggattctgggctaaagagatttggtaacaagttgagagtcagtagggatagtgatacgcttcagctcattgggtagttgtgaaaaatacatgagagttgaatcgatttcaacaaacactgaacattttctatgtgccagaaaaaaaagtctattttcctcatttaatatttaaatgatttaatatttccaggtagatgaatgaacatttagtatgaatattaatatggatctagggtcccatgtagacttttcgctccttagaatcagaaataatatcttttccacaggtgtattcttagcaccacacaatattctcggtccatagatggtaccaagtaaatatattatttatcaaataaataaatgataatctggcattcttataagactgttgcctagacatatttgaaacttcaaagtatttataccgttaagtaatattattgtatgtgctttgaaatttaaagtgaagacaatatgtttgcatattgttactatcaaaaatcagtcttctgagattgtattagataacttataaacataatgcatatgtccaataaaaaccaatagttgatttcaaaaaattattttaataaggtatattacacattcatgttttttcataaactgaataaatgaggcatatatttattcttgtgtgtctgatgaatttacttctgtatcatagtaatcatggttttgtaatttttccaatctgtaaatttgagtgtctcttttatttttatctattgttattttgtcagctatccctttttgacactgacagtatatctgatttaaacagacttactgcctctttctaactccctgcagtctggaaaaccagttggaattatgcttaatataggagcaaatacattatgcacaacactcacataagatatatctcttcttaaatctcagagtccttttaggatcttagttattttcttgggaatcaagcttgcaaaataaatgacctttggacaagtgaaatattgaactgtttgcaaaactatctgagaactattagcaaaacgtagcttatgtctaatttaaacatatttcccaatactaaaaactcagccttgcagtataggtgacttttaaagtccagattatagactgcttgctacaagagaaagatgctattagaaacatacataagaatatagtgcaataggggaaaggaaagcaaaagaaataacttcatgtaatacatagtaatggagaaatgggggaaattgaaaatcttcctggtgtgtaatcagaaaaatgatctttcaatgaaaagatgctatataaaatataatgcatctgtaacaggaaattttactcctccctctgggaattaattcctctactgtgcaggtatttgggaagaagtggtatgatagatggtattctacagcaatgaattcctcccagcctggagggcaagtgtgtggtttgtgtgtggggggaggggtggaggagtgggaggtgaagaaaaggtaagtgagcaagaactcaacttcgtcatacaaatagactaaaaatgtctagaaactgttgtatcatttcctttttagttcaacctaacttttttttaaaaccctacaatctccgcagtgtagaaacaactagagagtattgaagatacaatataaccctaaacacttgggcataaattcattcttgtttgtctttcttctttatcatcatagtctttttcttttcttatatgaagaaaaatctacagtttgctacaaatatttgattcacttttataacaacataaaatgatagaagatagtactggaaattgaagttgattctaaaggaatacaaatcaaaataatgttccggatgggctttttgaaacatattatacaatatcgagataataagacaattcttgatctgcctcactaggagcctaaagtgctatacaagcagtattttcacagtctcagtgctctctccctaccattcatccctcactatcatttacttcgtggctttctgaaatggtgtttcctggccatacagggtatcttaaatttgtgtttactccatcaaaaatagcaacacattttgtatcaaacaaagtcctaatgacttaggttgggcatgtattattttttcttgactggaaataactaaaacatgaaaataaaaagaaatgttagattcttaaagatgtaaacaattgctctaatgagtaacaaatattgagaattgatgtcctgaaagatagggctcacttccctacagctgatgcatcagctgatctgacttagcacagtctgtgaatcaatgtcattgttgtttttatttgcagggatgtggagaggagagtaagaggatagtttctgagagtctaatatggacaaaagttacaaaaacatcaggctccaaaggcaagtagtagttcctgattatatctgttaatgactctcaggcaaagaaaagtaattgttgtgcagtctatgacattacagcaatggtgacagctctacatatttatctcatttaaattttttaactactctgtgagttattagatgtcagcagtccattttacagatgagggaacataggctgaaagagaatcagtgacttagtctaatgttacaaactgagcaaccacagagccaagatttgaagcatcatctgtctcctttcaaaatctgtattcattctcctctaatgttatgtcttatctcaacactattctttatctttatctttgtttacataagtcctaagtcatgctaccttctaatctcatagaatcagagtaactgaatggatttcccagagaacctgactctgtccattagggttagatgaagagagaacagtcatttagctgccattataattgttagtaactgttgcagaatccctaaggtgaaattatttcagtttaaataatacagaattatggcagataatttgatttttaacaatttttttacaaataaaacaaaaaccaatgcccttattttcattttacaatcagcagaaagggtcacacactagaataacattcatcatgctctagctaaaaaaaaaaaaaaaaaaaaaaaattatacctgagtttgcaatttgcaatgacatctcacttttgaaagggatcaagcacacttggtccacaattgaagaccacaaatagggggaaaaaatggagttgtaaatttctgtcacctttctcttcaaccattattttacagggctccaaaaatttacatagattacatataaatgattttttagtttgtgctattatttattgaagggataaaaattaatcataattcttgctcacactcataggatattagtgatgaaaatatctttgggcattttctagtttaattacctccccccacaattttaaaaacaaggaaacagtggctcaatgaagtaatgtggattcatagagtaacttggttgtgagtggtaattaagttctgaggatttttccaaggaactatctattctgaactaaaaattgaaaaaaattacccatcataggatttctaagccaacttggtgacaccttaaagagcaatgtcttttaacattaagttttgcaagacagtgtatgtctgcaaatcgtgggaactacatacagggttaaatatcctgaacaaagaatactagggctagaagatgacatttagtttctggtttacaaaagacacttctgttttacactattatcctcagggagtgattaatagcgcttttttttttcctatcaaaagtttcttggtttgggcaacaaattttattgtttcacaagttaccctagtctttgttattggtatctataattctttacctagatatgtaacatcacgtattaaaggaaaaatgacattgtataggagagcttagccattactttcaatttagtgtgaagaaatttatcaaatctcttttgtctgatgcctgaactataatcgattttttgaatgagtgggatggcagaacaaaagaacactggcaccaaaaggccaaaaaatatataaataagtaaaaaagaaagaaaaatgggatgaagaaaaatgagaaaagtgttcacctgtcttccaattttgcccatggatagtctggattataggtatactaggacttttcatttctactgacaaaaagatcaagtaatgtaaattaaataggagggtttaagacttgagtattaggggcaaatggcttgtaaaaggtcatctgaactgccataaaggaaaaatcatggacatttacttgaccttacacagacaaatatgtgtgcatgtttgtgctgttgtatacaaaaatattcacttaagatggcttcagggaaggggagagagccaagatgagccattgaagagttttataattcaatcataaaaataaaatgaaaaaaaatgatgatttactgaaaatagggtaagcctatgatagctgttttaattgagtgcatttggcaggaaaaaatatctttaacagagccaatacatttaaagcaccttgtattcactcctccctgtcacaataaagataattattttttatttaaagttagaggaaatgagcctgttttcatcttaatgtacttcacattatgcctgtataaggaggaaatccataagttatagagaatcaaaatattgctagggttttctgcatatttatcaagacaaaacatttccctaacacttaaggttgggaagacaatattctgttcagggaaacgacctcacaattcttgtagtctatggtatgaattattatttcataatacaatatttcaatattttcccatgtaattaaattagcaaatgtattttatacaacataggatctaagctacagagtgattggcataaattctattcctgtgttacactataactactttgttatctccctgtttatctgccaagaaagtagttataatcagaaggcttttccatgttcagttttcttgaagaataaacataaattaatacaaaataaatctaagttttatattatagttgtttggatgaatgaacattcaatcttctgtttaataacacctactaatggttgttttcgtttgctgtacatggctgtcatcctcaatgatttttgtttctgaagaatatgttaaatatacagttccttatatgcaaaactaaaaatgttcctgctttgaaagccatgtgtttgtggaagaaatgtattaatgacatctggggtataatttcagggaaaataaacatgcctaaatgaataggtcataacttccgtatttcctctcaatttattttactgtattgttaaagaaactcttagaaattcttggtaaaggccatcatcggctttttattttagagtggggaacttggctatagaaaattacttaatagctcactacttaaggtttccaagacaacatttcaacattggatttgacatagatttcttgagcaacaccccacaagcacaggcaatcaaaacaaaaatagacaaatggaataatattgagacaggatagttcccctgaccagtttgtgggactcatgaaggggtggcttgcttactcagcccgcagtgctcaaaacccttgtgggagtaggagcacacaggtgagaaggtgcaggagcaggggcaagtaactttgggcgccgcccccccgccccacatacaggcctgtggcagtgtctacaggttgcatgcgacctctggatcctgaaagggtgagtgttacagtgtactctttgttttgctgtctgtggatggcttaagtgttaaaacagctcagtggagagtcagtgtgacagcgtcttgcacccatacctgggtccttgtcctctcattccaagaggaatgaggtcacaaggacttgaaggatggtgaacatagaaattttattgagtggtggaagtggctctcagtaggatggaaagctggcaaggggataaagtgggaaggcggcctaaccatccccggctgaactcctctctgaccgttgtctctgatgtccagctgcttcttctcctctcaacgttcagatgcttctttcttttgtgtgtgtgcgctgagtttgggatctggggttcttatgagcacaagatagggggcatggtaggccaaaaggcaacatttggttgggaaaacagggaagtgaagttctcacttagggccacaaattcaggcttgagggtggagcccttgccagggactccgccctcttttacccaatatttccctgcttcctgttcatatcaatatcaagttaaaaagcttctgcatagcaaaggaaccaatcaagaaattgaagagacgatccacagaataggagaaaatatttgcaaactacccttctgaaaagggattaataaccagaatatataaggagctcaaacagcactataggaaaaaattgaataatccagtcaaaaatgggttaaagatctgagtagacatttcttaaaataagacacaaaatggcaaacaggcatatgaaaaaggtactcaacatcgctgatcatcagaggaatacaaatcaaaactacaatgagatatcctgtcaccccagttaaaatggtttttatccaaaagacaggcaataacaaatgctgatgaggatatgcagaaaagggaaccactgtgcactgttggtgagaatgtaaattagtacaaccactatggagaacagttcagaggtttcaaaaaaaaaactaaaaacagagctaccatataatccagctattccactgctaggtagatactcccccaaaaaacaaagcagtatattgaagagatacctgcactcctatgtttattgcagcactgttcacaatagtcaagatttggaaacaacctacatgcccacaaacagatgaatggataaagaaaatgtggtacatatacacagtgaagtactattcagccataaaaaagatggctgatcccatcatttgcagtgacatggatggaaccagaggtcattatgctaaatgaaataagccaggcacagaaggacaaactgatcatgttctcatttatttgtggaggataaaaattaaaatagttcatgagacagagagtagatgatgagtttgggaagggtaggtggaagagggggaggtggtgatgataaatgggtacaaataatagagttaataagatatagtatttgatagcacatcagtgtcactattgtcagtaataatttaattgtacattttgaaataaatgaaagagtacaactggactgtttgtaatacaaaggatagatgcttgaggtgatagataccccatttactctgatgtgactatgacacattttatgcttttatcaaaatatttcatataccccataaatatatatacctactctgtacccacaataattataaattaaaaaaagacagcattccatttcactaaaagtgtgactttaactcaaagtgtttttctcttttattaaattgaacacaaggcatgaataaaattatccagctatctctgtatcacatgcatattgttgaactttagaaatggtgttacaaactggttaaaaatgactaaaattattgtttatacacacttaatccaaactaactctgctgatgagatacaaaggcaaagtgggtggatttgttccactaataaaaataaccctagctgactctctttttttttgggggggggggacggagtctcgctctgttgccctggctagagtgcagtggcgccatcttgactcactgcaagctccgcctcctgggttcacgccattctcctgcctcagcctcccgagtagctgggattacaggtacccaccaccacgcctggctaattttttgtatttttagtagagatggggtttcaccgtgttagccaggatggtctcgatctcctgacctctcgtagtctgccctcctcggcctcccaaagtgctgggattacaggtgtgagccaccatgcctggccccctagctgactcttaacctcagctctttctcctttcaaatcatatactagagtagcaaacaacatagtgaaaacaatattgacatgagaaacgtatagattctgctttccctatgatgaaaggcttataacatattttttagtcattggaattcttctttgttaatgctgaaatcatatatctaaaatgaaccacaattccttaaataccatagcatgcattttctccttcaaaagttagcttataacactgttgcttgtttgaacaacaaactgattaaaactagaaaactacagtaaaattgaagaagtaaatatttttattacatattattattttttattatttttaatgagtaaaaattggttgatccactggaatttttttaaagaagcctaattcaacacagtgcttattggggtcatagattgcaaataaaagtcacatgaaaaattaatctttacctttgagtcatatattagagtaggaaataacataatacaactgtgtcaacatgaataactaactaattctgctttccctgtttgaaaggcttataacatattttcaagtcattgaaattatttccaatgctgaaatcatatatcaaaataatatacaaaatatacaatattgtattacattcacaatgtattttgttaaaaacttttaaaaaataatcaggaaagtagcagaatagaaagctcaaagcccttttatccatcacagaaaacaaacactaaaataaatagataaacttatagactgatttatataatttaatagtatatctgatagtcaaaaatctacagaaaccaagcaaatgcccaatcaagaaaaagccacattaaaaatggtaagaaatttcatagtgttttacttgcctttgccccattctttatcctatgttgtgcttcacaggtggaagatgatgtcaatacccagttccctcacttggaccagaaagagcgaagtagatcatatttgcaaggttataaccagtgtgagcactgccaaggcactagtttctcactctccttacttggaactcagaagaggaaacagtagtatagttgggatcttaggctagaaaccatgtaaaccagtggcatgcatgcaaaaactgcaggagagaggggaagttgcaggtccacagaaactgaaggtaagagattattgggaaataatacagtagaacatctaaggccccaagaagaagctgagttgagactccttgaaacataacagggtctgtgagtgacatctgcaagttggtagattagaaagctccaagcccttgtttacccacaggaacattaaaaacaacagactgactaatacaggtttttaggagctctggaaagcaatcacagttctacagtatttataagagggaaaagcatacacacatgctcagacagaatatatgctcagaaaaggtctcagaggactttatgtgttcatattacattgattagtaagttttcccctgcacagagccagtgtgcaaaaactgagggatgtggcctcttttttaaatgaccaaatttcaacaaaaatatcataaagcattcaaagagatagggtaatacggtccatcaaaaggaacaaagttaactttcagaaactgtctctaaagaaacacacacatcagcctcactagataagactttaaaataattgtcttaaatatgctctaagagcaaaagaagaatgtggagaaaattcaaggaagtagagaaacaatatatgaacataattaaaatatcgataaatatagaaatcataaaaaagaaccaaacataaattatggagtggaaaaatacaatatctgaattgaaaattcactagagttgttcaacagcaaccttgaacaagcaaagaaaagaatcagtgaacctgaaggaaagtcacctaaaactattaagtctgaagagtaaaaagaaaaaaaaaaagagtaaagaaaagtgaacagagcagaacctaagggacttacagtaaaccaatcaacagactgctgtacacattataagaatccaaaaagataaaagagagataaagtgatacagagattatttgaagaaataatggctgaaaactttgcaaatttgaggaaatgcatgaatctataagcccaagaagctcaacaaattccaagtagaataaagagattcacaagaagagacattacaatcaaatttctgaaggccaaaaacagggagagaatattgaaagcggcaagagaaagaacattaatcatgtacaagggatccttgataaacctatcattgaatttttcagtggaaattttgcagaccataaagcagtaggatgatatatttaatgtgctaaaataagaaaaaaacctgtcaatctagaatcttatatttggcataaagtttcttcaaaaataagggagaaattaaaacattcaccagacaaacaaaactgaggcagttaattacaactagacttactacatatgaaattctaataggagtcttacaagttgaaatgaaaacatgataggcagtaactcaaagtcatatgaaaatatgaagttctccagtaaaaatgaacacagggacaaacagaaataagagtattattgtaattttggtttgtaacttaactttttattttctacaggattttaaaaaacaaatgtataaaataattctaagtatacataaaggaataccctttatgtatatgtatatatagacgtaatttgtgaaatcaataacataaagatgaacagggtgaagctctaaagcagtagagttttcctatgcattggagttaagtctgtatgtgaaaaagctctggagattgatgttggtgatagctatacaataatgagagtgtatttaatcctacagaattgtacacttgaaaactgttaaagttgtaaatttgttgtcatatattttaccaaaataaaacaaagaaaaacgtatttgaattttgctaattcctgataatatggcttcataagcaagaataccataagacaacatagtattaaattatgcacatacaaattgtctcaacaacatatcatccaggctctcacactgtttggaaactaatagtactggaaataaatcaaccattacatagctcgccagaggaaatgactgggaaagtgatggagctgtcacacttgctgcatgggtgggagccctaggccctctgtcaagatcatgctgccctcctggatcattttcatgcctgttgcccatgtgccatccctagtttcaaatggctgaacaaataattagttttcccaacacacgaatggggtatgcaatcattctcctgcaacaaattctaatcatcgccattcagctgtgattctactgtcataagataggttggtacccaatgaaacaggacaaaaattgatagattataatgtattaattagctaatggaaaagtcaaagttgaaaaaaatagatgttgaattttaaattaagtgggattgttaggcttgcatacatttaatgacataaggttttatacaatttatatatctgtaattatatataatatataatatagtacatatatgtaacaaatatataaaatataagtaatatataacatatatattatacataattttctttatatatgttatatataattttctttatataataggaaattataggttttttaagacttgagtattcatttagtggaggcaaataaagttactatgcttcttaatgcctcttctaaatttccatgtaccttttaacttagagaaagccaaggaattgttgatctggtataccaatgccatctgtcttagttaattttctgttgctaaaatagaatacctgagactgagcaatttgtaaagaaaataagtttagttgtctcacagttctgaaggctgggaggtccaagtgcatactagcagtttctggcataggctttcatactgtgtcataacatggtagaaaaacagaagggcaagacagtgaatgtaaaagagaccaaacacgagggtggccttactttaacagcctgctgtcttggtaaattatccagtcacttgagagcaagaacatacttattccctcaagagttaacaggatcaaacaagagtggcattattctctctcagtgacttaatcacatcttaaagatcccacctcccaacactgctacacaggggaccacatttttcacatgtgaattctgggagacacacacgaacaatagcaccattcttaccagttataggaaagttaattaaaaccacaatgggataccacagtatacccaacagaacagctaaaacaaaaatctctgataattattaccaagtgattataaagatatagagctactagaactcttatactatgtcagtgggaatacaaattggtttaaccttttgggaaactagcatctgtctaccaacaagcttttaagccacataaacacaattgtacagcaagagaaattttcacacacatgtcccaaaagacatgtataagtatgtaaggtccaaaatctggtcatgatgaaatacattgaaaattaaactattgccacacataggaatctcacagcataatattgagaccaagaggccacacataaaacaagtataaactctattattacatttataaaactcaaaagcaggctaaataatctatagtattagaattcaagaaaggtgttgccttgtgagggattggaatttgtgacttggaaagaaaaaagagggccctttcaatggtgttcattatgtcttatttcctaatttgagtggtattacacaggtttgtagacattctgataattcatttagctattcatttatgatttgtgcactgttctcatgtatgttctgatacaaatattgcttaacctatgatacatggttattttatataccagaaaacagaagagactaaagttaaaaaataaaaaattacttcttattccactagtgcattgacttcaagtttttttttttttaatatgtaggttcacacatgaataattactcagtattggtagtttttctaggttaacacagattatcaaaatatgttaagggaatcaagaaaatcttgaatagactaataaccatagaagcatgagaaattaaaaaagaaactgtcagaccgaagataatctttgtctaagtttactattaggttgtcctaacgtttaaagaataagtaatttccatgcaatacaaaaaatcgtagaccacagcaaatatttagattaaaaaaaccctttccatttatttcttcaacaagttttttttcccttgcaactgttggattagtgctctttttttatttattttggtctcttcttttcataaataattacctacacatttgtttctgttttccatactggtcatatgttttctctcattattttcatagtttatctttgccctctgcagttctgaagaaactgagtgctccttcagtttcctttgcacaaatctgattctgttatttgttgcctccaaagacagatatcattcttctgtaacatttttgtttcttttcaattgtctgtactttaatatatccaatctctgtgttttttatttctgagtcattcaatgcatacacaaggatggaaaacaattttctaaaacattttttctgctttctgtattaactcttgctttatatatgcttttcctctgagactttaattttccatgtcaagtaattactactgacaacgagttttgctttaatggtcttgttatttttttctttactgatctgagattgtgataaaaatctattgaagtgtagggttttctaacagacaagtgacaagattgaccattagcccttggttctactgataacttgttttttttttcagcagaaagcttctaagcttcacagttgaagagtagattgttatgaagaaattcaggcccaaattccaatgagtagcagcattcaattaatgcaattcttctagaattgttggtagatggatcatcgtctttctccattctgtggtcgtctcaccttgatctgataaaatatctagagcctctctctctctctctcacacacacacacatacacatacacacacacacactgtgagcatgcacacattactactgtctctattcccactactgtaacacctacagtgcttttgggactatatctctttcccgggacatactgcattactgtaagttcttccttcctttcttcccttttcagagggagcagaaaaagtaatcactttttctgtagatgtagaggcactgattgaagaaaggtgcccatgtatgactgcttgattttctgagtgatacaaatcttggatctttgagtcatggggaagaaacacagggtctctctacattacttaaggccataggttttctttactttagtttgtgaatttcaatttagcaatgtagagtcttcccagaaactaataataggttgactgaaagtgtcagttttgaatattatcataaaatgtcatctttctctgggcccttacagccattttaagctaaatcaagcactgctaagaaaaaaaaacttatttctgacatcttaaactatgataaaaaacattccatcagcatcattttgagaaaaattcaatcttcctttaatgtttactcacaaccaaaagctattcccgaacatctgtgtaatattactttgacacagatggtaaaataattattaataaaatagcacatgtaaatatttggatccatttcagtagaactgagaaagccacaaaatcatcttacaaagtaaattttcattgctgactcaatgtgcattttactttgcaccaaaagtgctgcaattttctttggtagttttgaaatgaacaagtaacatttattttcaagccccttcaatgtagtgtgcaaatgagttcatttttatttcacaggaggccaggatccacctttatctcttagaattgtacacaggtcggtaaactgctttgaactgacaaggtctagtctcctaaatacagcttaacttaccttctcaaagaataaaaaaagaaaaaagaagagacataaaaaaacttgagaaagtttttcaaaaacataacacatattgaatttttagaagtctagatgtcttataaatcaatgtagaataagtcatttctacaggcttccaaatgtttcccctaattttttaatgtcagttgtttcatactactcttttataatttttgtcatttttcatttttcttgcaccagtttcattttaacaatttggaagttgatcttcttgtcccttggaccatacaacaggtttgttactgtgtgttcaggcagccaagggtactatgagaagtcctggactaggagatggaaaatctagattgagtgtttcacttgcatcacatgagttttaccagtgctgtatggtcagctgtcacctgtctgtatggtcaggctggtgtcaatttgcaaacaataactggtctgcaccatgaggattatggatattgggagaaagtatgaaaaatgttatataaatgaggtaattttttgtttgtagaatgataataaataagaataaaaatataaatctgtatattttctgtcttctttttatcatttcattttttctagcaagttttagtaattttacaaaaacattcaatctacaatgcattaaaaataaactgactcttaacccacagagagtctgagaagcactgagctctaatacatccagagagccaattagtctctcagaacctgaatttatctgtaaaaatatgaataatgaactccaccctgcattttttacagagtatgtgaaaactaaacacaattacgtattcataagctatttatacctataaggcctcatataaatatacagtcatcatatactaagtaataattatttgtgaagtagcatggcatctcagctaaaagaagcctggcatctattagatactaaaggtttttatactttttgtataaatacaaaaatagaaattttggcagtggatacaattgcacacaaaataactgtctcagggagcagcatatgatttaaaggcaagtcacatcatctgttaatagcaaactttctttatctataaaacaagggtaattatgactattaattttaggttgaggtgaggttgaaataatacacgaaagtatttagtggttattacttggtatgtgaaaagtattaagtattagtcttatatctttaagctctttatgctaagaaaactactgaattctttatatgcaatgtcttagttaatccttataaaaagtttaaccagacaacaacaataatctccattttaaaatagggaaacgaagattcaaacaacgtcagcaacttccacagtcctacacagctactttaaatccatgtctgtctataaaaaaatgtggtcaagtttcccatagaatactacctccctaaagtcttccaagtcatgaaaatacatttcacagggtacattttagaagctttctcattttatttataaactatgcagactttttgcataagacacagaatcgaaagatatcctgaaacctagaaaaagagactcacttaccagtttgaattgttgggctcttcatgctggtagtggccactttcggtgctctgctctgagcttcttctcataaccctatttccaggctgccaaaaaataggaaatgaaaagaaaaatgacactcgcttgcttcaagaaggattttactatattaatggccataacggtaataattaacatatatagtatttgttatataaaggtttgaaagaaacacagtagggattaattcacttcacatgtgtgtggttttccattttgaagttaagaatattgttatgtttatctgcaatccacggaacataacaatctattaaaattaatcattaaattatttatttatttatttattttgagacggagtctcgctctgtcgcccaggctggagtgcagtgacacaatgtctgctcactgcaggctccgcctcccgggttcacgccattctcctgcctcagcctcccgagtagctgggactacaggcgcccgccaccacgcccggctaattttttgtatttttagtagagacggggtttcaccgtgttagccaggatggtctcgatctcctgacctcgtgatcctcccgccgcggcctcccaaagtgctgggattacaggcgtgagccaccgcgcccggcctattttcttgttttattaaatagatgaataaaggaaactcatgtttaaagccattcatatatttgaagatctgtgtacttaaactccagaaggcaaaatggtattttgttataacgtaatgaagagaaaacagaccggaaggagacaagacttgctgtgtccgtaaacctgctttcaaaggttaaaatctgacaatgtggtcagcatgcaagtctaagattattctttgtcgtttatgtatttaatataatggacaagtcaaaaacagtaatgattaatttattaaggaaaatttaaatccaatcagttaaaaactggaatctgcttttggaattgtaaagttgtaaaaggaaatgagatgttcttttcaggattagaatatgacatttccattttcttgatcaatcatttccttcttcccctactccacaccagctcccttcagtgaaccacagaaagagagaaagataagttggcagaaaacagtagaaactattctaggatcatttgcactctctcaaaagaactataatgaggaaaaaaatgctttctgaaaataattagaatgtcaatcactttccttaaacttcatgtttacatatcagatttcctacatgacactgccacttgtgtgaccaatgataatggcaataattacgtattgtttacactgtatcatgaactgttcttagtattttagggtatgatctaatttaatatttacaaaaaccctggaaggcaggtgttattaatatccctacttttaatgatgagaaaaatgaggcacagtttaagtgaattattcaagatccacagctagtaaaaaaaacagggtaggatttgaactttttcagaacccattctcttaatcttcaaggtattctattacctttcaaacttgacccaaattgaaattctccattttcctcatataccttcttaagtcttcccccattttctaggaaactgaaacatttgccttgtattcaagccagaaatgtaggcatctccttgatacctttcttttccatgtgattttacaggctaattatagctaatacccatataattcacttcaatactccaattgaagctaccatcatctatcccttagaatatagcaagagctttctacctgttctcactgatcccacgcttgacaccttctacaataaattgctcacataattcatagcgtaaatcatcattttacttctttggttaaaattattcaatggctttttattgcacatggaataaaatacaatgatctattgtggtctacaacttctgaaatgagctggctgcagccgatctctcaaacattaccgtatatagttcttttccatttttccactaactcattttctaataagccatggtcttcagcaactaaggactttgggaatcaaccctggaaggctctgagactggatacttttcatcccacaggtctcagtttaaaagtcacttactcaaagagagtctttccttccatcataacctacagccatgttttaatttatctgtttaattatctattatcgctcctcctcactgaagaaaccagtaactgtcaaatagcgctgaagtaagcttgtgcaatgaggcatcagagtgattatttcaggacatatatattgattttatttataccaaacaacaacatttatatgtgattttaactagcagcatttgtttttttcctatctgaatcattctactaaaatatatgcagccctctaatctttgtttctgtttttttttctcagtttgatttaaagcattgcttctcaagcttaaaacaaatatgagttacatggagatttataggcacattcatcaaactgcagatttttcattcagtgagtctagggtagggctgcagaatctgtatccatcacataggttactctgatggtgttgatctacccaccacattttgagtaacaagaattcagaagataggtcacagttttagatggtttcagaaagattcttgaatgattcctattgtatatttctgtgtgtttgtgtgtgttttccatgtgcaaaaatactattataacaataagttttttaaacgtacattttcctcttcagacaaatgccattcctgtgagatcaacaatacatcactaagtagttaacaaaccatacatacttcttctcttacttactttgtaatttgtcaataattctgaataaagattgtccttgccttgaagataagtgtgcaccctgatgtcacctaatgcagacacctttaaatttaataacacatgaaatatataaaatactggaattttgtaattgaccaatatttgagctaacttctgcacttttctgtgcttttttctatatttctgattccttttacagtatacattttagctttcattcatgaagtcctataatacattgtggtaaatatgtgtgtttatatacttttatgtacttatgttatttcatttaattgataaattgatgaaattaaagttaaaagtagtagttatcattttgggctcttactaatggcgaggcactgtattagtgctttgtatatattaactatcattacaaaaatgaactattaatacatagagacagaattttgggatggaagaattagttcaagcatatatattttaaaagtggcaaaaatgatattaaattcagttatgctcagccttgtttttataatcaagggaaatttaatttttttttaaagaatcatatctctgctagaagatattttaggtagccaattatattacaaaagagaacataggaactagctttgtattatatactttattaaaggacaatatgccaaaataagaagtgtttgcaaaagcacaggaaatgtcattataaattttacagaatactgattacagtcgttatttccaaaatttagcaaaagatcattttgttgctaaatattactgccaaagatctttctgaaggcataggttttaatcaattttgaaagaatgaaataaaataagtagatgtttaataatggcagacccatgtaatacataaatgcttatgtctgacatatttttcatttaagaatgatagaccaggtgacaagaatatgcttatttcttacttgtcttttcagcaaaatttccaaacaacaatgtatttcaggaacatgtgtctagttcctttaaagaacagtcattggtcctatctataatgactatttctcccatataagtaccatactgaagaatgtcttaactactggaaccatgtcatctgtgtgtgtgtgtgtgtgtgtgtgtgtgtgtgtgtgtgtatgtgtgtatgtgtatatatacgtaggtatatatatatatatatatatatatatatatatatatatatatatgtacattttgagagaaacttaaatagggttacttcctaagcaaaatttcaaccaccataataaattgctattatttgttttgatagattatgtaatgctatgatttctgtgaggttcatttacgtttacaaggagttgctattataatcattgtaggtcaataatggtttcacttagattcaattatcaaaacaagaacttttaacaacacaggaaagacaaggtatttgcccaatgggttagtatggctcttttctaagagaggtttaataagagctggtcagttcattttcttcattatttgagacccaccttatgattttctttgcacatatgttcaaatgctatcttcaataatttctttgaaaggaaacacttaagtgccttcataatataaagcatcttaattctgattatgtttgaaagccagttattcagagaaatttattctttttcaagagcagatgggaacaggctcaaggaatccatggcagaagacacaaacatggaagtaaaatgacaattgtttaggtaaatttctgataggaataaagagaaaaataaattgtagattgaagtgtttgtttgttggaagggaaaacaaggttaaaaattaaagggggaaactattgccaggaggaagaattcagtaactttaatatccttcagttaatgtcttactggaataacttaccacctcaccttgcaactggcttctcagatttcagtctctttcttgtgcagtctactcctaaaatgctttcaggctttctatccaattttcttactttattttactttcaattttttttgttagtatcctatctgtccttttaggccctgattcccttctataacatataactttatagagggttaattgactttcctgaagaaacaaaaggcattgcgacttctctatttctatggctccaaccacctcttgccccttactgcaacaatttctcaactaagtcatctgcctcaacaacagtcctgcctccttttcatacatcaattttgttcccaatttcaccagattaaattctccaatccaaaactataatgttgtcaactcattatcaaaagatttctcaagctcccctgtgtaatacaaggttggagaatgggcatggagccccatttctaactccaaagcctgggctcaaagtcttcaaatgtctttgatttacctttttgggctcatttcctatgtgcaaattcataatgcaaaagtgtattgcaaatagttaagatcttcataactgtgactaaattcatgctcagaaaaaatatgcaaaataattattaatatccatattttgtaatgagacaattgaaacatggagatgttatggctactctaagcctttagttaacctaataaatagtagtaaccaggccttctacctccacagcctatacgcaccaaaatttatttgtcctctaatttgcatgattagccacttctttaaatactttattttcctttctctgaagacagatttgtgcatatttatattcagaggaacattcctttgagtctctttattttcaagtatttgtcaccttccaatatctagatcaaatgctaactccctctattactttcaactggaaatgctgtcgccctcctctgtgtaagttttatttatttatttatttatttattttttattattatactttaagttttagggtacatgtgcacaatgtgcaggttagttacatatgtatacatgtgcattgctggtgcgctgcacccactaactcatcatctagcattaggtatatctcccaatgctatccctccctcctccccccaccccacaacagtccccagagtgtgatgttccccttcttgtgtccatgtgttctcattgttcagttcccacctatgagtgagaatatgcggtgtttggttctttgttcttgtgatagtttactgagaatgatgatttccaatttcatccatgtccctacagaagacatgaactcatcattttttatggctgcatagtattccatggtgtatatgtgtcacattttcttaatccagtctatcattgttagacatttgggttggttccaagtctttgctattgtgaatagtgccgcaataaacatatgtgtgcatgtgtctttatagcagcatgatttatagtcctttgggtatatatccagtaatgggatggctgggtcaaatggtatttctagttctagatccctgaggaatcgccacactgacttccacaatggttgaactagtttacagtcccaccaacagtgtaaaagtgttcctatttctccacatcctctccagcacctgttgtttcctgactttttaatgatcgccattctaactgctgtgagatggtatctcactgtggttttgatttgcatttctctgatggccagtgatgatgagcattttttcatgtgttttctggctgcataaatgtcttcttctgagaagtgtctgttcatgtcctttgcccactttttgatggggttgtttgtttttttcttgtaaatttgtttgagttcattgtagattctggatattagccctttgtcagatgagtaggttgtgaaaattttctcccattttgcaggttgcctgttcactctgatggtagtttcttttgctgtgcagaagctctttagtttaattagatcccatttatcaattttggcttttgttgccattgcttttggtgttttagacatgaagcatatctacaactatctgatctttggcaaacctgacaaaaacaagcaatggggaaagggttccctatttaataaatggtgctgggaaaactggctagccatatgtagaaagctgaaactggatcccttccttacaccttatacaaaaattaattcaagatggattaaagacttaaacgttagacctaaaatcataaaaaccctagaagaaaacctaggcattaccattcaggacatacgcatagacacattttaagaaagatttttctacctagcccatgttgctctgttccaagataactttattacctggtggtagttacctaaattgcaggcacattgtaaagaagaattaaatagtctcaaatacaggatttgcatttcaaaacctaaaacgtgcaaggtattggaatcccatttcagctatacaagttcaggataggtagattcatttaatataaaacaacttttgttagcattcagattgtttctccttaactctattatcatcatttgtctagctcttcactactgttgaaaatcttgctgatattcctatctccaaagcaatggactatctgctgataaagtgtttattttgtgtactgcaggcattttggaaatagctcttggatcaaactaaatgagttccagtataaataaagaacctaagacattgcaggtggcactcagcaagatattggtgtgacagctagagatgcggtgtgaccctctgcaaatgatgttttgtattgagtgcagggtctaataaaatgagttccatcatggaacttttgtgctcattgaaatctgttttaaacctaaatatgaggtttcactgctgctttagtgacaggaaaaaaaaaaagataaaaaaagaactgtaactaggatggtagcttgagtcacattcaggccttaaaataactgttaagtatgtactttctattgtaatcaaagtgagaagtgaaataatatttgtattatatatgttgtctcactgtggcattatttcaaatatactgaaacatgatttactttattctaaaacttatggcacattttacagtttgattcatttcctaacattttcaatgctgtagttcattaaattatacttgtttcatataagccaccaagaacatccactgttaacctaaaaagattgggaggaaaaggattgttttaaacacattctatttccttcatgtagatcaatgaagacagcttcctaaagaactatattttcctcactgttgcaggaaaagcttcagattatggtaacttaagtagagagaaagaaataccacctcaatataccaggctaagctttatctacagcctgggcatttaattaggggttctagtgtcagcaacagcttccagtagcatggtcttttttaaagtacccttcacctgaatgaggtgagtaagaattgctgatgaggtttgactatcatccattgggaatagcctaatgactcacataattacacaatcttcaagtaataagcgactcagtttgtccagtctatctcccattcaatgtggagtataccagcttttgttgacaaggagggcccataatgtggttctcttagcaccaagaatggagcttgaaacagcagctccaactgttggataaatctgtttatatagagtggaaggcttgtacctgtcatacatccgtccaagttttgccctctagaactatacaaaatacacagaatcccagtttcatgaggcagctcttcaagtaattgaaggaagttatcactgccctgcaggatatagaacatctttcagactcaacatcaccactttcttgaatacaaaatggcagccacattcctcacgtgacatgtttgtagatacttcactattctggtcaccctcttttggatgtacttcaatttgtcaatgtctccttttaaaatacattgaacactgtatgacatttctggagctactagcagacatggaacaccatgagaataactaaatttatctggcttgtgactagtgacaaggtctaaacttaaataaaatttctatttcccaaaagtggtcagagaaggaactttacaatattaatggattaaaaattcaactttaagtctgctggtgttacaaagtagtgtcagagagagacatcatctacagggtgttgtgagcaacccacagacaacacttcaatcaattgtctgttaagtctccaaaatattgaactcttagagagggatggaaagaacatctgtcagagaaaggacatctaggtcatgactctcccctcaaacagctcagtaaacttgaacaagtcactaatgcctgtggttctcagtttctccattatcaagtgaaagcgttgactaaatcatctctaagattccatgtaaaccataatatttcctggtaagggatttcaatgattcccaacttcttatttgtcagaaatcattctaaaatcctgtctttgattacaatttgacccaaatttaaatagttttatcttcaataaaaagctgagaaaagtgcttcagcagttcctccagtcttcctacttactggttcattggctgattcactaagcaacttactttattatatactatgagcacagcacagtgcatggcactccggatgatacaaagtaatatcatcacagctgtttctcttgaagaacctacagtctagttatgtagatatacctacaccataacctagctagactataatatgctacaatttaaagtgtaaaagtatgagtatcaagtaaatgataatgacattaaataatagtagaatcagaggagagaaagctcattatagcctgaagagatgaaaaatacctcatgaaggatatataaggagacagtataagttgatgaggtaggattttgatatctgagagagggaagtatttgtgtactgataagataaagcatatttcttgataaagagtcttccattgctctagaaattatgtggccacagcatgcaacaaccctgaaacatggttgctgaaaccaaccccttgtacacatatttccaccctgcttagttagcaagatacaaccatcagtcacaaggtttgacactcccatggggcctgtgcagccctgtaactattaggagacctaagaacaagaggagatatttacttttgggttctaaaatatactcagaagatataagtggaaaaaaatatcttgttggcaactggcattgaaggaggtgattttgagccctgcaactgccaaatcactattcttattcttggtgtctctactgattggtatggcagaggttactttaattatggagccaggtgacacagcttggaatgactaactttttggtaggagaaaaggcacatactctcggaattaatttcaattagtctgaaaagacatcaatttagtatggatgaggagagctgaggatatccttctaatgctgatttgaaatccagcacgtccagactactgagtgttgttcacttcttctaataatctgcttgagggtaacactagctgttgtttggcctaattattttcttgatgacaacaggcacagcaatgacaattgaaagattccgtgtggcaatttcttacacacaagaaaagtaaatgtaggtcgttatgtttggcaatttgtgtgttgcaaatgactgatagaaagtaataggtgctaagtaaatactaagtaattgaagtctgacaaaaactagggttcctttgtgttatttagagaaaaaaaaatgtttattccaatgaagatattgtctcctggaaatttttcccagtgccttatattttccaaagaaagtacacatacatacatatgttcatgtgcatatgcacatgtgtgtgcatgcatgtatgtgggtgtgtatgtattctttttctattgctcagatttccttttaaaaaggtattcctcaggtacaggagacatctagttctgttataatgaatagtgctctcgttctatgaggcctccaaacaaatggtacttcaatgtaaaaaaaatcttgggttgaccctccttcaactcatgaaacacaacctcatgttccaaaaaaccccacaaaatggaattttaaaaataataataaaatagtgatataaactcacaatctatgactagagatagagtttataggacatacagccagactctcttttgtaggatgcttgcagtctctccattaagggtactgagttatttgacacaaagagaaaaaacatttaagaggctgagtgccaagcagagacagcgggagcagttccagaggaagatggcctcaaggtagagtaaaagaaggtatggagtcaaaaatgtaacccatatatagagtaaaccatagaaagaaaaagtggagctctgcttggatggaagaaagcccatataaagttacagttcctcactaatctaacagatcatattgtggagacagacattggtccccatcgggtaggaaactagcttcttttcatcctctgtacctttccaatagcaggtggtcttctaagagtttatagaacactgaaatcttttgataaatattcttttagtatgcttttctcaccactgtgatttggggaatgcattaaagaataaattgatattttcaattttgactcaccaggtatttctggaatgcaggtaaggtgatttagcataagccaatcctacttgaataagcctgatatgattgttttagaaacaactaaatagagtttgggtcatatgcataacaattcttatgccaaaattttaaaggaaatttatctgaaaacctttgaaagccacatttatgagagccaatttattataatcaattctcccatggaacattctctacttcttctcaactcacatgaaatgtgttggaaatgtcaaatttcccaatgaaaggttgaataaagtgtatacaaatatccataatacacccacaagaaatactaacataaacagcagcataaatcttgattttttctgcactgtgacaccttaggcctgagaatgctgctagctacattcagacttgatcctaatttattgctgatatgacacaaatgttaaatacagctgcagccattaaccgaaactcattaattagaaaataaaattatggaatattttttcagcttaatttgccaagatgctctcagtcaacacaggttaggtgtttgatgaagcttcccagcttttaatatgacccataatgtatagatcaaaagccaaacaaaacaagagaaaacaattagctatttagcctatttaaaagtatacacacatgtatactctgaaaagcatgcttttaaagtatagccctgctgacatctattttgaatatatacacattctttcttaccaaaccaaatgacagtcatttctctaggataaaaacatttctcccactttccccatggaggtgattttgagtagcaaaaaagctacaggagtcataggataagaatttcaagagctaaaaattaatgtggattcttaaggtttctgtgctttttaatgtttggcaaatatttgagagtgcctgcagaactctaaaaagacattaagaaaaaactttaagagatgtaatgatatcccacataaacagggaaacttactgaatactgtagcaaagaaacactgacccaaggaactgaaatatattacttactaattaaattaaatattattataaatagatccaacttcttcacagaatcatccaaagtgagttatcctaagaccattaaggcaagacaatataggatagtggttaaaacaccagctctagaatgaaaccttcagttaaggtcttagcactgccattaattgtttatatattaagcaggttatttgacttatctaagtcaaccctttctcatttgcaaaataagaaaacaacagcacatatttcatatacttgtgagaatcaaaggagtttttttgtgtatttggaacataatgagtcacatatgtagttatttttaattttgcaaatattattaagtagtatctccaagtataaaacttcaatgaaagatttttctagaaataatctcatcagagctatctttccacatgatggtcctggttatactaaatcacagttcaaagttaaattgtaatggtgcttgaattaatcatattatttgctgtcatcaaattgtgtgatggtgaataaggctggataaatattggtctataaatgttcgaccaataaacaaataccttatattttgtccagtgttttgaaatttacaaaatgttttgaaataaattatttttatttgtttagccaatgctattgagaccgaggcttcaagaactgcaaagatgtttaaaggaatcaaaaaagcttatattctaatgatgcatatagggtagaggtggggaattcctctactcacttctctacattctggcataaattgtcagtttccagaatactgactgagcaatatttataaatgatcatgatatcacactttaaaatgtcacaatccagggaggtgagagtagcttttcttctacaattcactgcaacctccatctccgggtttcaagagattctcctgcctcagccttccaagtagctgggactacaggcatggaccaccacgcctggctaatttttgtatttttagtagatacagggtttcgccatgttggctggctagtctcgaactcctgacctcaaagtgatccacctgcctcagcctctcgaagcattgggattacaggcataagtcactgcgtccagcccatccttccttttaatattgtggctaaaaaagggcttgttctttgaggataggcctgaacttttgttctcttgtctgttcttgtattttgctgtgactttctaagtccgttagccacctgctaaagctgaggtttaggaagataaggaagctgggcgtggtggctcacaccttaatcccagcactttgggaggccgaggcaggcagattatgaggtcaggagatcgagaccatcctggccaacatgggacactctgtctcgactaaaaaaacacaaaaattagctgggggtggtggtgcgtgcctgtaatctcagctactccggaggctgaggcaggataatcacttgaaccagggagtcagaggttgcagttagccgagattgcaccactgcactccagcctggaaacagagcaagactttgtctcaaaaaaaaaaaaaaaaaaaaaaaagtaagataaggaaaggcatataggtatgatttatgtaataagtaaagtatataattccaattagcagaccaatatttatataatcttttataagataatgaatgaaaataaaatcaaagagcaagaaagtgctagactcagtcttggcataaaatcagtcagcaaagtcccaggttagtaaaaaggtatatggtgtgagctgctttcgaatcctaccccagtaggtggttaaaacttctaggtagagttaggggagcaggcccagtggaacaagtaaacttcaagttccaatacaaccttgtgggaaaggcaagcttatattgccggagtttaacaaaagaaaatatactgaggcttagaaatattgaataagtggttctcaaatgtagtctatagactgctccttactagctgtacaataattagctcaagtgtttgttaaaaagcaaattttcctatctctaacccaaagaaagtctgattgagtaaacttgggtgaactaggaatgtgcattttaaaaacttcccaggtaaatctcatagagtgggagttttgtgagcaactgggttaaacaatttgcacagagtcataaatacagtgagtgctaaagccagaactagaagccactgtgctccaggttccttcattacagatttcctaaaggtaatcttgaattaatttagtttacttatgtataagacaatagaaacataaactcagattatgtgaagtgtcctacctaatggccaatataaacctatatcttaaatatcaacattttaatggtttttgcaagggtagagagaagtaacattctcacataatactgggattgtataaattagtttaacctttctaaagggtagtttttcgtaatctatcaaaactactagattattgtacataatttatcatccaataatttcacttcaagaaaactattctacagctatgcatctcacatatatcaaagggtgtatgtaaaagatgtttattgtaaaattatttgtaaatgttaaaatctggaaaaaaatacaaatctttcaaaaccaaagagaaaacaatgtatatagagttactagaaaattatttgaaggatacatgaataattcttaacagtggttaactttggaaaagtgagatgggagtattgtagtgtgtatgtttcttgttgccattgtaacaaattactacaaactgggtggctttaaacagcacaaatgtattttcttcaagctctggaagtaagaagtctgaaatgagtcttatggagctaaaatcaaggtgtatgcagggctgattctttctggaggcttcagtgataaatatattccttgtctcttgcagcttctagaggcctcttggcattctttggcttgtggccacatcactccaatccctgtgtctgtgatcacattgccttcttatctgttttagaaggacccttgccattccatcaggcccactcatgtgatacaggataatctctgcatcacagaatccttaaccacacatgcaaaatctatgttaccaaatagagtaacattcacaggttccaagcagcaggatacagcatttttgggtcaccagttttctgcctaccacatgttcggagtaagtattctttttattatcctcttctttgcattatttgacttattttaactatgtttttgtattaactttaaaataaaattaaacctaattaaacatttaaaatcaaatggaaacctgtgcctttcttaggcacactgtgatatatcagctacaagtgcaatatttcatttttgaagaaggatttatttatgccccagtttgttccaaagagtatttaggcagtttataaaacaggctccaatagtaaaataaataaaattgaaagctgaaatgggattagaaatataataacatgagaatgcttatactataatcttatgagtaaaaatacttgctttgaataggcataaatcttgttttgaggttcctgactgctaaagcaaaaagggaaactgtgggaaaaagggtgtattatttgtattgttggcaactgaacaaatgtatcaaattattataaagaggagatagatctttctagtactaagctcacagaaaattttgcatgggcatcattgtatggggcacttagtgttgccaataacattcaaaacaatttcatatcagatttcaaaatttcagcttttgctctctctcccgtgattcctaatagaaaaagatgttgccaggaatgctccacacagaactaaattccattcggtgttgtgtatcttgcatgtgccagtgagactaagtggaatacaacaatgtctgatcaatttgtctaaactatccagtctcccagtttcaatgtcttgggggaaaaattctatgacaaacaaataaagcattgagaacacatagcattaactcgtatgctgaaaacctgaaagctttatgctagcctgtagcgaatttttaggaagaatccaaaagtacagcaaagtatgtgtataatataaatgttgccaccgttgtaatgaaggatatgctgttggcaacctgaagctgcataacatagctttaggtgacaataaaattccacatagtcctgtcaagcttaatgttggttgtttttgttaaaagtagggctttacaaatcattctgggtcttttccaaagttctactaaactcctgaaatactaacagctgttaattattccctccattgaagaagatgcattgaaaggtttcagctaaagagatccctaaacataaatgagtctctgaattccaaccagcatctagagggactactaaacactgccataatacagtccactaggaaagatccttcacctgtcctggagggaagaagtcaataaatgcagaactgcaaaggactcctaaaagaaaaacaacaacaacaacaacaaaaaaacggtgaggggagcgggcgggtggactacttcatcactgagcaattatcctaaaagcagttgcagctcaccagatttcaaaaatttacagaagtgttaacctattttattggtgtaggtacaaataatagaaaacccaaagaactctgacagatgggggctcatgtttttcaagtctctaggctggttgagatgcctaaaggtgtgtttcttaaaggaaacaagtatcccctgtcatcctcatccacagtccttagtttgtggcgtttgtcctattttatttccaggcgattatttgcatttcctgacataggaaatgaccaaaggaagaaggtcaaagtgtttctccttatgaggctttgcctttttgtcctaaagggaatccctttgttaatacttccacctacatttctttctccagaactaaaaacacgatcatctctcactgccagggtaaccaagaaagaaagtatttataactgacatatcacttttaaaatcaacattgggggtctgttagtaaagataacaagtgaggatggatattcagtaggcattcagctaaggataccacagacatcaaaagaagacatgataataaatcattggagatatattggtaaatgcagtacctactctctacccatctctccaagtcttttctagctgtttcagagcaattaaagtgggtaaaaagatagcttatatgttatttgaaaaatcatgaaacaaacaaatatataacaaaaatctaataaaattctagtgtgatggttaatactaaatgtcaacttgattacagtgaaggatgcaaaattttgtccctaggtgttgtctgtgagggtgttgccaaaggagattaacatttgagtcagtggactgggaaaagcagacccacacttaatctgagtgggtacagatctaataaactgccagcacggtcagaataaaagcatgtggaagaacgtgcaaagactagacaggcttagcctcccagtttacacctttctccagtgctggaagcttcctgccatcgaacattggactccaagttcttcagttttgggacttgactggcttcctctctcctcagcttgcagatggcctattgtggaacctcatcttgtgatggtgtgagtcaattcttcttaattgactcccctttatatatacatctatgctattagttctgtccctctagagaaccttgattaatacacctagaattagggattcatagattattagattgagaataaatattaacatatatttgtttggtgcaaaagaaataccggtttttgccattacttttaaatcacaaaaacacaattacctttgtatcaacctaatatttaggctactttttttttaaatcatactttaagcactagggtacatgtacacaacttgcaggtttgttacatacgtatacatgtgccacattggtgtgctgcacccatgaactggtcatttacattaggcgtatctcctaatgttatccctcctccttccccccaccccactacaggcctcagtatgtgatgttccccttcctgtgtccaagtgttctcattgttcagttcccacttttgagtgagaacatgtgatgtttgtttttttgtccctgagatagtttgctgagaatgatggtttccagcttcatccatgtccctacaaaggacatgaactcatccttttttatggctgcataatattccagggtgtatatgtgccacattttcttaatccagtctataattgatggacatttgggttggttccaagtctttgctattgtgaatagtgccgcaataaacatacgtgtgcatgtgtctttaaagcagcatgatttataatcctttgggtatatacccagtaatgggatggctgggtcaaatagtatttctagttctagatccttgaggaatccccacactgtcttccacaatggttgaacaactttacagtcccaccaacagtgtaaaagtgttcctatttctccacatcctctccagcacctgttgtttcctgaccttttaatgattgccattctaactgctgtgagatggtatcacactgtggttttgatttgcatttctctgatggccagtgatgatgagcattttttcatgtgtctgttggctgcataaatgttttcttttgagaagtgtctgttcatatccttcgcccactttttgatggggttgtttgttttttcttgtaaatttgtttgagtcctttgtagattctggatattagccctttgtcagatgagtagattgcaaaatttttttcccattctgtaggttgcctgttcactctgatggtagtttttctactgtgcagaagctctttagtttaattagatcccatttgtcaattttgtcttttgttgccattgcttttggtgttttagacatgaagtccttgcccatgcctatgtcctgaatggtattgcctagcttttcttctagggtttttattgttttaggtctaacatttaagtctttaatccatcttgaattaactttcgtataaggtataaggaagggatccagtttcagctttctacatatggctagccagtttccccagcaccatttattaaatagggaatcctttccccatttcttgtttttgtcaggtttgtcaaagatcagatggttgtagatgtgtggtattatttctgagggctctgttctgttccattggtctatatctctgttttgataccagtaccatgctgtttttgttactgtaggcttgtagtatagtttgaagtcaggtgtctctatttccttcatttctgctctgatcttagttatttcttgccttctgatagcttttgaatgtgtttgctcttgcttctctagttcttttaattgcgatgttagggtttcaattttagatatttcctgctttctcttgtgggcatttagtgctataaatttccctctacacactgctttaaatgtgtcccagagattctggtatattgtgtctttgttctcattggtttccaggaacatctttatttctgccttaatttcattatgtacccagtagtcattcaggagcaggttgttcagtttccatgtagttgagtggttttgagtgagtttcttaaaacctgagttctagtttgattgcactgtggtctgagagacagtttgttataatttccattcttttacatttgctgaggagtgctttacttccaactatgtagtcaattttggaataagtgtgatgtggttctgagaagaatgtatattctgttgatttggggtggagagttctgtagatgtctattaggtctgcttggtgcagagctgagttcaattcctggatatcctttctaactttctgtctcgttgatctgtctaatgttgacagtggggtgttaaagtctcccgttattattgtgtgggagtctaagtctctctgtaggtctctaaggacttgctttatgaatctgggtgctcccgtattgggtgcatatatatttaggatagttagctcttcttgttgaattgatccctttaccattatgtaatggccttctttgtctcttttgatctctcttgggttaaagtctgttttatcagatactaggattgcaacccctgcctttttgttttccatttgcttggtagatcttcctccttccctttattttgagcctatgtgtgtctctgcatgtgagatgggtctcctgaatatagcacactgatgggtcctgactctttatccaatttgccagtctgtgtcttttaattagagcatttagtccatttacatttaaagttaatattgttatgtgtgaatttgatcctgtcattatgatgttagctggttattttgctcattagttgatgcagtttcttcctagcattgatggtctttacaatttggcatgtttttgcagtggctggtaccagttgttcctttccatgtttagtgcttccttcaggagctcttgtagggcaggcctggtggtgacaaaatctctcaacatttgcttgtctgtaaaggattttatttctccttctcttaagaagcttagtttggctggatatgaaattctgggttgaaaattcttttctttaagaatgttgaatattggccgccactctcttctggcttgtagagtttctgccaagagatccgcagctagtctgctggacttccctttgtgggtaacccgacctttctctctggctgcccttaacattttttccttcatttcaactttggtgaatctgataattatgtttcttagagttgctcttctcgagaagtatctctgtggcattctctgtatttcctgaatttgaatgttggcctgccttgctaggttggggaagttctcctggataatatcctgcagagtgttttccaacttggttccattctccccactactttcaggtacaccaatcagacacagatttggtcttttcacatagtcccatatttcttggaggctttgttcatttctttttactcttttttctctaaacttctcttcttgcttcatttcattcatttgatcttgaatcactgataccctttcttccagttgatcgaatcggctactgaagcttgtgcattcgtcatgtagttcttgtgccatggttttcagcttcatcaggtcatttaagaacttttctacactggttattctagttagtcattcgtctaatcttttttcaaggtttttagcttctttgtgatgggttcgaacttcctcctttagcttggagaagtttgattgtctaaagccttcttctctcaactcatcaaagtcattctccatccagctttgttccgttgctggtgaggagttgcattcctttggaggggtagaggcactctgatttttagaattttcagcttttctgctctgttttttccccatctttgtggttttgtctaccatcatctttgatgatggtgatgtacagatggggttttggtgtgaatgtcctttctgtttgttagttttccttctaacagtcagcaccctcagctgcaggtctgctggagtttgctggaggtccattccagaccctgtttgcctgggtatcagcagcggaggctgcagaacaggtaatactgctgaatagcaaatgttgctgcctgatcgttcctctggaagcttcatctcagaggggtacctggccatgtgaggtgtcagtctgcccctactcgggggtgcctcccagttaggttacttgggggtcagggacccacttgaggaggcagtctgaccattctcagatctcaaactccgtgctgggagaaccgctactctcttcaaagctgtcagacagggacatttaagtctgcagaggtttctgcggccttttgtttggctatgccctgcccccagaggtggagtctacagaggcaggcaggcctccttgagcagcggtgggctccatccagttcgagcttcctggccactttgtttacctacttaagccttagcaatggcgggcgcccctccgctagcctcgctgctgccttgcagttagatctcagactgctgtgctagcaatgagcgagcttctgtgggcatgggtccctctgagccaggcacgggttataatctcctggtgtgccgtttgctaagaccattggaaaggacagtagaagggtgggagttaccccattttccaggtgctgtctttcacagtttcccttggctaggaaagggaactcccagaccacttgcgcttcccgggtaaggctatgcctcgtcctgcttccgctcacactcggtgggctgcacccactgtcctgcacccactctccaacaaaccccagtgagatgaacctggtacctcagttggaattgcagaaatcacccatcttctgcgtcgctcatgctgggagctgtagactgtagctgttcctattcggccatcttggaaccgcccccctcctatttaggctactttgatcagtaggtgtctagtgcatgaaagatataagaccataaaaatataagactatataataaaaataatactacataatgtggtagcaataaaggtaaatattataaaatattaaattatccactatgatattttactcaaatactttttttttgtctttaaatatcagaaagaaagcaaacttatggggatgtaacctatattcataatatctgcaggtattttcacaagaaagtagccttcgattcatttatccacactctgaagagcagcttacttaactctaacatgttataactgctataaagtttcccttctttagcaatccaaaggtaagtcctgggaggtcagttggagatgcagaggaatgaagatactattttctagccttagagtgaaagacagatgacttgttttctgaggcactcaaagtagaatatggggaattaggaagtagaaagaccatctcagtcagacctacctggggttttgaattatcacttttatcttactattcaatatgtatataagaatagacctgataaagtcttgagtgatcatagttccaggagcctgttgtcaatgatcaacatcccttagcctttggccctaagtaaatgagaggtaaatatcttgttctgttgtaattagttcagttcaagtgcctgacagcaattttaatttagacatatatgggttttatttagacatatatggtttcaaacccagacttcccatttgacagctgaatgactttgggtaagttactcaattttactaatcctagttttcttcatatgtaaagagtgataaggatacacttctgaaaattaaacaacgtaacatacataaaatcacatagcacagtacatggccatagtgaatgttaaacaaatggcattccttcatcttattcccactgaaaagccatcactttatagatgtgacatttccaaagaagtttgcagaacttctctctcctacaatcccatttctcacaggaagcctttctagactaattagagaatagtagataagtttctatatgtccccactggatgccatagttgcacagtcacacaagccacaaaaaaatgtatgtcacctcctagaaacttctctttgatggtagtcagttaaaatgatcctagacttgaaggtaaattgtgacaccagagatttttcttgatactgcttttccccttcagtagcaacctccgtctctagttctcaccgctcaggagtcatctgcccttctccctgttttggtcttggctgatgctgaatcttttggtaacagggtaaaactctgaatagagccactgtgtgggtcttctgactttgaagattcccagatgggaagcaggattaaagaggcagagctgtgcctctggattcaaggaagttgggggctttcacaccaagaaaatacactagcaacatatttcaccttattagacatccttctccttcctaataactgaccacatgtccttgtctttgtaatcagaagctgtattcctctaaaggcagaaaatgttaaatccccagaaatttgaggcaaacaaacagcattaatattcactagaattctcaaagattaaaggtactactgtagctagaaaaacaataattaaaacatatttttgtgaaaaaagtaaaaataattggatgctagaatttttaaatgagctaaatagattagatataaactgaagtcaattgattgaaaaattgaggcaagatattttctcagaatgcacgacaaaaaaaataaggagataagaagtaaaatagaggagtttggaggcaggaagagtatacgtcaatgtttcaatattcatctgataaaatttccagaggagtataatagagatcatggaagagatgattttttaattaaaaaagatatacagtatccccaaatgagaaaaataagatggctccaaatagagaggtgatctctgagtactgagcagaaagaataagaaaagtaaaaaatgaggctgtatttccaaagtcaaattacaaaaagctacaaaaggaaagcagcttgaattcaaaagaatgaatattaaattagtctaaggtatttcagcagttaaagtggaagaatgaatataacagtacaatgtcttcaaaaaccctgatctcatacacaggaaaataacatgtaagtagtagagaaaaataaagacttttataacattctatctaccaactgcaggtcctttctgaaaatattgctaaaggatatatactagcaaaacaaataaaaaaagatttctatatcaagaaatatgtcaaattcatgcaacagtgttgaacaaaaattttatcagtatatttatataaaaatgcacttgaagtatcatacacaaattgttggtaattaggaagtatttatttctgctaaagataaggcagggcaggtgaaagaagcagcatgctgcgttctttgttttatttgaatgtggctataaatactaagtaattccagatgttggtagaaaataaaactttttgaagtttaaataaaatattaagcattgccactatcacattgtaaatacgatgaagaaatttaaactaacacaaataattgaatgaagcaaagaacattaaattaatccaacaaagtcaagtggggaaaagggcaatctaaaggaagcactgcaagtaaaaatagatctaaagtgccaaaagtaattctaaaaatatcagtgaccactgtaatgtgaatgtgaatttattacatttccctagtaaaagccagagactctcaatttggggaagggatggtggagaaaagaaaatccacctgtctacctatgttctgtttttaagaggcatacctaagaaacacacacacacccctacatacaggtgatactactaccagctgatacttgaaaaacgtctttagcagaaatttatacctaatatcctgctttgcaatccagatttattgtccatttttccatcgatttacaatgtaattgatttagaatgcatgaaaattcacagaagaaaaacaaattgccaataaatagctaaggaatgttcagctttgtgaataggcatggaaacacaaattaaagtgaggcatttgttttgcaattggcaaaaacagaaagagagagaaagtaggaggaagggaggaagaagagaaagagaaaaagaaaagaaaggaaggaagaaagggaggaggaagtaatggataaagggaagaaaggagggaggaagacaaaggttgataatgcacattgcaggttttggtttccaggtctcaagatgagaaacacagacacacacacacacacacacacacacacacatacacacacacacatttctgtggcatcgcacaatcttcttccaaagatattttcttcttagattttcatgacaccaccctctacttgtctgtatccttcctttctgcatatgtggtctcatgggcacttgtttatgtgctactccttaaatatcaatatttccagtatttcagcttgacttctctcttgtctgcccaaataatctcattcatttttctgatttccacaactgatgattcatacaaaagtatttccagcttagaccttactaatgaaatttcaggatttcaatccaaaggttcactcgtacatttctgagagggattctaaactcagtgtgccccaaaatgaaaatttattttacacatatttatcattttagccgcacaatgaacccttcataaggcaaatacaacaaaaaactataaaatatgtctttttagagggcatcaaagataatctcacagctctttgaatattatagtgacatttgttattcagcagtttggattgataacataaattttaaaattagaaattaattaaaagaataatgccactcagctctagaatatttcttcattttatacagtgcaacaggccactaaatatagcactaaaaacattcctttttacacaagtattgccttttagtgctataaaaatgtactttcgggagagtagcacattatcatttaagtgaagctcttcattagatagtgtgagaaaatgaggcatgaaaggaagatggcaaagcctccttaatagttcctgtgcagataatgtaggccaaagacaatcaatagccatggctcatttattttatgcctgtgagcacttagaggcaaaatgttagtgtttgctatcctgttggctttctttgctctgcatcagtaatgaaaaaataaatttgcatactaaggtataatttttacgaatttgactcaaaaaccaggctgttattgttaaccaatatggaaagaaacactttctgtattactttgggttcattacagccactatgaagcagctctgattataaatttagtaactctttagaaagccaaacaatgaatacgaaagtatataaatacattataaaaatgcattaaatgtacataaaaattaagaattccataaaatatctagtttaagacatgtcattatagttgatgaaggcaatcctaaaatcaacatattgaagataaaatgttttcttaaaaagtctattgattgtgcttccacgtggaacacatgtttagctatcatgtatgataactcatttagcatcacctttagggtgatgacagattggaaagcaatgcatgtctacatgaaatcaaaaggcttcttttattattgctgtcatatttatgggaacagagcttacaagagaaaaattttcagtgaaaaaaaaattgttatttagaaaacttcagttttccatagagtaaaacttaaatgccatatacatggattaatatttgttttatataagataattaaatgttagacattattctttgaaaagaaactgtactggaagggataaaatagtcagtaaagttcttccatgggaaaactccgcctgccacatcttcccgaggtatgagtcagaatgttggtggtgagcaggaggaattaattagtgggaacattacgagacagtagaaaatcagagaaaaaagatacggggggaaaaaaaacaataaaaataaaaaaccagacagattgaccaataaataagatattaggaaaggtagaacaagaaaacatgattgagtatgaagacagttttgggggttctcctgaaatttagtggatacttctttaactgcctatcatgtgaagaacagaataaaaccccacacagcagaaaaactatcatcaaaggtcagatctatagtgcctacggttcactaatctattctgattttaacagttagacctcaaaacacatttttcttgggaaaaaacaaatatttcattaattcctcaacttcaaaaagctaagaaaatgttataaataaaataatgcaaacaatcatacttccatcatttctctatattttcccacatacttatatattttggctgtttagtattgtttatcatttaaaacactgtgctaaattttttacccttcccttttccactaaaacttttaatttagatatattaaaaatatagtaacataagcagcaaaattcaacttgtcatggtatataaacataccgtggcataatgcttcacaaggggccgatttcaaaaaatgtgtagaagtaaccagtacacacataaggcttctaaattgggatgataaaaaataagtccctactgtgctgtgttttcactggcacaattctaacatgattgtttaaaatgttctttcatctctttcgaatctcactgttctttaactgctagattttttttcattacattttaatgcattagcttcatcattaaaaatggacaaaatataaatatttttatatatgtattttatacctaatagatatattaaaattttaatattttcaagatattaaaaatagtcattgtaggaaaaatatgtcattgtaagtaccctaaatcagcttataagttagctgggaaataaaactgagaaatgagaaagaagtaaagaggcagaatatgctttttggtaaaacagtgtgggataagtgtatttggagttagaaaggcttcatagaggaagcaaaacaggaaccatggattgaaatgatgatgcagggtgtcaacaaacagggaaaatggcatgagcataatagaacaatgaggagaccaaaatgattgcagggaagggttcaagtcagggaaggatgagaaagaaaattatgtgacttggtgtaagccaatttaagagggattttgatgccatgctgaaaaaataaagttggctttgtgatagaagaagcaacagtaagttactacattggttaaaaattaaccaactataatgatttggccatacctattgaacaaattattttatgtttaagaaatattactagaaattcagtctagaaagcataaaggggaaaatatgagacattttttcatggaacaaaggagactctcaaaataaagaagtgactctcaggtggggccaaaggtaaaaaataaacaaaatgttcctcagcagctgtggtttcatctcctaacttgtacttcattggcaacatttaaggggttagacaaatgagggtaaatagtgtcactaacaaatttgttggatattgtttataacattttattaagttttggaaagttgaaaatgaatgtctgtttagttatgtttctaatttgtgaccgatgatacattgaattgaaaaggcttacttttgctataagacaattcatatctttttaaaagaaatagatcatgatgattataaatcataaatggatattaaatagaaacagagggctttttgttcccaagagtttacaaacaataaatagtgcatttaccttttcttatttgaccctaagacaaacaactgctacatttaccaactaatgcataacctgcatttgtaaaccctaattccgaggctatcattagtgaaaatcagtctaattttcatatgctttatatatcaacacattgttatctctatttcattcattcttgcattaggtttcactcttggggagtgggagtcatgtgttgcaactaactactatcccaaatactgatgacttcaactaaataacatttttcctatgttttaagcacaaaggaattattattatgcaagggtatttctgtttttgtcattgttctattatatctctaggtccagcaactcaacttgaatagttgtactgacccgtggaaaaattcctcccttcatcaataataacaatataatatgagtagtaatttatattgttattataggtgtttacctatatgatatagtttatattgatcttcacagcaacataccatctcaaataattctaatttcacacttccactcaagaaaagtaaggccactttgaacttctgttccacacttaaataacaaaggtactttagacaagtcataacttggaggctcaagttcttcatttgtaagatgtgaatattatactctatttgacgatgttcaattgtaagaataagttctaatgaactattaatggagtgacatcctaagattgcaaagaagatcttctagttttaattgagggcttcttagacatatatatatatatatatatatacacacacacacacacacacacacacacacacacatacacatacacacacacacacacatacacatacacacacacacacagacatatatatatatatataaactgttggggactaagtgccctctatttctagttaatgtccatttataatttataatcatcatgatctacttctttaaaaaagatatgaattgtctcataacatatatatatttgcatatataaatatatatacctgcatgtctgtcttcactcattttaaacaactattcactgatatatatcacacagaaaatgtctttgctcacattactagctgtgagttgttttgtctctaggtaccataattattgccaggtgtttatgctatagaaagtactgagtgtaagaactgccatgttggtcacttgcaaaggtattccccctgggaaaacaaactttaacagattgattaaatcatcttctctacagccattaggaaatttgtttcattaaattttatttattttcctacattactataaaattcaaaagaattacaaagggaaagaacagctctgtgtaatggaaagttcacacaatttggaattaaacaaaaagtttgaatcttgtttccacatttaccagctgaaaattcttgagcatcaaggtctaggaaggcagcaaagacttataccttataagaaattccaagatgatgtcccatgaatggcaactctcgctgattgaggctttttatcctggatagctcagcaaaaatcagaaatagaccttactgcatttcagaggagtgtgtgtgtgtgtgtgtgtgtgtgcgtgcgtgcgcacatgtgtgtgtagataattactctttcctacccaacagtcttctgtaactatgttatatccttcaagagaaaaagatactttgctcagtcttttgttagaaccacatagcaatggaaactggagcggtgatgaagaacccagcctttcaatcctcaaagcattcatgctcagtggtttctctcttgaactccaaaatcatatatcccactcaccatcctaccttagatatttaatagacatctctgacttaaatgtgcaaaactgaattcctgatctttccctcctccagtaatgacatttaacaattctggcaacaaaagatgtccaagataggttagtaaagaaaaaggactatatataaggtatgactcaaattttgttaaatcaatacatacacgcctacatataaaactttatgtattggtatttgctttgaaaataggttaaagaatatatactcaagtattaatagtggctatattcagaatgagggagagcaaaaggctttcatgtactacataatatgaggctggattattaaaaagatttataatgagtttctcatatgttataatcagggcaaattaactgcaaaactagcataagtaggttttgattttttttctaaaaatttcacttaggtattatattttgtgactcagagcaaaggtaggatgacagtgaagggttcattgtaaagccagcctttctaataatatattttgtcatatttggaaagaaaaaaataggtattcaaaatcaatctttgatgagtgggtaggttaaatgtatgtggtgtaatctgggttcattccaatttctgtaaatgatttgaaatttataaaactaaacttggctttcttatggcacatattatggctctaaacagtatttacatgaaattatcaatacacatatttccctacctgttactttaggctactgctttgtacatttgttaaaatttcaaaaaaaatcattacatctatttgtatgccagaagattacagctttaatatatcattgttgacatcagaaaatagtatttattaagtgctcatttggatgtgctattctatggggctcaatagttgagtaatcttttactcagatgacttataacagtatgttaagatgtcacctttaggcatgcactaaatactaaagggaaattgtagaaagaaaactcatcttaagttcttatcctctttacttatttttctcaccttctctctttttttccctttgtactctcatttttggttaatttttttaaaaagtctagcccatatgtgaaatgattttcctacttttttcacttatatttatctaactactggaattagtcttttgttaaccccccaattttgtcttggattccacaatacatcttttcctttatttgatgtctaagcagaaggttggttatttaattcctttccttggagggagaaaaaaaattatttgtaagacattctatgactttctgcttgtatttaatgaagaaaactctatttgtagagtagaacaaccatgacagttaacagacagaaacaaaggatttctccctacctttgatgatttactacacatatgatctttgagttagtttcttaccttacttgagcatagatgtcatcatccctagaatggaaataataaatttatggagtggttgtgtgaactacttcatgcagtatgcatgccatactacatgcatactacataccacatgctacatactaatctgctgccatttcatatggtaggccaagaatctagcagactctatggtattgtacttatacttctcccaacctggaattcatctgctatggtctaaatcagcctcactttagatcaaatcagcctccttatggccctagttattttttaactttaggctctttttaaattcctctatgagtgagactgtaatttacaaagcaattctaaaaactgagtgtggcttaatttccctcaagaacgtccaatgggctacctctgaaacaggtttcacattttcgctcggacatgaaaaatctcagagaataatattcagcctttctactacaagttttattgcttgaaactccttcctatgacagtgattcctgtagccttctgctttttgattgaagttctgactattgaccaccttttgaacccctgcctgaaatattttcctatctggatatttttctagtcagtggtttacaatcattgtctccactaagaatacttttgagaaaacattgttttacatgtgtggtaatggaatcagttgtgcccctatcaaaatttgtatgttaaagctctaactcccaatgtgactatattgagagacagggccgttaaggaggtcgtaaaggttaaacgaggtcataagggtgggacctcaacctaatagtacttacgtcctcataagagaagagagatgacagccttctacaagctaggaagaaagagaagcctcaccaggaagcaacctgatggcactctaatcttagactttcagtttccagaattgcaaggaaataaaagttcattgttttagtcatacagtctgtggtattttgttgtggcagcccttgcagactaatacatgtatagtctagatttaacttattgtgatattttaacaaaacctaaatatttttgaagataaacaaaacaaatagcactatactaacattacaatcattgcaataattcgtaatgataactggtatcaatgcagtggcagttgctcagcttgccctgtggcagagagaagaaccttgctctccggcagcttactgccctgtattttaagatgttcacttgttgattagggcttggaaatgtgaaaaagttaaatatacttgtggaaagtgagacatttttattgacagcattcatttaaacaattctctaaacatggttattaatatacagttgaccctagaacaatgcaaggcttaggggtaccaactcctcatgcaattgaaaacccacataaaacttttcactcccatcacttaactactaatagccttctgttgactggaagccttactgataatacatacagttgattaacacatattttgtatgttatatgtattataatatattcttataataaagtaatctaaaaaagaatgttattaagaaaatcataaggaagagaaaatgcatttactattcattaagtaaaaatgaatgatgataaaggtcttcatctttgtcttcatgtggagtaggctgaggaggagaaggaagaggaggggttgatcttgctgtgtcaggggtggcagaggcagaggaggtggaggaggtggaagatgaaggagaacaggcacattcagtgaaacttttattgaaaaaatccacatatgaatggcctgtgcagcgcaaacccaggttgttctagtgtcaactgtatatatatgtgtgtgtgtgtgtgtgtgtgtgtgtacacacacacagtcttttttattagtcaggattctctagagggaccttgactatatatttaaaaattatctatctatctatctatttgggagtttattaagtattaacttacacaatcagaagctcccacaataggttgtctgcaagttgaggagcaaagagaacgagtccaagtcccaaaactgaagaacttggagtctgatgttcgaaggcaggaagcatcgagtgcgggagaaagatatagactgtgggtgtaggccagtctctctttttcttgtttttttgcctcctttatgtttgatggcagctgattagactgtgcccactagattaagggtggatctgccttccccagcccaccgattcaaatgttaatctcctttggcagcaccctcacagatacacccaggatcaatactttgtatctttcagtccaatcaagttgatgcttagtattaaccatcacaagtccacccgttgtcaaattggcagaagcattatgtgcaggataggcaaacccatatctggagtaagtgtctattccagtgaggaaaaacctctgcactttccatgatggaagaggtccaatataatcaacctgccaccaggtagctgactgatcaccctgaggaatggtgccatattgagggctcagtgttggtctctgctgctggaaaatggggcactcagcagtggccgtagccaggtcagccgtggtgagtacatgttgctgaacccatgtataacctccatccctgccaccatggccactttgttcacgggcccattaacagattacaggggtggctagggaaaaaggctgagtggtgtccacagaacaggtcatcctatccagttgattattaaaatcctcctctactgaggtcacccgttggtgagcactcatatgggatacaaatatcttcacagtttttggccactcagagaggtccattcacatacctcttccccaaatttctttgtcaccaattttccaatcatgcttcttccaagtccctgaacatccagccaaaccactggctacagcccatgcatcagtatagaatggcacacctggcctccatgcaaagtgcacagccagatgcactgcttgaagttctgcacactgggaagatttcccttcaccactgtccttcagcgatgtccaagaaaggggctgtagtacagcagctgtccactttagggtggttcctgcatatcatgaaaaaccgtctgtgaaccaggccctagtcttctcttcctctgtcaactgatcatagagaactccccatgaggtcatcagtgcaggctgggggagagaaggcaggatggcaggcgtggaggccatgggcatttgagccacttcctcatgtaacttacttgtgccttcaggacctgcttgagcccgatcacatatgtagcacttccatttgatgacgcaatgctgctgtgcatgagccactttatggcctgatgggtcagaaagcacccggttcacggtaggcagttcaggctgcatggtgacttgatgtcccatagtcacatgttcattttccactaaagcccagtaacaggccaggagctgactctcaaaaggagagtagttatctgcagaagatgacagggtcttgctccaaaatcctagaggcctccgctgtgattcaacaatggggtactgccaaaggctccaaacagcatccctatctgccactgacacctcaagcaccattggatctgctgggtcatacggcccaagtggcagagcagcttgctaagagcctgaacctgttgcagagccttctcctgttctggattccacttctggaaccaaaatctgtattagggttctctagagggacagaactaacaggatatatatgtgtgtatatatatatatatatatatatatatatatatatatatatatacacacatacatacacacacacacacatatggatatctatctatctatctatctatctctctgggaatttattaagtattagttacacaatcacaaggtcccacaataggttgtcttcaagctgaagagcaaggagagccagtctgagtcccaaaactgaagaacttggagtctgatgtttgagggcaggaagcatctagcacgggagaaagatgtaggctgagaggctagtccagtgtctctctccctccttttcatgtttttctgcctgctttagtttcacttgcagcttattagattgtgaccaccagattgggggtggatctgccttccacagcccactgactcaaatgttaatctcttttggcaacaccctcacagacacacccaagatcaatactttgtaactttgaatccaatcaagttgatgctcagtattaaccatcatacacacacacacacacacacacacacacacacacacacacacttagaaaatattctagctttaaatgccacatgcaaactttgcaacaaacaggcaaaaaaacaattggcagatgtaggtattcacaccttttataccaatcaatcaatcaatcagtcaaccaatctgcaatcaatgcaatttctatttatgcactaactactatgagctaactgcagctcaaagtgttacggtgtctacatttcagactcaaagtgaatattcttttaaataacatgtacttagcacaatatctgaaatctacattgtttcctataactatggcacaggatataattttttagggtacagctatataatcttagtttctacatcagtctgtaatctcactgattacatttaagtgcatgaaaaagatacaattatagaaaaagcaatatttgagtaaatagtttcatatcttttattgtcacttgaattctacaatgagatagtttgttagaaatgtattcttaaaatatttagacactgttaaataaaaatactggatgagtctacttttgccaacattgttttgtaaaaaattcagatattgttctataaaattaacatagtagtctatttttcttctttgtgtgtatgttcttaacatttcaaatatgtgatacccaataaagtattttgaagaagcttagaggttgataaaatggatgatcttaaaaaaggacataccgacttcgtgaatgtatgtatagtaaaattgatagaggtacatatctttttattgtgctttgcaggtattgcattttcacaaattgaagcttttgtggcagccttgcatagagcaagtctatcagcaccatttttccaacagcatgtgctcacttcctgtctctttgtcacattttggtgattcttacagtatttcagaactattcattattattatatctgttatggtgatctctgatccacgatctttgacgttactgttgtaattgttttgaaatgctagaaattatgcccatataagacaatgaacttgatcaataaatgtgtgtcttttggctgctccactgaaaagccattcccgtatctctctccctctccttggaccactctattcttggagacgcaacaacattgaaattaggccaatgagtaaccctacaatggcttctaagtgttcaagtgaaaagaagagtagcccatctcttattttaaataaaaaactaaaaatgattaagcttaatgagaaaaacacattgaaagctaagataggctgaaaactatgcctctttcgccagttagataagttgtgaatgcaaaggaaatgttcttgaagaaaataaaaagtactactctggcaaacaagaataataagaaagggaaacagccttattgctgatatagagaaagttttagtcatctggatagatcaaaccagctacaacattctctaagccaaaacctaatctagagcaaggccctaactctcttctattatatcaaggatgaaagacgtgaagaagctgcataagaaaaattagaggctagtagatgttagttcatgaagtttatggaaatcagccatctatgtaacgtaaaagtgcaagcggaaacatcaagtactgataaagaagctgcagcaagttatccagaagatctggctaagacagttgatgaatgtggctacactcaacaacagattttcaatgtagacaaaatagccttcaatgtagacaaaacagcagctgttgactttaagtttaagccaatgctcatttgccattcagaaaaatccaaaggccttaagaattatgctaaatctactctgcctatgctctatttaaaaaaaaaaaagaagcctggataacagcacatctgtttatagcatggttactgaatattttaggcccattgttaagacctaccactcagaataaaagattcctttcaaaatatcactgttcatttacaaagcacctggccatccaagaaccctgatggagatgctcaaggatattaatgttctcttgcctgcagacacaacatccattctgcagtccacggatcaaggagtagttttgactttcaagtcttattttttaagaaatacattttttttttttttttttttgagatggagtctcgctctgtcgctcaggctggactgcagtggtgcaatctcggctcactgcaagctccgcctcccaggctcatgccattctcctgcctcagcctcctgagtagctgggactacaggtgcccaccaccacgcctggctaattttttgtatttttagtagagacgaggtttcaccgtgttagccaggatgctctctatctcctgacgtcgtgatccacccacctcggcctcccaaagtgccgggattacaggcgtgaaccgctgcgcctggccaagaaatacattttgtaaggctatagttgccatagccttcagtggaggaagtaactgcagacgtagtggaaataccaagagaactagaagcagaagtggagtctgaagatgtgactgagttgatgctatctcatgataaaatgtgaatagatgagttgttctcattaaagaaagtggtttctttttatgaagtctacttgcggtgaagatattgggaacattgttgaaatgacaacaaaggattttagaacattaaataaactttgttgataaagcaatggcaggttttgagaggactgattccattttaaaagaagttttatgtgggtaaaatgttatcagaaagcactccatgctatagacaaatcttgtgaaaggaagagtcaattgatgcagcaaacttcttttgttgtcttattttaaagaaattgccgcagccaccccagccttcagcaaccaccactctgatcagtcagcggccatcaacatcaaggcaagatcttccaccagcaaaaggactgtgacttgttgaaggctcacatgattgttagcatcttttagcaataaagcattttaaaattatggtatatacatttttaaggcataatgttattgcccatttaatagactatgttatactataaacataacttttatatgtactgggaaaccaataatttcatgtgacttactttattgtgttgtcccagaactgagcctgtgctatctctgaggtacgcctgtatatttaatctctccccacaaatgtcaagggagcttctgatataggtaggatcatttcaaaatgattttgtgatacttcactctctttacagagaggacaataaaaactacatttaagttttaacagataatttttagaaataagagagaagtgctacgacttcactgtggactaagccagtctttggtggagatggagccacagcctgttggttttagggacacaggtcctgcctgggtgtggtatctccctgcctgggtgtgatgactccacttcttcctagtcaggggacctggaaaaattaaattctgcaacctgcttttccaagtctaaataggtgatgccaataatatctacttcatagaaatgaaattttaaaaaaatttaaaaccaaggtgtaaaaaccactgaggacaatatttgatattctcatcaacatcgctgttgttgcagtgttactgacactgttgctgttgttgttaatgttactgaagaacactctatcctaagaagtattctctcaggttgaaatatcttcttagctaaatctagaattgggatcagatgattcatagatacactcttcctgtgccagactctatgagatatctgataatattaaaaatggaaggtctgaccctacattattttttctttctcaaatgttagtgacaatgtctatttagagcaatttcaaagtaatgtcaggatgtcatgggcacattttgtcagcatggatctgtggcaatacatacaacttggttttcaaggtgctgagacaacttggcgaatatcacttaggcccttcgtgcctggtaggcagaataactaccttaatttttcaaggtgattaagctgattaagtaagaacactgtgattcttcattcattcgtcttcacttaaccagacagaaaggtctttcttacagacaaatgagtataagtggtgtgacttaatcctcctattcttttcttccccctccacccccaccacagctgccactccttctaaaagagccagatctttaatatcacactaattcaaagaccctcatttcagagttgtgagattcctcttttctctttgtaattgaaaacatctaacagactttctaggaagcaaatgctagagcactaacctctgaatgctatttaatcactcctttcaatcaatttacatgtttatttatgagaatttctgtacctgttaagtgctaaattaaaagaattggaggggaggaagacactattaggaaaaacccagaaagtagtgctacctgaaacatttatgagcgtctactgcaaacactcttaaaaactggtaaattgcattttaattattttgtaaatgtactgaaattaaagagcatttggaaagcagtcatctagagttgaggaggtacaaattaatcacatggttacaatgaatattcagaaattcaggaatccttaatggagcaataataattttcaagcaacattagtacttctcggcacaggcttagggctgcttgaagcatattttcacactgcggaaatgtttactctacccagaagcctattttccccaatagaaacacaatgaaaattcaaacacaataaatcatcctcaaggtacaaagattcaaatgccacaagtgctttgattcactctgcttcaggggcggaatttttaaattgaagaacttttaaatttgttcgaacatagcagtctggaaatgagaaacgcaaagccaattggattccaagatcttatttctgtgtccctctgcattacccttggcagtgagtcactggcataacagatagggtcccaaaatgtgatgtatggagcagagtcattttacctccacagccagcaggagaggctcagagagattacaacttggagaggactcagaggtgcccacaactaccaccccattttaaaaatgagaaaatgaacctaagagatgaagtgaattaattctggttttcaaagagttaaaacaaattaagaagaaaagacaagtttcctgattcccagcctagtttccattcctttccaccattcaatgaaatatatgaaggtcatatctcatatctagttataatataggttagtactatgttctaaacactcatgtgtcacctccaattaatcaatcatttatgaagtgtaccagaatatgcaactctgaagtatgtcatttcaacataggggttacttggaactaaagtcatatgaaaaataccagatccaagaaggacactctcgacttacctttttcttccttaaaacaggagataaaaatgttcatgtgaaagatgctccttgaaccaggagaaaagaaacattctttgatgatgaatcatagctgagagaattctgcacagacgggccttattaacataactcatcttttaagctcctccatataatttaattgctttttcaaaacttattattctttgtccaattcaaactggacaaagtatataagtatataagtgattgacaataattgcttcgttgggcctacatttccttttgagggctccatgtcacataaaacattaaatttgtatgcttttctcctgtttatcttatgtcagtttaattcttaggtccagccggaaacctagagagaaaaggtaaagttttgactattctactggcctggatttatctaacttgtgttgtactttctgcttttcttgtactgttgcatcctataaatacttgcctttttaatgactatttcacagtattttttaaatgtttggtttgttgttgttttgtttgttttttgtgttttggagacagggtctgactcttgttgcccaggctggagtgcggtggtatgatcattgttcactgcagcctcaacctcttgggctcaagtgattctcccatctcagcctccagagtagctgggctacaggtgtgtgccactacgtccagacaattttgtattttttttttagtagagatggggtttcatcatgttgcccaggttggtctcaaactcctgggctcaagtgatccccggcctctgactcccaaagtgctgggattataggtgtgagctactgcacttggtcacacaagatcttgtatttttctcttttattgtcttcatctcttaaataagttgttcaggtaaatagtaagagctagtatcattgatgtatcattacttagttaagacttccctttttggaaacgctgagctatatatagcttttagatgttaaagcatatatagaacattttgtactctgctcaacaaatcattcctatcctctgtactgtggttgctaccatcaaacttttaaatcatgtttatgtaaaccagtgatgctgcaaaaagttacagccccataaatgaagttgtagagtcatagaactgccagataagaaatgttacctgcactatacatccttcaccacatctacagatcttcatcaagaaaacctttctgcaaggcaagactgcagcttgtcttttaccctcactactggggtttttgacagagaaagagtttataatttcgatgaggtgaaatttatcaaatttcccatttatggatcatgtttttggcattgagtctaagaagtttttgcccagcccttgatccccaattttttttctggatgtcttatggttttacgttttgtccataaaccattttgagtttactttcatatacaaagtgagggttaaggttaattttccagttaaaaaaatacatataatgatgctattaatttcatattttgattttgtaaaccataacatatcaatttgttttcattatcattattagcactatgagtttgtctgtaaaatcatttgggttttcaacataaacatcacatgattggtatacaaagatagttttaccttagccttaattcttatgccgcttttgtgttccttttacattagctacaatcttcagtagaatactgagtagaaactgatattgcaggtgtctttgttttagtcttgactttaagagtacttctaaaattttattatgaattatgacgatgtaggtttttaagtaggtgacatcaataattttttactagtttattaagaattttttagtaatattggaatgctcttttaccagatctttgcatagtttccttctttatgacatttaatatccatttattacctcttcagaggggctttctaaaactaccttagctaaaaaaatctcattactctatttgtccttattgtctttgcttttcttttttaaggcagtaatcattacttgatatttgaagattttattgttgatacgttacttgtctgtatcacccactagaatgcaagttccctcagggcaggtatgttatttcttttattcatctttgtttctccagaacctagaagacagcctagtacccaagaggcattgaataaagagttgtggaattaataaattattgcattccaccaatgctcaataatttaattagactaatcagctaacacagctactatagtaaggaagtagtatatactatatttttacatttagtaacaaaaagcatgaaggtacaataatttttcaactttttcattaaatctcctttacatatgccttagagcaggaatatgataagcactaattagaaaatattagcattgaagatgtgccacacaatagtacctgcatcactctttgattcctatattcctgtgctttttggatcctcagcttctctgttctcaatggctggatgtgtgtaaaatgtttaaatccctacaattaaactccttctcaataaatgattttgtcttcccctttgagagttttaggcccagtagagcctaaaattggagggaatactaatcctctgaattatttgttatgacagtaatatcattccgttgtaggttcttttgacatgtcttaataaaatcaaaattttaaaccgtgtgggatattcaaagcaagataaaaataaatgctgctatttttgataattaagagggcagtagaaacatcgtctctgaaattcaatagatgatctaaggcagctaactttcctgctatactattcaaaactgtagtgagggtatgagtactaaaactccaggaggcgacaccactgtatgtagacagggttcctacttacaatgccaaacctagaaatagattcatgaggccctatggaagtgggtttgtaagccattcaccaatattgtgcatgatgtgtccaaatctgaggaaaagatatggtaggcctgtggcagccaattagtcatgttcttccccccatttttccttctgaaaaatgtagaatgactaacaaagttgggggaaaatccccataatttacaaacactgaggttgtagaaagaaactagaatatgcaaattttatgcaagtggggtgtatgcaggtgcactggattgaatagtgttttccccaaaattaatgttcaccaagaacctgggaatgtgaccttatttgaacatagcttctttgcagatataatcaagttcagatgaggtcatactggattggaatgggccctggtttaatgactgaggtcctaataagaaaatggaaatttgggcacagatacacacagagtaaaaacagccatgtgaaggtggagacaggttggaattatgtgggcacaagccaaggaaagccaaggattgtcaatagccaccacaagctagaagaagcaagggaggatccttctctgtatccatcgagggagcatggccattacaacacctttggacttccagccttcagaactgtgagagaataaatttctattttttaagttgcccagttcatggtaatttgttacagcatctctatgaaactaatgaagcaattaagacaagcaaaacttctatgacaataagaccagaaaagaagaggggagtgcaagaaagctagcagtggcaagcttagaaatcaacagcaaatactgaattttagaaaaaggtgatctcacattagtaggaactctgtgaaaaggactgtgatcagatgaaaagctatcattgtgggcaacaaagaaataaatcagaagaaatggccagaggaaatcaaaggagacagatctcagaatttcctctttataaagagtagaagttctattccatggtaccaaagacaataaatctgcgaggggagtacagagctactagtgcaaactctcttgaactcatcagttctgagaggcaaataaagtatgattgtattttaaagaaacactccatcagagtagcaccagaagagtcataagcagaaaaatataaaagtctttgtcacttctaaggaactttcttctaatagttggtatggaaaaatacaacttatacaaaaggaatatatgcaatcaaaataaatatttaaaatcacaattgaaatatataaaatatgataagaataagtaatgtgggaaagagcagcacaaattcattgcagattcttaaaaattcttacaagaaaattatttctacagagcattcgaaatttgtaacccaatattccatcacaaattataaatgaagtacatagaacctatgaaggaaaacagctaggcaggaggatattagtgatttccaggcaagaggaagggacaaggaacctgtagaaatcagaaaaaaaaaatatgggaataagttctaagaagccagtgaaagaaaagacacagggagaaacagagtaaggaatgtagaagatataaatacataaacaaaacaaatgaagcagaaaaaaatgtataaaaagcagtggagtgaaaatataagagattaggcgaagaaaatctaacacagccataatttaaatatctaaaaaggccattaaattaatagaaaatgaatgtaaaaataaattcaataaatttaatccaggaataaaagttgctttaatatcctaaaataaatgaacacaaaacaccatataaatagaataaggggcaaaatccacatgatcctctcagtagatttagaagtgcagcttgaaaaaaaaattaacatgctttcatgatagaaatagccaacaagctaagaacagaagggaacttcttcaaccagataaagagcatctacagaaaacccacagctcatatcatacttaatggtgaaagacttaatatgaccagagataagacaaggatattcacattccccacttccatgcaatattgtattgcaggtataaacaggacaattaggcaacaacaataaataaaagaactccagactagaaaataagaaataaaactaactgtaatcttagaggacataatcttacatacagaaaattctactagttctattatttgagtttaacaaagttgtaggacacaagatcaacacacaaaaatcaattgcatatacacacattagcaatgaacactcaaaaataaaattaagaaaataatttcattcataatgatttaaaaataaacagatataaaattgacaaaataagtacaagacctgtacattgacaagcacaaaatattattgaaagaaattaaagaagatctaaataactggaaagacatttctatggattggatatctgaatattattaagatggcaattccgtacgaattgatcaacagatgcaacacaatccctactggaaacacagttggctttttttttttttaattcaaaattgacaaccagattctaaaattcaggtggaaatacaggggattcagaacaccaaaaacaatcttgaaaataaaagataaaaatcagtgaacttccagattttaaaacttactacaaagctacagaaattataacagtgtggtactagtataagtatagacatagaaatcaatggaatagaattgagactcattataagtcccaaactttagggtcaattgattttccaacaaaggggccaagataattaaaagtgaaaaagcagcttttaacctttagtactagaacagttggataatacacatgaagaagaatgaagttcaatgcctacctcacaccatacacacaaaaatgagctaaaaatgaataatagaattaaatgaaagagcaaaagctataagaagaaggtataggagaatatgtttgtaacttaattaggcaaatgtttcttaaatataacatcaaaagcacacataataaaagagattagacttcatcaaaactaagcatttttctacttcaaaagacatctttataaaagtcaaaagtcaaggaagggccgggcgtggtggctcacgcctgtaatcacaacactttgggaggctgaggccgggggatcacaaggtcaggagttcaagaccagtctggccaacatggtgaaaccacatctctactaaaacccaaaaaattagccaggcatggtggtgtgcacctgtaatcccagctactcgggaggctaaggcaggagaatcgcctgaacccaagaggcagaggttgcagtgagcagagatcacgccattgcactttagcctgggcaacagagcaagactccgtctcaaaataaataaacaaataaataaatcaaggcaaagacttgaagaaactcttacaatttaatactaaaaagataaacaatggaattcagaaataagcaaagggatctttaaaaataggtaaagaatatgaataggtacttctccaaaaatgatatatgaatcacaaataagcacatgaaaatatacttaacatgattagtcaataagaaaatacaaatcaaaacttcaatgacacactaaaaagattaaacaatccaattcaaaaatcagcaaaaggatttttaaaaatagctaaagatacaaataggtatttatctaaaaaatatatatgaatcacgaaaaaggacatgaaaaaatactcgacatcactagtcaataaggaaatgcaaatcaaaactgcagtgagataacacttcacttctactaggattattataataaagacagacaataacaaatgtttgcaagaatgtagagaaattagaactatcattgtcaatagaaatgtaccatggttctggacttctgaaactaggttttcagttttccaaaatgttaaccataaacctaccctatgatagcaaaataagtgaaaacacacacccatgaaaaacttgtacatgaatgttcataataatcaaaaagtggaaacaacccaaattctcatcaattgtttaatgtaatgaaaaacaaaatatggtatacctatataatggaatattatgccacaatgaaaaggaatgaagtagtaacacatgcagcaatatggatgaacattgagaacattatgctaagtaaaagaagccagtcacaaaagaccacatattgcagatcctattgataagaagtgtctagaacagcaaatctatagagacagaaagtagatcagtggttgtctaagtgggagtgtatgtgagggaggcaacagagtgacttattttgagatggtgacattttctaaaaccagatcttcataactgtcacaaaactctaaaaatatgttttttaaaacgccattgaagggccgggcgcagtggctcacgcctgtaatctcagcactttgggaggccaaggtgggcggatcacgaggtcaggagatggagaccatcctggctaacgcggtgaaaccccgtctctactaagaatacaaaaaaattagcggggcgtggtggcgggcgcttgcagtcccagctactcgggagactgaggcagaagaatggcatgaacccgggaggcagagcttccagtgagccgagattgcgccactgcactccagcctgggtgacagagcgagactccgtctcaaaaaaaaaaaaaaaaaaaaagccattgagttacccaccttatactggtgaacttgtatggaaattacacctcaataaggacattaaaataacaaaatcaataatacaaaaacggaatctaaaaattgctattggaaaggtacaccatattctggaagaatgttacttggaacatcaagacacgtcctaataaaattattatgctttaaagaaagaatcctttgagtgctcagccagaaaaataaactgctttacaacagatagaaaagcaggtttgcatcaggcttctcaacagcaacatccaatgccataaaagagcaaagcagcatctacaagatactcagagagactagcttccatctttctgttgtagaatcttagaaatgtattagcctttctggcacttctgaaactaggttttcagttttccaaaatgttaaccatagacctaccctatgatagcaagataagtgaaaacattcaaccctgaaaaacttgtacacgaatgttcacaataatcaaaattgacattttgggtaaatctaaatgaattctatggccttcctgcaatattaaggtaatagaggctgaaaatacctgtgtttctaaaggcagaccttttggccaaatggaaacccaccactgtgtatagatatccctggaagctcaagtaccttaatttgctaaatgccacattacaggatgccatgtggcctgcccagcctttccaactaggcttattttggttttacaacgtaatagattttcctttccttattactgtatttcataaatgaattatgtattattctaagagattatagcagcttccctaaaaattatagggaatgtttacctactgggagctatcaatatatgtgtcctttataatgtagtttaaagaatgagccatctttttatgaattaaatattacattattatattaaaagtcacatttttaattgactctaaatcactctggaagacgacttaaaagtaattttctagaaacatgtttgttttcttttacacagaagtagagtcatttcatacattccagctatcaaaagaacgtggagattatgtagtataatcttctcgctgtacaggcaagcaaacttggttcactggacaattgatgacaattaaataaatgcagagctgaaaccagattctaggtatctgcttgtttgtctaatgctccttaaactgccccataacctcccattttcttctgtttctgtctgtagtcataaacatctcattagtttattcattctgtaaaaacgtattcattatccactatgtgccaactattctttgagattcaggggatgcagaggtaaagaaaataggtaaagtccatgttctcaggggcctttcttctctgatcatatgtggcttctgcagaatctcattgaaatggcctcccattcctgctgtttttaccattcttcaccaaggtccatcttcatcaggtacccagggcatttctattctctgtctctctaagtgtcaaggaaaacaacccaagtagccttatagcctgaggcagaccttcctccaagtcttctgtgttcccctcactgccccagtgtggacgacatacccctgctctgtgctcccttaacactgtgtgcttacctcagagcaccacaacctggaaaggtatttatctgcttatttgtcactctttctcttaaattatgacctccttgagggcagggactggtgtcttgttttttccgatatctctagtgtctgcacctgacctggaacagaatgagtgctgactaaatctgttgtcgattaaattgaggatgtctgcacaaacaaaagatcttatatagggcttttaaaccttactgaaaatgagtttaagtaaaggaattcttcctcttagggtcatttgcaacttactagttccaaactaattatcagtaaataatgtcaaaaatatccaatttatttttggatgattttcttctccacactgatgtcatgtttttctcaatgcaatgtgtcagcaagggacacatctcatagctgtggaagaatacaaccatctcttctacttatcctacttaactcaggataagatgctgatgctagaattttcacaaaacagagacaagttctgttcaacttctgagaaaattacttcggttttctgttaaatgccaaattgatttaaaaattgccacatgataagttgcagcataaagcaatgcacaattcagaactggggtagttgtcagaagctatctttcagaactgagctgttttcatttgtgattgactgaaggaggtctatggtctagtttcagaaagagaaaacagcaataacaaaaccctcagcaccaacatgaaattctacacatgctggtttagttattacacaggccaatttataattctttctcagctggaatctgaaatggcagtcaataaattaattcatatctgaacttttatcctttcagtcatgctctctaattgaacactgcttacattttgtattgggaatgtaaaaacactccaggatatctttgcattaaagggaggtacatgagttgtactacataattgtctttgaattgtattacaaataactctacaagagatactaaaatttgtccttactatctactaaatactaagataaataatgtcaacacaccatctactattctctgcagcaaaggtgtgtgtgtgtgtgtgtattgttgatgtgtatatatccacatatatatacacatatatgtatgtgtttgtgtatatatattcaaataaaatttgatatttttagttttgtcataaaaaatcaacattattttctcaaataaatcactagctactttaaaattcaatatcattactttatctgagtcactaaggattaagtgttattcaaattattagcaggaatagttccctggtattcttcctagacttaacctgagtattagttagaataattctaaagcagaggaatagttttagaaagtccttcatgttccattctttctttaggaactcctggttgagtctatctgctacccatctgggaactacagagaccataaacatcgtaatgacccattctccttccagtacctcaggcagagttatgggaaagtgaaataaatataacatacaatgaatgcaagcccattttgattgtgtattaacatttatttatctgaaatggaattcagcattagtgagactatgattaaatttatattcttctccatactagagattacttaactatttaaggctcagtcacctatgattaaatggttttgcattttaaatatggtatgtcaggtgtctaatactgtttttcacacgttaatgactcaatggatttatatctgttatcccttaatatattcctagttatcaataaacaatgtgaaatgtcacagtacagagataaggtagatagacctaattggaaatggcagtctttcccaaggatttaaagccctaactaaactattccttcaggcaaccattaagaccagttgcaaattgcaaatactttttttttttttttttttgccatctctattttagctactgggtttactgccctgggagttttaaacacaatgtctgcctttaaaaaggtggatcgggtaggttggaaaagttacataaatacaaaacataatgaatagtttaaggttgaataccagttctttcccaggtttaccagtctataaatataaatgcaaatgagtacagtatatgatgaagtgaaacagcaggaaagtgtgaaaagagctctaaatttaaatagcaaaattaaaagaaaaatcctacttcttttatctaactggttattcaatcttgactttattcaccaacctctttgggaagcagattttcctctctaacataaggggataaaacttgacacagtatttttcagcttcatcgtgttatgattaaggttggaagtagaagtaggaagtgattcttgagctttttggggggagtgaaagctggttggagcagggtgcacctaaaataacctttgaaagatgagctgaattcagtctggcaaaagcaggtgaaggtggcatatgagatgagaaatcattgtaagcaatgtctcttaatcagacaattccagacaagtttaatagcacgatgatggtgatgatgatgacaacgaagataatgcaaaatattttagattataacaatacatcaccaccatcaccatgtgccatctgccattccattttgagcaaattatccctcaggcaatagttgcacttgctagattttacaccatgtacaatacagtttggctcaaataaaaaccatctaaaactggaatgcctttgccccagcaaaaataaaaaaaagtgtgtgatgtcttcattaatatgctaatttgcccatttcctctcagagtaaacataacggccccatgcacaggttgacctaattaacagtataaagttgtttctttcaaagtgcacatccaagaaactactgtgtgaaaaagaatgaaacctatagggatttcagcctttatggagaaatgggttaaagaaatagaactatgatagggcttaatattgttttcaatcactaaaataaaaatcaataacatattacataaagacaacactaattatgtgtcagtaatattaaaatgttcactattgatttccctctgccatcttctaatcatgataaacatctcaggaatcctgcttctctaaaatttaattgcttatatatgtgtactgtattgaatattaagtacatattgaaaaacatctttttctgcacctagtcttttttctaatgtctcataccgttcttcacaatgtcatatgccaagtcctgccatgatgcaccgtcactaggactgctagatttagtaagtaaaaatatagtgccaaattaattttaaatttcaaataaaccaaaaaattaatataagtatgccatatataaaaataaatatatatatatatataatatataaaattccaaattaataagactggcatcttatactttatctggcaaccctaacagtaactgaaataattaaaaatgaaaaaagattatttccaagtaaacatttcttatgctttcttcataaaatccaaaatgacatatgatcagcttccctcatagtaatgctttatcaaagcacatatacacagcctcttttacaagtatcccagggccacagcaacctctgtcccttccatcccacacaatctcgggagcattaaggcattggttatttttcctacattgtcctctttttctccccaagtttcaacactataacattccattatgctttgtctacattttttcaattttccaaacaccagtatcccttttttctagttatgtttaacaatttgcaacatctgacttcatagttttgaagtgtagacagaaggtaacttgtgtgtactctactagaattttacataaagaaaacttgcatttttgaaggtttatcttatttaagtatctatagttttatttgactcagtcaaaatactgataaaagatcagatcagaaatatttatataaaaattattgtcaggaaaataccagtacaatatatatttaatttccaaatacgtattcactttatttgtattaacatttctgaataaacaacacggattttgccatttactaaaggccagcttttgaaatgggggccagtataagggaaatttagttcagatcctcaagggtgaaaaaaaaaagcttttgtgtgtgaaaattctggactatttccaatgcaaaactttcagatgcactgaattattcatttgtatttggaaaatattatgggctaacagctgaacaaataaaatggcatgttaaaattgtagctattgatatctaaaagcataaaatggattttaaactgttatgggagcattttaccttattttacaaaccggtaacgttccattaggagtcattcagatttttaaaaatgaggcaagtataagtaacaagataactgaactgagagcaaggactctcattttaatttcttatacaaacagaagccattatgatttttaacagacattttctgcctctattttctcatctgaacagtggggataatatctttcagacagcttgggggctgagaaaaagcaagttgaatagatttctcctataaatctaggaaagaaaaaagagaggtttcatatcagcaaatcaggagaatatcctgttttagtccttttctcatattcagctaaaataggttgtgagaattcaaagtcctcaaactgttttttgttgttgttaatattttttgtggttcacatgatttgtcctcagatttttctttctaaaccgacttttttttttccagaaaaagaagggaggcctttgtcacttttatttgttacactgggaaacaaacaagacaaaacaaaggctttgtacctgccctgggattgagggtactttttcaagctaacactctctatgtatttatcatatacttattcatttggtggggaggttaagctttccaaggagaaagaaaaagcaggaaaacctcaagtgacagtgctctgattctcctctagacttccaagcagttcatcctgagaaaggaaagttaaccagcccagcccgcgttgaaaggctacttagtatgcttctgattgtggaggattggggaccaggtgtcaaagtactccttctgactacaagtatctctaccctgagagttcctgtaaattgggttttcttttctattatacatttctaattacgtttactgcctcttatagaccgaatccagcttgccttctgtcagtcttcacaaggcaatcctttgcaccctgttgatgacatacttggctctttggtccttgtgatggttaataccgagtgtcaacttgattggactgaaggatacaaagtattgttcctgggtgtgtctgtgagggtgttgccaaaggagattgccaaaggtggactgggagaggcagacccaccctcaatctaatcagctgccagcacggctagaataaggcaagcagaaaaaggtggaaggggctgacttgctgagttttccggccttcatcttgctcgggtgctggttgcttcctgtcctagaacatcagactccaagatcttcagcttttggcttcttggactttacaccagtagtttgcctggggcttttgggcctttgaccacagactgaaggctgcaccgtccgcttcccacttttgaagtttggggactcagacgggcttcctgattcttcagcttgcagatggcctattgtgggacttcaccttgtgatcctgtgagtcaacactccttaaaaatctcccctgcacacatccatctatcctgttagttctgtccctctagagaaccctgactaatacagtcctctttagtttatcttataaggaaggagtcaggacataaacactgctttgaagtcctgatgaagtcaagattctcaaacttaggttgatgaatcgcaataggtgtggcctatgttatctgtcagtgctgaggtttgaaactgactgcagactatattcctttatcacagggttgtgcccttgaagaggctgtgttgagaataagagattgttcataaagaaggcttgaatctagtgggagtttagtaaatgatggttaatatttacttcaatatttccagcacccagaacagtacctgaattaaaagacattcatgaagtatttggtaaatggatgaaagtacttagcttaaaggtggtagtgatttttctgttcatgacattattatttatttatttcaagtttaaatatctattttggactgctaggttacaaattaaattatatacacttgaagatcttctgtgacctatacattgataaacacatctaatagattattgttgttaggccttttcaacttaatagaaaagtatgaaccaattgttataagtgaaaatatgtttagcaatttatttccttcttattgaactggttaagcataccccttacctgggtacacaattaaaccttgccttgttttcatgaaatctcattctgctttatttatttatttatttagagtcagggtcttgccctgtcaccaggctggagtacagaagcacaatcatggatcactgcagtctccagctcttgggctgaagtgatccttccacctcagcatcctgaattgctgagactacaggcatgtgccatcacttctggcttcattctgttcttttggatccttagatggttgactacctaaatacaattactatatactatagagcatgcactgtttttactgaaaacacattggggtcattcccaggagtacatttggatcctctgggatttgttttttaaatctcttattccacaactaaccaagatatcgtactatagcaattctgccttgattattttttcatttcctactaaaactccaaaaacttgtcattcttagctcattttctttctaagaaaactttcttaatttcttctcaatttttatggaattcagtgctgcttacttattataatgtttgggtcccttaaaaactcttagatactgaaacattagcaaactaagaaaagccattaaaattattctactgaattaaatatagaaacttagaacaaaggaataagaattaacattgtacatcagaaaaatatctgtttacacttgaatctcagctgtagtgcatcatccatggagctaaatttaaaggtttacttattattcatggcacattattctggagttttgtcaaaaattaaaacagagctgctctattattgtatatcaatcaagtaaaataagaaatttgtttgtatatatacatgtgtatgtatatacatacacacactttttaaaagcataaatgtaacagtaattggctttatgtatttaaagctttaacaatgactttactatttgaccccggaattcttctccgaggaaattaccacagggaaagtattagggatgggttcatgcatttatgtttacaaatatttattgctttgttcattacaataaacacaggaaaaatctaaaattcaacaatacaggaattttgattttaattttatcatatttatacaatggattactaggtcacattgaaaagtgtgccttacgagaatgctaagaggtcaatggacataatctaattcaaaggtgaaaaaatacactttcaaaattataattaatgtttttaaaacttttgcagggatcatgaattatattagtattctgataaaagacatcaatcctttacctagaaaaaaatgcactaatgcaaacaaacaacaaaatggtatgcagttgggagaagagggtgagattcccatagccattctggggatgctaggtaaaggaagcctgatatatattgccatgattttcttaaaaataaactgtatctatttttttttaattttatacacatatatagaaaatgttcagagacttcagcagcaaggtaggctaagactgtccaaatagatttcctttctgctacaacacagagaaatactgaataataccacatccatgtgcacacacacacatatgtacaccacatgagtacgtgcatgcacacacacacacacgtgtggacgcacacacacacacacacacggagctaaactggacagctacacttaacagaagaaagtggacatctgcaggcatagaacaataggagaagacaaatgcagaagaagaaaggttactgatatcataataatcttgacgtttcagaggaggatttaaacttttcacctggatttgtaatgctcttggagatgagacatgacctttggcctaagccagacaagagagctggacctgagattccagcacaaaggagatcatcattggatagacacttgatgaagttttattttattatttttgtttttaataattagatgatttaattttttttggtcacttaagattcacaggtttggggtatccttgactaaaaatgaaattgcaagaaagagaatagactgttctaaaataatagacatcagaacccgaagatacacattgccaataaaatatttttaactctgtgcttaagtgtggtgggaaagttttagagataagatatcaaattttacataattcttactttgtaactataatttcttttactcactcttttaatcatataaatcaaaatctcacagacatttactagttagggatttttaccccttacataaacaaacactggcttcctaaagggaatattttgggttgtcataacttcattcaagcatttttcagttaagttaaaagcaaaagtaaaatcactgcaaaaatatagctgccattgtacatctactactgctgagtaataatgcatgaatgaagacagccccttacccatagccagtcgcttgagagaaacttgaataagcaaatcaagcacaagcaacagaggcagacagaggatgattgcatgggtcgctgaataattgacattgccttaacagttgaatattttcagtgtattctaattctgagaaaaattgtgataaatatacactttttgtcaaaatctagttaagatatcaacaacgagcaatcaacttgacagaatctgaacagaccatataccagaataacaaggctcttataagacaagacatttgatactatgtaacttttggggaaaaattctgagattcctcagactctaaactcaaggctggctcctaccaatagtgtctctgttatggtttgacttgtgaccccctcaaatttgtgtactgaattcttaaccctaagcaccacattatacgagcttatttgaaaataggattgttgcagatgcaactaagatgaggacatactagaacagaatgggcctctaattcaatgtgactagtgtccttatttaaaaaaaaataaacataggcatgcacacagggataacaccatgtgaagtttaaacaggaaactgacatgatgcaacagaagaccatatactccaaagattgctagcaaaccaccagaaggtacgaaagaagcatgaaaaatactctcccaaacagacctcaacatcagaaggaaccaacttgaccaacaatgtgatctcagacatcttgcctccagaactgagagacaatatatttccattgttgataccatgcagttgtggtacttttatacatcagccctagcaaactaacacagtctccttcaaaatatacaaatctcctctcatccctttccccttcattagcacggtttctctattgattcttgctaatatttagaataccaaattatttgactcttttgaggctttccaaaaactaatttaactttttagaaaaatagtcatggactttgactgtggtaaacaaggttgctaaaaacaacttccttttataaacagagaggaatgctggataaagtaaatagaaaaaaaaaaatgttttaaagagacctaatttaaaaggaaggccaattagaaagagagctgaagaagaatttagtaaactaaaaaacagaactcaggaaagtatccagaattaaactcagagaaagacgtaaagataatagaagtgaatacataaaaggtatgatgagaacttataatgtgtgtaccatagcaattctataacaatagaatagagagaataggggaaaagaggcaatattcaaagtggtggtgaatgaaaattacccataattgaagaaagattgagtcctgaaaaagtgtcagtatcaaaagtgttaaattaaaaaaaaaaaaaacttaaacacttcttttagaagaaataaaaataatccaaacttcccaaattcaagagaaaaagttgccctaaaattctaagaaataatgactgccggattgacagtagtgttagaatcaaccacagttaacaagacagtgaaaaaatagattttaagtattaagagaaaatatctgtcaacttagaattgtatacctagttgggattttaatcaagagtgagggcaaaatagatatttttgtccaaggcattatactcacagatttcactgaaagaataccaatagaagtacttcaagggaatataatttaactcggaagaaaatagtggagtataaaataaaaataaaacaatataaaataaaataggaatataaaataaattagtaaatgtattgtctataaaaagtattgataatgatgaattctgacgtcataaattcaaaatatagatatggaagatgagactggtgattgaatttaaaagattaaagtttttgtatttggaagaggttgatagagatattcagtcgtgacagacatagttaacacaagtattaaatcattaaattcaaaactgtcaaagtataaaaatagaatgcataattttaaattaatagaataaaggagtaaaaaagaaacttgactaacgtattagtccacttgttctgttattacaaaataccataaactgggtaatttataaacaacataaatttatttctcacagttccagaggctacgaagtccaagtttaaggttctggcatgtgctgagggccttcttgctgtggcctcacatggcagaatttggaaggtgcaagaaagagtgaacccactcccacaagccccttttatagtagcattaattcattcgtgaatgtggagtcctcatgaccgaaacacctcccgaaagtccccacctcctaacattgttgcattggggttttggggtttgtttccaacctatgaatttggggagtcatattcataccacagcagctaataaaatagattgagaaaaataattaaaagaaagcaaagggaaagcatggcatagaaaaaaataaaataaaaaaatccatatatattaatagtctcaaaaatgtatgtggatggaaattttctgtttaagctcagagatttttcaattatatttttcttaaaaacaaataaactcgtaatatgtatataaaatacatacctaaataaaagatattctttcagtaaggttgaaattaaagatataaaagaagatatatttgataatactaatgtaaaaaaggttatgcagccatattaaaatatatcaacacagattttaagtaaactacattatttttataaagtgggtcttttaatatatgtaagttacagaatggtagatatttgtggtattaatcaacatatcctatatgtctagaatagtacctggcacataataggcattcagaaatgtttgtttagtgaatgtttaataagtactaaaagaaaacattagcagtgagttaatacaattctcttcatatataattaacaacttggtttcaaaatataaatgaacacacattatgtttacaaggtatgtgtgcacacacacacatgaaattttagcaaaataaaaaaaaaaacaaggcaaacaatttgtgagaaattgtgaaccttgtaatgaaatcctcactaccatctgccagactgtgttacctgtttgagctagacaatgtgactgctaaattacaggtactgtgactcataccaataacactgttgtgtaatatcatgcttgtgttctcatctttgcttatttaataatggcatgaggtgcatagataaatcagtcatcttgtttagctgagtccctgatgctaaaaggacaaggtgatcttcaaattctgttttcagtgtgatcatgttgctgtctcctccacattcttcagtagcatctggtaagcatgcaatgtgaattgctaattcaactctagctgtaaaattagtctatgttcagcagagagtgtaggagcagctggtaaacaatatgagatcccacaggctccactagctgaatatacttcaacaggatgcccgagtcatttactttcctatctgtttctctagtgatgctgcaaaatttggaaagggtttccagacagacagctagggttaagtggtgtggggatgagggagataggaagtctaaaagacatcgcacaactctgaaaaaacagtttgataagactggaaacacaggactcggactctaaccttatttctttttctataaccatcatggaaggctacacctatggtgaactctccctttataccatttttcagttcattttttttttctttgagacaggctctctctctctttctgtctctctctctctctctccctctctctctctctctctgttacccaggctggaatacagtggcacaattacagctcactgcagcttcaacctctccaggctcaggcgttcctcccatctcagcctcccaagtagctgggactacaggaaggtgccaccacgtccgactaatttttgtatttttttgtagagacagggtttcattatgttggctaggctgggctcgaattcctgacttcaaggtatccaccggtttcagcttcccaaagtgctgggattacaggtgtgaaccaccacacttggcccatttttcagttctcttttgcatttttcttccaaataatctaaagaaataataccatcactattatcactcttcataacagttttcaatgtgtttgtttaataaaggaatgatcttagtcactaggacttagatataaaaatgtataggcgtgatcatcactccaccaagtaagtgcagagtttaacgattacattaattccacactatagaagattagatgtgtgttgccatcacaaagtattctagtttatttgtattttgtcattacaatgtcataagctgtagtctttgcccaggtgtacaccaacttaacctactggactgtgatcagagtgtacattaacttttgtttcttctgtagttcagttaaaaacaaagtcttttatttctacaatggtttcattttcctatctaaagcccaggtccactccaatatacttgttagaataaattatttgaacacatttctgatagcattcaagaagtttaaaacagaaaggaacaatagataatgcaaagtgagaaagagtgaataataaaaatgtagttgctgatattgatgaaatgtggtaggaagataaaaacaactcaaactatgcagtatttcccaacagaaaaccatttcattctatgtttaagataatatccagaatgcctgcaatgaggttcagtggttaatttaccttgaaatattgaaatgaactctgtgatcttttaagacagagagtaccatgggtttggcagtaggtttaaaaaaacacttctctcctggaggagggacacatattctatcataggtttatttgctttggtaaaaataacaggtccttatgaggatgactgatgtaattaggaaaacaatttttaagaacaacattcattgtcagaaaaatagattctcaacaaaacatgaatagaaaaacaagagcaatttttataattgagtcaactttccagatgaggaagaaaacttccgatgtgtggctttctagtttcagagctattaagaggtctgggaagccatgtccactaattgtaaacaaacaaacaaaaacaagtaatagagttggtgaagaaataaaaatgtgcaactcacttccttgaaacaaaatgacaaatatgcttattaaaaccaaaattgactgcatttccttgggtaaaacataaatcattacagggagcagatggccaatttgctattagaaaaatagaacccacctattatgttcttgaatatggtaaatcagtttcagagctgaatcttgattagagttaaaattcaaaaacttggtgtattctgaagtaagatatattggaaacatatcttagtaacttaagagaggcatggagagctgagacaggctgttttcagaggagagaagctgcctccataatatgactgcagactgaagccattatagaatgggtgcattcctggaagcacacactaaaacagagtttggggtacaaaatgctgattaggcattgatatctgtgaaaagaagggtaagaagcaggattaggaagggaaagaagttaaattgtgatgccaatcaacaaagcatctgctagggaactctgcagtggatattaccttccaaagttgtcttgcaatggatggaaatggccataccttttccactcacttatcaggtgctggatgggtaagaggtacagcaagtctgtcctctataggtaaggtagatcctgaaaaaaaaacaggcagctgcaagctatctgctgatagctctccctgcagctggacatcaaggtcttcttgagtcagaatctgggcaatacatcttcctatctaccagagaggcctaaggaaagatggccctctgagaggctcttgtgccaggtaagagatccaaatacatgaagattaatgattattgtagtgaattgcggatttcttcccttacctaaaggcattcccattcaattaaaaaagaattgaactcaaactcaaactggtagtatagtatacaacacaaggatagccagaaaataccagaataatgaggcctaagaagaaaatttaagttcttttttttaatggtaatttatatagctgatcctttaccccatcaccactgattaacccagaagagttgttctctttggtgtaattaagaattatttaaggaacttgtagaaaatacagatgtttagttgtgatttccatggatcgtgattcatgagagcagtgatgtgttcagggattccacgttagtatcctggttatgctgaggtgagtgaaacagtgcatgaaccacacttggagaacaacatgcctaaagcttcagtaaactctgttacatgccacactcccgtaattcagggtctgaaagaagaggatgtctaggaatgggcagaaaggagcagaacacgacgtgtagggcacagaaaacaacaaggaaaagcaccagaggagatcaggcttcagtgacaaatatggtaaaacatgtcctttgccaaatgcactagacgatctgggagcaggcatttctaaaacacaaataatgggcaaaatgacgtatttagtacttcaggaaatagcaattgcatataaagacagtagggaatatgagacttcaaaatcacccaaatgtctttagcagatttaacaagcctctgactttcccacttacaagttgatcagtccaataaatgtctatttaaacttatgttttacttagcttataaccaaattctcataaatttcctttataccttaatgtagaatagcatatctctggaaccaagagaaagttttaaggtctacttgttacccctttttcaatggctttaaaatattttattcataattagaaagacagttctggattatcaagcgcaagatctcttcatttacgccttgtgaataagtttgacacatttatgtagagcactgaataatttagtgaactgagaccacttgggactgagcaacactcgtatttggactgcctcagaatttttatgaattttgagtttaagcccagaaacagtgacaaaaaagtgttaacaaaaaaaggtatatgaatgtataaaaaaatctccttactttttctatatttagtgtgggtctacatgctttttaaataaccctgaacacaaaacacttaagaatgcttgaaagattgtagaacattcattttaaataaaacatatttccttgcttttaatcaatctaaaagtaggtgttgcttcattaatttcaaacacattaggtattagaatgtgaaaggagggggttagaaggcacctgatgacatacttaagtttaataagatcttgattgtgatgttaaatcataaaaacaagcaattatgaatctaacaaaaagtattttaggctggacacagtggctcacacctgtaataccagcactttggaaggccgaggcaagcggatcacttgaggtcaggagtttgagaccaacctggccaacatggcaaaaccctgtctactaaaaatacaaaaattagctgggcatgctggcgtctacctgtagtcccagctgctctggaagctgaggcacaagtatcatttgaacccggaaggcagaggttgcagtgaaccaaaatcaagccactgcactccagtctgggcgacaggaataaaaaccaatctcaaaaaaaaatacaaataaaaaacaaaaataaataataattgctcaaactataatggcataattttgaagacctcatttttatggaatagagttgccagttctgtaatctgagacttcataaattaaaaactactgtatctggaaatcatacctgtaatgcagtgacagctctcttgactttcacttagttggtgctggttaacagtatcttttccctggcctttgtaacccacactgactgatataccaggtacaccgaaccctctctgttgttgattactcactcatgttcatgacttctgttgatcaatgaggccttcaatcaacaaaaacaattgcatttgcaaaggacctaccatggagtccagagtgggcattcccacccatgttagtatctttctctttctttctctctgttaaaaagtcagaagctgttacaacaagaagaatagcaaaatgcattactagcatcatattaaaaatgccataaggcaatatatgtgagtacactgaatataaaaataaaaataaaatactattatatgatattatgttatatattatattatatactctactatattctattattataataagaaagcacaacaaacaaagaatacctaaaatataaaattaggaattccatgggtctcttgtttttgaattgggggaacttaaacggtcatctaatctcaatccttttaattgccaaattagaaaacggactcagaggagttaatatctatagattacttattttggaagaggtactatgttaattatgttatatatattctttatagtcattgtcaaagcaaccctaaaacaattattatttgcatttgagaattattctctgcactttacagatgagcaagggaggcttgctaagggtttttagctgcagagattaaaatcacttctaacttacacccaaactcactttttcctgccttacatcatattgtataaagggaccgataaggattttaactgaactgaggggaggcagacaaggtagtgattcatttatgttagctttaattaagaagagttccatgataaacccaaagactttagaggccagtcaggagacctaaatatgtgaaggagtaatgattactaaagagcattgtgaatttctacctaaagacatttctgttcaatttttaaaatatgaactggcccaattaaaatatatctgctggatggttacccatttgcaacttatgaaagagagcaaaggtaagggatctgcaaaaataagtctggaaaacatcctaggcttgggatggaggcactataatatatgggaaggtacaataaacagatgaacaattaaagaatcaggggctggctggtcttaaccatatcaaagaagtatgtatttagttattccatatatatagggagggcagacttggtagtacaagtgaaaggagaggaaaaagagggggggaacttttagtggtccttaggtgctagcctgggtatttgtattttattagaatgaagaaaggacccacttagaaatatgccaaatacttccctattgtattctaggtatacttactgtatattgtgcctttggaaaagcctttacattttacagattggttcactaatatttattgaagataaataacttcctcaatgtcataaggtagaaagtgggtgagtaaacttttaaattgtatctgtctggttcctgaaagaatccacacaacattataccatacagttttctgtagaaaatactcacttttatattctatgtcactactactctaagtattcttcacatattagctaattttatcttcataaggcacagaaagacaaatacttcatgatctcacttatatgtggactctaaagaagttgaaccagtggtactctttaccaagagtaaaatatgctgataaattaagggaggtgtgaaaaagaaaaaaggcctttagatcgattagttttcttttaatataaataggttttggtagtgtaggggtagacagacaggacagctttcctcacccatcataaggatcatagctgacactactatagcaaaaggcaggttaataagagaagagcattaaaaaaatatttaatcagttctatgtgacatgggagccttcagcaatgtagaccaaattaggttagatgaaggataaacagccatgcaaaaatgtgattggacaaaaagggaatgatctaatggtaatagactgagtgagggaactcagcaaggcttgtttgttcagattcttcttaaactctctgtgtagtatttttctcctgagtatagggcaggacccattctgaaatgagggtcttatgatctattattagacaagctgggtcaaacaatttcattacagccagctcctacacagaaaggtggaaaaaggttaaagtaatatttctaggttttatggctggcttttggggaaagtagttctggaattctagtttctgtggcctgccttgagggagaaaagggagcaggagaaagaagggcaagagaatgtcagaaagagactctgtttctgacacccttctgagacccttccaatgtccttcagttcaaactactcagcattccaaaatgccacactctggggtatcattttctgaaccccaatagtagatcagttaaattagagaagtagaatgataatgaggacaaatctctgtgaccgaactctcaaagtcttttaacctttcccctaagttgcattgaaagtcttaccctctaattcccatcaattatttcagaactgcaggaaaaattgactgggaaaagttggtgggacaaattgaatccatcaaataattccaagtgaaatactagaaaaaggaaggtgggcattgtgatcctgagacactaaacatgtctccatttgttctatatcaatattccactgctttttgccagcatctgaagttacgttgtttaccagctagtttatttgtgaaatcgagtattctccctgtattactactatgtgaaaagggtacaaagcaggcatacatctttttctataaccgtcctttcatttttttcacaagttttagtagatacatttacagaaacccttatatgtaaagaagtcttagtaatgtgatttaatgaaaacacttaatttgggaagagaccctttaaaatgttccatttgcatctctctgatataaatttcaatatcaaaattccatcaacagcaggggaaaaactgccattaactagagatagcaactttgctcttaatagaaacactaaattactgctctaagagctaaactacatataaaacaactttagttctttaagaaagggtgagcaacattttattttcgaaaggaacatatgttattttcatttgccttaaatgacacatggaaattaagaagcctaccattaaataggcaaacgatttacaagaaatgaaatacagtgctaacaaaagttcaaatggatctggtttcaagatttgaaaatggaatattactcataataaaaaggaaaggagtaggaaactgggcttagtgcccattaagaaggtaaacttgagaatgacaaaaggctgaacatatacagagtgaatggtgaatacaaagctgaaaccaatgtcttcatctgtattgcctttgaagaaaatagggggaagagcataggtaagtttctaagttgttatacaaatttcagtaaaatagtcaatattagtattttatggtacttttggttacaagtaacaaaatcagactctggctaccttatgcccaaaagaaaatttattagaagaagctagagtatataacagaatgcagtgaaaatccacccaaggaagctatggaaaagcaggaacctggagagctcacagatcctccctagagatgttaaggaaactttcctttaaggaaccgtaataagcctgccagagtttcaagaagttcaaatccttttatcactcaaatatcaactttatattaaagttaggtgtccattctttgatcagccaaatgcatctaagggactgttacgtaggataaatgaagcaactggggcttacacctgtttgaggggatattcccatagtagacaaggttttgaactggcatttcctactacacagtaaacgtagttacactaatgaaaaataaaaacaaaagttgatacctgaacaccacattacatttatcattcaagaattatttggggccgggtgtggtggctcatgcctgtaatcccagtactttgggaggccgagacgggtggttcacgagggcaagagattgaggccatcctggccaacatggtgaaaccctgtctctactaaaaatacaaaaattagccaggtgtgctggtaggcacttgtagtctcagctactcgggaggctgaggcaggaaaatcacttgaatccaggaggcagaggttgcactgagccgagattgagccactgcactccagcctggcaacagagcgagactccatctcaaaaaaaaaaaaaaaaaaaaaaaaaaaatatttgattctatataatagtaacatagaagaaaaaatgcaattgtgtattaactacctcagggagttactataaaaatgtagacacatgaagttgttaccacttcgtttaacaacttcacccaagggatattaactttattcttaaatacatttattcattttacatatttattttgtataaattgggtaatattccaaaaatgtagaaaagttcagaatataataaaacaaatgtctgctttcactgtatagatataatacatattttatactgcaaaacattaacctgtacacagttctgaaatattaacctgtatacagttctttcagatattatttttaatgacatacaattgcttcagatgtaataaaaccattattttctctctacaggttaactattttccatcattttgaattattcacacacacctaggtaaccataaacaatacatatcattgttgtgtgtgtttaaatcttacataaatattatcttactgtcagtatccatccccaactggtttttatgaagcaacaacatatttttcagtttgagtcatgttaatgaacgcagttttagttcattaatttaaaatgctaaacggaatttcattcatctatattgatgaatattgaggttgtttatttccttatttcttgcctgtctaactaaaggaatgatgcaataaacattgtggtagggagctgactgagcatgtgctcagtggtttacgtagggtttaaagttaaaaatggaattgttattatacaagacttgttcatctatgcttttactagatattttctccagaatagttgtaccagtttacagttgcagtagcagtgtatgaaagctgccactgaactatgtccttaccaataatgggtattatcatgtgtaatattttagtatttttttttactaatagtagtatctttttaaatgatagtcacagaatagttttaacatattcattgtctattttccttttatctatttacctttttctattaaagtattaatttttacatataacagataaattttatttgtcaattatggctatttcaaacatattcatccattttgttttttatttttttctcatactctttaatagttctcgaaaatatcattttaccctccatttttgataataatttaacaggacataaaactaaaaattgacatttcttttctgttagcaatttttagatgtattttaattatcttcacaacatcctgttgttaattagaattatttacttgaattgccattcatttttagataatcctatgattgctgttaaaagtatctatctttgcattttatattttaaattcaatgtgtctaaatttggatttattcctatttatccctctcagaaagctgtgcattatttgagtacttgccttaaattctggaaaattactaagaattaagcatcaatatgcacagttctcattttcactactttcttcttctgtaattcttattattccaacatacacatgggatcttttcattctctcattttatgtgctatgttgcttaacttctcatatgtttttccctttttgttggtgctgcatcctttataatttcttcagatttatctttcaaagtactgattctttcttcagcttcatctgatcttctgtttaaattaactgagttttattttcaatgactgtatttttatttctattagttctatataattatttccaagcatgccttcttttgtctacttttaattcaatacacttcttaaacatatttattttattatatctttcaaattgttctattatttcagtaattgtcagggtgccatttctcctatttgctacatcaacagacactctatggtaatttgtttcttcttgggctttgaattgctgctgcaattgaacttatctttgaatattaaaaacactctgtgaaacaaattaccatttaatatttttgctttcataaaatagaatagtaaacaccagtgaaaaatagatgaactaaagctacatgcatcaatgtaaggagtcatataaaataatgtttataaaattcttggttaagaaatacatatagcatgatataaattttagaagtttaaaatatataatcaatgctacatattattttggattacatattcctatggtgaaaatttaaatatgtacaaaagaatgataaatatccaaatcagtagttacttatgagagaaagaagcagaaggagatccagcatgaatacaaatgagaatacaaattttgtaattgcttgtaatcttcagagtatattaacattcaatatagtgttctccacacatttctgtagattaatacataaaggcagtaaagtcattgagtagcctctcttccaaatataaaacaataaaaagataatcattaaagcaagtcttgtattaatattttaaactttaaatagattactaaaataaaactagaatatctgaaataggcccatctcttagaatttagtataataaaaccagagactgccacagaaaactaggcaaataatctaataattcacagaactataaatggccttgtatccatcaatctctctgtgaaatattttctacttatataaagtatgtatatttattattacctacatatatatacgtctatatctaaagatatataaagttagaaaaaaggaaaccaaactattattgaaatagtttaatagaggtagggttttaggtgatttaaaatttccagtgttctaaaataacaatattttaaaattatgttctgcttttatccaaattatatgctcatgcttaaaaagttatataattcagtggttgtacacaaaagccacagactactcttattacatactttttcctgcttctcagaggcaaccactttcaaatagtttgcatgattctatttttatttatatgcaaatttctctgcaatatgattatattgctacttcttaatttatttggatggggaagggatgatttagacactgtatattgacattctattttggaagatacaaatcaagcctttttcaacaccactttggcagaccttgctctctgacacacgtgtgtcctcagcctctcatcattatgtcatatcatggtttggttgcatatgcaatttttacattgccatattgatataagcactatttacaggatacacatgtcagacattacttctactcttccttttataaaaatattaatcctttttattttttcagtttattgtacgatttttaaattgtgtggttttgttgccattgctttctgtgttttagtaataatcgctaactgtcatttaatcctttgcccccatatcccatatatcacttttgttaatacatgtaaatatacaagaaattataaatttaccttgttaaatcaagccctcctgataaatctcatcctgctgcaaattaccctgggtgtttctccagacctgcctacagctgtcaccttgtgatgggtgattccctctacctttcttctagattggatgccctattccctagatttcttgtcctctttcttggtttaccagctaaaacatcttccagtaacattaagaaaataactgcacgggagataaaagtcttaaatactttgttgcatacttagccatagaaccctagattataactcatactgtctcatcagaatcacgaacacttggtcttattgtttactagcttatttcatattaatgttccctccaaaagcttaaatatttcctttctttgtatccagggtactgacttttcaatgatgtgtcttaagatggatctattgctattcataggactgggaacatggtcacatggtgagtctattcattataaaagcatatgtctttccattctgggaactttttatgatttttttttttcatgaattcctatgctatattttctgttttctccttccgggatttctatgttttaagacgttggattttctctgtgggttccctaattttattttattttatttctattcttattttttcctaatttcaatcttagacattttgcttttcattctggaacagcttttcaactttaccccctaaaactttcattgtatttttccatttacactatcttagtttccaacattaaaaaaaaaaaaatctgtgttcttgttttcgagatgaagaaccttttctcacatctttgaggatattaatcccagatattttgaagctttcttttggtgaaaacttttctccgagttattgtttgtttgttttagtctctttggtataacatgctttcttcaaatatctaataatccttgggattctgctataaaagcagagcacctctcctcctccaaaggaacgcagctcctcaccagcaacggaacaaagctggatggagaatgactttgacaagctgagagaagaaggcttcagacgatcaaattactctgagctaagggaggacattcaaaccaaagacaaagaagttgaaaactttgaaaaaaatgtagaagaatgtgtaactagaataaccaatacagagaagtgcttaaaggagctgatggagctgaaaaccaaggctcgagaactacgtgaagaatgcagaagcctcaggagccgatgtgatcaattggaagaaagggtatcagcaatggaagatgaaatgaatgaaatgaagtgagaagggaagtttagagaaaaaagaataaaaagaaacgagcaaagtctccaagaaatatgggactatgtgaaaagaccaaatctacgtctgattggtgtacctggaagtgatggggagaatggaaccaagttggaaaacactctgcaggatattatccaggagaacttcctcaacctagcaaggcaggccaacgttcagattcaggaaatacagagaacgccacaaagatactcctcgagaagagcaactccaagacacataattgtcagattcaccaaagttgaaatgaaggaaaaaatgttaagggcagccagagagaaaggtcgggttaccctcaaagggaagcccatcagactaacagcggatctctcggcagaaaccctacaagccagaagagactgggggccgatattcaacattcttgaagaaaagaattttcgacccagaatttcatatccagccaaactaagcttcataagtgaaggagaaataaaatactttacagacaagcaaatgctgagagattttgtcaccaccaggcctgccctaaaagagctgctgaaggaagcgctaaacttagaaaggaacaactggtaccagccgctgcaaaagcatgccaaaatgtaaagaacatcgagactaggaagaaactgcatcaactaacgagcaaaatcaccagctaacatcataatgacaggatcaaattcacacataaccatattaactttaaacgtaaatggactaaatgctccaattaaaagacacagactggcaaattggatcaagagtcaagacccatcagtgtgctgtattcaggaaacccatctcacgtgcagagacacacataggctcaaaataaaaggatggaggaagatctaccaagccaatggaaaacaaaaaaaggcaggggttgcaatcctagtctctgataaaactgactttaaaccaacaaagatcaaaagagacaaagaaggccattacataatggtagagggatcaattcaacaagaagagctaactatcctaaatatatatgcacccaatacaggagcacccagactcataaagcaagtcctgagtgacctacaaagagacttagactcccacacattaataatgggagactctaacaccccactgtcaacattagacagatcaacgagacagaaagtcaacaaggatacccaggaattgaactcagctctgcaccaagcagacctaatagacatctacagaactctccaccccaaatcaacagaatatacatttttttcagcaccacaccacacctattccaaaattgaccacatacttggaagtaaagctctcctcagcaaatgtaaaagaacagaaattataacaaacaatctctcagaccacagtgcaaaactagaactcaggattaagaatctcactcaaaaccactcaactacatggaaactgaacaacctgctcctgaatgactactgggtacataacgaaatgaaggcagaaataaagatgttctttgaaaccaacgagaacaaagacaccacataccagaatctctgggacgcattcaaagcagtgtgtagagggaaatttatagcactaaatgcccacaagagaaagcaggaaggatccaaaattgacaccctaacatcacaattaaaagaactagaaaagcaagagcaaacacattcaaaagctagcagaaggcaagaaataactaaaatcagagcagaactgaaggaaatagagacacaaaaaacccttcaaaaaatcaatgaatccaggagctggttttttgaaaggatcaacaaaattgatagaccgctagcaagactaatagagaaaaaaagagagaagaatcaaatagacacaataaaaaatgataaaggggatatcaccaccgatcccacagaaatacaaactaccatcagagaatactacaaacacctctatgcaaataaactagaaaatctagaagaaatggataaattccttgacacatacactctcccaagactaaaccaggaagcagttgaatctctgaatagaccaataacaggatctgaaattgtggcaataatcaatagcttaccaaccaataagagtccaggaccagatggattcacagccgacttctaccagaggtacaaggaggaactggtaccattccttctgaaactattccaatcaatagaaaaagagggaatcctccctaactcattttatgaggccagcatcattctgataccaaagccgggccgagacacaaccaaaaaagcgaattttagaccaatatccttgatgaacattgatgcaaaaatcctcaataaaatactggcaaactgaatccagcagcacatcaaaaagcttatccaccatgatcaagtgggcttcatccctgggatgcaaggctggttcaatataagcaaatcaataaatgtaatccagcatataaacagaaccaaagacaaaaaccacgattatctcaatagatgcagaaaaggcctttgacaaaattcaacagcccttcatgctaaaaactctcaataaattaggtattgatgggacatatttcaaaataatatgagctatctatgacaaaccgacagccaatatcatactgaatgggcaaaaactggaagcattccctctgaaaatgggcacaagacagggatgccctctctcaccactcctattcaacatagtgttggaagttctggccagggcaattaggcaggagaaggaaataaagggtattcaattaggaaaagaggaagtcaaattgtccctgtttgcagacgacatgattgtatatctagaaaaccccatagtctcagcccaaaatctccttaagctgataagcaacttcagcaaagtctcaggatacaaaatcaatgtacaaaattcacaagcattcttatacaccaacaacagacaaacagagagccaaatcattagtgaactcccactcacaattgcttcaaagagaataaaatacctaggaatccaacttacaagggatgtgaaggacctcttcaaagagaacgacaaaccactgctcaacgacataaaagaggatacaaacaaatggaagaatattccatgctcatgggtaggaagaatcaatatcgtgaaaatggccatactgcctaaggtcatttacagattcaatgccatccccatcaagctaccaatgactttcttcacagaattggaaaaaactactttaaagttcatatggaaccaaaaaagagcccgcatctccaagtcaatcctaagccaaaagaacaaagctggaggcatcacactacctgacttcaaactatactacaaggctacagtaaccaaaacagcatggtactggtaccaaaacagagatatagatcaatggaacagaacagagccctcagaaataacactgcatatctacaactatctgatctttgaaaaacctgagaaaaacaagcaatggggaaaggattgcctatttaataaatggtgctgggaaaactggctagccatatgtagaaagctgaaactagatcccttccttacaccttatacaaaaatcaattcaagatggattaaagacttaaacgttagacctaaaaccataaaaaccctagaagaaaacctaggcattaccattcaggacataggcatgggcaaggacttcatgtctaaaacaccaaaagcaatggcaacaaagacaaaattgacaaatgggatctaattaaactgaagagcttctgcacagcaaaagaaattaccatcagagtgaacaggcaacctacaaaatgggagaaaattttcacaacctactcatctgacaaagggctaatatccagaatctacaatgaactccaacaaatttacaagaaaaaaacaaacaaccccatcaaaaagtgggcaaaggacatgaacagacacttcttaaaagaagacatttatgcagccaacagacacatgaaaaaatgctcatcatcactggccatcagagaaatgcaaatcaaaaccacaatgagataccatctcacaccagttagaatggcgatcattaaaaagtcagaaaacgacaggtgctggagaggatgtggagaaataggaacacttttacactgttggtgcgactgtaaactagttcaaccattgtggaagtcagtgtggcgattcctcagggatctagaactagaaataccatttgacccagccatcccattactgggtatatacccaaaggactataaatcatgctgctataaagacacatgcacatgtatgtttattgcggcattattcacaatagcaaagacttggaaccaacccaaatgtccaaaatgatagactggattaagaaaatgtggcacatatacaccatggaatactatgcagccataaaaaataatgagttcatgtcctttgtagggacatggatgaagctggaaaccatcattctcagcaaactatcgcaaggacaaaaaaccaaacaccacgtattctcactcatatgtgggaattgaacaatgagatcacatggacacaggaaggggaacatcacactctggggactgtggtggggtggggggaggggggagggatagcattgggagatatacctaatgctagatgacgagttagtgggtgcagcacaccagcatggcacatgtatatgtatgtaactaagctgcacaatgtgcacatgtaccctaaaacttaaagtataataaaaataaaaatagaataaaaccaaaaaaaaaaaacaatgggtctgttgaacccatttttcactatgatctagctgatttcgttctacttaagggttttctgctgccatttttgttaggtcttttctcttgagtaagacatattccctacagaagattcatacattttcctgctcggatgaaacttggctgcctgggttctgctgtagatctcaataagaggggagagtcaggcagggtgaagtgtttcagcgtttagtatgcatattcctcctttcagttttgtattcctatcctgtgtccacgtgtcctccaggccagagaacctgttttatcctctttggggaataaagttcttcttttctagtagggggagtgaagagtagtagccttattttgaagaacaggaaaagcaacacagaagtctaactgttcaagagactccaaactacttttatggtatttagccataatttcatctcttttggcaaaagtccctggtgggacaaatcttaaattttacaaaagagtatcgtaatgaacactggggggctttttaactttctgcactgtcattttagcagaaagaaagaaagaaaaaagctgaatcttacttacctagtttccagcttcaaaaatgtttcatttgtgatctttcaattttgcttttgagctcgtgtgtgtgtttaattactcttactggtctattgcatccttagaagtggtattcccaaaaaaagaatctatataaataaaaacctatttgatgatgatttgaataggaaaccatgccccaaataaagagatttagagaaaaaagtagtatatttgccaaatctcttaagtaaccatgctttggtttcttatttattgaaagaaaagttcaggtccactattaaatataagaattgataataatgactaggatgtttacttcttcaggatgcatatacattcaatttgcaatcaaataaattctaaaaactgtcatcaagtaaatattcagacactgtcagcactttattggaagagttgtgagtatttgatcttgcagattactaatactctccagagagggacttttcatgttttcagttttcaatttacaactgtgggtcaaagtcaacaccttttgtgtcttcatctgaaaatgtctcagatctttattctgaaatgtcttcaaattgctgcttgagaatatatgtcccatttcacccaggagaatgtttccctctgttagaaacaatgcattttgttttgtctctctccagtggcctcatgtatagaatttcaaacataataggtcattgcacatgcattttattgcctgtaagtcttacagcttgtagtatgctcttccaacctcaggttccaagatcctacagtacatggccactgacggcctttggtatatgactgtgtaataatggaatctattttcttgaccaaacactgtgtaatagcttttattattttctttcaacccatgtaacttacataagaaatacaatcaaaattctctttttttcacaagttacaaagtttttatgtcagtcttgtgtccttttctccatttttctgttaaattttttttgttctgtacaagattgtccttttatgtttgccagtatttaagttgtttgggggaaatatttatatctccaggatgtttttcatttcaagaaaagtttagtgtacctcaactggatctgaggctggaatctaggaaaaacagagaataatccagggacttactttcaccagcttaaaaatactataaaatcatcctctctattctccaacatctgtacatagagtagaggaacagcaaggagcactgggaaaagcctgtgtagccacatgcagcctcctactcaaagctgcctttggtcttcttctctgtatctcccaagttaagcagcttatatttaggaggaaaaaaaaaaaaaaaagaaaaatgaaagatgatctgctcaccactgattacgttaccaatacttctcatcttttgggtactgtgaggattaatagtatgtatctgtatagctggcccacattgcccagataatctggctaagcattattctggatgtttctgaaagggtgattttgggtaagattacatttaaatcagcagatttgggtaaagtaagttgctccccataatgtgggtgtgcctcatctaatcagttgaaggattaggaaaaatctggtcttgatctttctgaacaagagaaattcttcaggctatcagccttcagacttgaactttagcattagctctttcttgggtctccagcctgccaacccactttgcacattttaaacatgtcagcctctataactgaataaggcaatccttaagtcatcttctatatacgtatacacatcctattgattgtcttttttctaaagaattatgactaatataaagactagcaggcattatttgggtgtgattatatatatatttgagtctttatgccacactgtttggcgtttttattttttacaattttatttatttatatatttttttgagacagggtctcactctgtcacccaggttggagtgcattggtgcaatcttggctcactgcatcttccacctccccagctcaagcgatcctctcacctcaacctcccaagtagctggaaccacaggtgcacaccaccatgcttggctaatttgtgtgtgtgtgtgtttttggtagagatggggtttctccaagttgctcaggctggtctcgaactcctgagctcaagtgatccacctgctatggcttcccaaagtgccgggattacaggtataagccaccacacctggcctcattcttcttcttaaacatataagttttgtgtaaaatacacaacgaagaggacacagtattgtgtttttccaaacaaaattgccagctcttctgttgaaattaaagtggcaagtgaggaaagaaggagggaggagtacatgatacgatacttatcagtacccttatgtttttgtaactcctaccactaattttctcttaccatatgcactctgccacactccttatttcccaggctccctttagaatgcccaaccaccctatagaaaatgagtacgaactctgaagacatcattggatagagttaccgttaaaaaaaattcactcaatgttattcagagtcattttcaaagaaacagctctggccactaggagatacgaacctgagtatcatagggaatctgtggattaaaacagattacttatagtagtaagcaaaataaagtgtaggagaacctctgatagttactttttaaatttacctcaggagatttgtccctgtttctataattagtttataaagaaccttatatttattttaaatattttatatctatgctacttatacatcagtaattggtttaatagatttatatataatataatgtgtttatatattatatataaatgtattatatatgtataatatatataaattatatataaatgtattatatatgtataatatatataaattatatataaatgtattatatatgtataatatatataaattatatataaatgtattatatataattttgtgtgtgtgtgtgtatatatatatatatatatatatatatatataaaaaatatgctactagaactgaaaaagacagtagagaaggctgaaggatttaagcttcacactcctacagacatacctttacacagtgaggatgaagcactgcacacagatctgtggtgtaccaatatgcacttaatgagcactccagctctctgcttttcaatttgtactcgctgaacttctattttttaaactgaaaacaaacaaaaacactgtcatccttttttcttgatgtatctgcaatagccactttgaactcctctggtaccttatcaaataaccccatacagtgggcagtctgcagagattgcagggaactacaagaagggtccacataatatggtgtgttacagttactaaaaatgctctgctaatgaaccaagctaagatgattggtctcctcgttcatagaacttttcagtttttcaggaaatagaaggtctacttttttctgaagaattacaagtaaggaacgatgattattagagattagaaagcattgttctttttttcctctattggtgaattattctcagtgagctaaggctttcctgaccgccagtttcacaactctcccacataaccatctctaatctctcatgtataaagtcaaaatgaatgttttccaagaattcaatattcttcaacaggaaataagcaatgtgcatttactttcaaaaaaaaaaaaaaaaaacagaaaaaacaaaaaattggtccccattaagcaaatttcaccaggaaagtatatgtttccttcacagagttataggaaaataaatttctacaaagctttcctgtgtcatgctaaaagggttagtgatgaggatataaggtttacaatgttaaagctgcaaaggaatgtgtctttatgatgaggtgagcctctttctgatgttgtaaaggtggttgaaatacctcactctcccatttttctgacagattttatattttaaaagctttggacaggatagacacaaatagcttttactgcattttacatatagttaccacatttaatcattacaaaaactgtttgaataaaacttatttatttatttgtgtatttatttatttatttattttgggatggagtctctctctgtcacccaggctgcagtgcagtggcacaatctcggctcactgcaaactccatctcccgggttcaagcgattatcctgcctcagcctcccaagtagtggggacaacaggcgcatgcgaccacgccctgctaatttttgtatttttagtagagatggggtttcaccatgttggccgggctggtctcaaattcctgacctcaagtgatccacccaccttggcctcccaaagtgctggaattataggcctgaaccacatgcctggcctgaataaaacttgttattttcattttatagatgagggaactaactttcagtgaggttaaatattttgatcaaaacctcagaactaataaagggaagagccaggaattaaatccagatctatcactgtctacttttttatactatctcctctctgggaatatcaataaattaaaatcgggtacttacagaattctcaattgtaacgacaaatctagaatatcagggtttctgtacttagtgaccagaagtcatacagctttctatttacgtctaagttcaaaacatattctggacaataaaagaataatcctctctaaagacaaattttggcaaggaaaaatgcagtccaatttgcttgcattataaaaatagaaacacatgtaatctcaaattaactgtctttgttttctgcagttctatgcaaatgcaaatatgcaaaagaacaaatgcttgatagaaaaaaatgtacatgttggcagttcattatccttgtgtttttcttaattgatgagtgctttctctgttgaaactcttaagatcgctcagattccctggcataagtcctcatgaaaaatcatctaaatgatatctttgtggagactatgatgctcaatcagacattttggctaacatactaggctgctgatctgacattcagtgcccagaatcgcggctgctgagccaagtaaaccacctcctgagttgtttctggtccaatctgtggtatctctgccaacgggttttctagatagttagacccctcctacctatgcataacaatgagctagcatgctagcaaagtcccaatttttataaatgtagtgatgcatcctacagatacataaagtcactgataatcagaccaatgtctgcacatacgtgtttaaatcaattacaatgacaaatagatgctttatgagaccatgactattcagaaccttattttagacacttaacacattggtaaccatcacagaaacaatgaaaaagaattgtggggaaaagtaaaataacaaaataattatcttttgctgatttaatatcatatggaacaatagtcttttacatagaaagaaaatatgattatattattgaagcatcctgcactttcaaaatgtaatcaatcattataggtagtctcctaagattagagtcatacataagaaatcataaggaaatctagatctgcaaaagtagatgaaccgggagtagataattctaaataaaccaattgtgcttttttaaaataaataatccagtttacttgagtcacttcaccagacttacaggcaccaaccctacctctatcttagattacagttacaactaaccaagttcttgtctcctcaacctcctccaatttgcctttcatacagcaagcagaggaatctactaagagcactgttgtagttgcgttactaccctgccttaaagcatttatgctcctcctcctttcaccactgctgtcacacatgctgtatgcccaaattctttatcttgaatcttagggctccaatgtgcttttcaagaattttcttttctctgtttataacattagacctatgcttgcaccaataaacctgcactgtttaatgcaattgttaccggcgatgtgtgtcactttacacttaaatcagataaaattaaaaattcagttcctctactgcactagccacatttcgagtcttcaatagtcacttgtgactagtggctacggtattggacagtgccgattatacatcattgcagagttctatggcacagcactgctgcatacctgccctgaggttctatggtatgaagctgtctgcaagttctgatacatgttattcccttaaagtagaaatgctcttgcttcctgtacacccctccaaatttacaaactgaaattccatcacccttcaaagtgtaggctacttttcatattttctattccctccacccgtatatattccatttagaaatgatctccaacacttctgaaatttttttgagtttaatttataatattcacatgtaaaatctcatactgctgctttaaactatcaaaaaataggaatatatataagtctcactctgtcgcccaggctggagtgcagtggcgccatctcagctcattacaagctccgcctcctgggttcatgccattctcctgcctcagcctcccaagtagctgggactacaggcgcctgccaccacgcccgggtaattttttgtactttttagtagagacggggtttcaccatgttagccaggatgatctcgatctgacctcgtgatacccctgcctcagcctcccaaagtgctgggattgtaggcgtgaggcatcatgcctgataaggaaaaattatttttatttttttttttttacagacatctagagacagagagaaggagagatctaggcaaaagaattatttttttgagacggagtctcgctctgtcgcccaggctggagtgcagtgtcgcgatctctgctcactgcaagctctgccttccgggttcatgccattctcctgcctcagcctcctgagtagctgggactacaggcgcccaccaccacgcccacctaattttttttgtattttttagtagagacggggtttcaccatgttagccaggatggtctcgatctcctgacctcgtgatccacccgcctcggcctcccaaagtgctgggattacaggcgtgagccactgtgacgagcccaaaaggattattttcttgctaacttggggaaaggtgaaaggctatatagctttgtcttctcagacactcttggggctttacactcaatagctgtatatctatatatctatatctgtatattaaaaatatgaacatataatccaccattttgtgaaactttttttcatttaccaggagaaaactgaggaccagcgaagtggcctgcagaagtaacaaactccttaacaagtgctatggcaccagctcatcagaatggacactggctttaatggtattaactgagtcctaaaggccctcttctccttatttcctgaatattgggaagatccaaaggtttctgcaacaaaggggacaaccaagtaaatggtggaggaggatcttttaggggctcgtggctgaagccactttgtctaccagaatggcaccatttcaatattttgtcaatgaatatagctacacctatgcttattaaacaagtctggtgacataattgtcccaagttcatacagtcagtagaatttgccatcaaacaactttaaaacaacttttcaggaatataactactatgccacatgaaatacccaccttctgggatattgaagcaaaagcttttcaactgctaaataggcacatgatctttataccattggtataatgtcacgtacatttgtgtgcagattaccacatccctgaaaactgctccctcagatgttgtgtatggggtaattgatgctttaggcctaaaaatctaaataagctgacacttttattttcagaagtgcctgcaaggggtgcaattcaaaaaaattacatttcaacctggctgattggctaataaaatgaaagtagtttgtaacaaataaacaagtaaaggatatggcatgctttgcactgcttttaacataaatgagtaaaatcacatcatttctttcaataaaaacatcttgtgcctaaaataaaatgcctgatgttgatactgaaatggtatgctttcatctaaaatatttttgatagctcgttgttgccaacacttaaaacaaaaagttgctaacttctttaaagtggccaactacagtagtgcaaaaccaatagttgatatgatattatttttagccttcatcttcagctttaagtaatgttcagtaaatgcaacattacttccttattgatatttatccatgactccacacagaaaacaataaacaaataaaccttattcataaggctgtctatataccagtggtcattttatagtcagaatttttttgcatttaaaaaggcagctattatgttggtgaggatgcagagaaaagggaatgcttatacactgctggtggcaatgcaaattagttcaacttctgtggaaaacagtagaaaatttctcaaagaattaaaaatagaactaactaccatttgacccagcaataccaccattggctatttacccaaaggaaaagaaattgttttatcaaaaagacacctagcactcaatatgtttatcatagcactagtcacattagcaaaggcacagaatcaacctaagggtccatcaacagtgggctggattaaacaaaaagtggtacatatacactgtgaaataatatgcagccatagaaaaaaacaaaatcatgccttttgcagtaacatggatggagctacagatcattatcctaagtgaaataactcagaaacaggcaatcaaatattacatgctcttacttataagtggaagttaagcaatgtgtacacatggacataaagatgtaaataatagacactggggactccaaaagtgaagaggatgggagagaggcaagggttgaaaaactaccttttcggtactatgttcctatttgggtgacgggttcattagaagcacaaacctcagcattatacaatatacttatggaacgaacctgcacatgtacttcctgaatctaaaataaataaataaataaataaataaataaatttataaggagctgttaaatacttctagattcaaagcatggaaggcttttctttcctcttccctcctcatgcagttcttactctgactctactcactgctattttacagtcagttcgaacaagcaaagctgacttcccatcccacaaaataaaagattcagcaaatcaccagggagtgagaaattcctatagaccagccagtgaaaacaaatagcagggaactgaagtaggtgtgacatcagcaaggtggcagaataagagttttctactctcatctccccacagtgaacaaattctgataaccacccatggatgacagtacctttgtggaagtgtgggagtcaggtggagaagttctagtttgccactggagcaaaaaaatctgaaaacagacaaagagaaaaaaacaaataccatatgttctcacttacaagtgggagctcactgatgagaacacatggattctgggagaggaacaacagacacgggggtctacttgtgggtagagggtggggtgagggagaggatgagaaaaaacaactatttggtactaggcttagtacctggatgacaatctaacctgtacaacaaaccccatgacactagtttacctatattataacaatcccacacatgtattgctgaacctaaaagaaagaaacattttttgaaagttcccaaacagtttcaacccaaagggaacttcaccaagacactttataatgaaattgtcaaaaatcaaagacaagagaattttaaaagcagcaagagaaaaaagacttgtcacatataagaaacatgccataaaattatcagcagattaataacagaaaccttgcaggtcaggagagtgtggaaatatatattgaaaatgctgaaagaaaaaataaaaacttcctctgaaggatgctttatcagacaaactgtccttcagaaataaagatggataaaaacttacctagataaactaaatttgaacgagttcatcaaaactagatctgccttggaaaaaatgctagactgttcttcaacttaaaatgaaggatgctaattagtaatataataacagaggaaagtataaaactcacgagtaaaggttggtatatattaaaattcagaatactcaacactcccaataaaaagtgggcaaaggactgtaatagaaattttttcaatgaatacatataaaggcaacaagtgtatgaaaacattctaagtattgcttatcatcaggtaaatgcaaatcaaaccgcaatgagatatcacctcccatctattagaatggctattatcagaaagatgaaaaataacaagagtgtttatgtaaatgtactgaaaaagtaaactttgtacactgttggtgggaaagtaaattagtactgccattatagaaaacagtatggaggttcctgaaaaaattaaaaatacacttccgtatgatccagcaatcccacttctgggtatacagccaaaggaaatgaaatcagtatcttgaagagatagttgtactctcctgttcattgtagtgtgattcgtaacagccaagatctagaaataacataaattcctagacataaacaaatggataaagaaaaggtgatatatatatgatggaatattattcagccttcaacaatagggaaattccttcattagtgacaacatagatgacctagaggacattttgtttaacagagaagccagacacagaaagacaaatattgtatatcacttatgcatgaaacttgaaaaagtcaaaatcatagaaacagagtataatgatggttaccaggggctggggggtagaacaaatggggggatattggtcaaagggtacaaactttcagttacgaaatgaataatttcaggagatctaacatacagcatggttactatagttaacaatatctatgataattgtataaataaaatttattaagagtatatctactatctgaagtattctcaccagacaaaaaaggtaactatgtgaggtaacagctaagtcaataagcttgattgtggtaatcatttcacaatatatgcatgtatttaataatcaacattgtataccttaaatatttataatttttatttggcaaaaaataaagctggaaaaaagacataaatacaataataaacataaaattgaagtagtgatcaacattttcaaacaataaagaaaatagaaaacagcagtgatagttaataaactgacgggaagggtgaagattaaccaagggaaggctacatattcagagaaaacaaatatttttaaaacagacatatgtggccaaaaaattctaaatattttgatagttcctgtgggcatcactgacatatagtacaacataatgatagatacaatgtcatataataattgacattacttacttaccatttctcataactgaacaaacaggaaatggtttagataatttctaccacgtcacggctattatgaaagtttgtctatatgacatgttaacatttgtttttctcaaatatattaataaagaattggacattgcaacccatacattagtattaaatagagctacagtatgagaaagaacaaagcattcaggaacaaagatggattaaaaaaattaaaggagagttttcttctcctttatctgtctatgcgataaaaaaattttacttgggggaaatttattttggtattttaaattttctttctggatatttgtttgttagttttcaagtactatcagaagcatataacttttaagaataaagccaaggtcactgaaacagtttgcaaaaaaaaaaacaccgtgtgattgactatctacttggggagcagcatctgtttttgttgtgggaattctctgccttgcacataactacaaaactctatctactacccatgtcttttttggatttagcattaacaattggtcaaacagtagaacaaaaattttaaaacactcttcagttgtttttcaccccataaatccagactttcttctctattgtgctatttctcagaaaggttgcataggttacttctaagtagacatgcattgtattcactatcaagtagcctacaatgtgcttaaaaacatccacacttttaaattgtaacaacaaatcaagaaaaaacttctactgatattcaactgaaaaaaaaagaataagaaaaataaatttaaaatgagaaagtaaacaggaaaaaattacagattcctaaatcaagaaaaatcagaatgtatcattaaaacgttagaagaataaaggagatgagatccatgatgtagactgagcagcttagaagaaagaagctgaataaatctaaggtatcttaaaaaaatactttcatggctgcttatgacttggaatattttcttcttggctgggggaaaatgcatttttaaagccttatatgtaaaccagaacagtcaatttcctaagaactactgatagaaaataaaagtataagtagtctttcagaggcttgtacttctaaagtaaagagcttgtaagtttagtaacatatacatgtttaattactggtattccatatgcagggttggctgctattactaaaacactctgtacagagatttgctaagatgaaagcacacataataattatcgttatcacatgctgagtgccctcttacaccacacttcacagacattctctctaattcataaaacaatcctgtaaaataggaattatcattagtcccattatataaattaagaaactgagactcagagaagttaaataacttgcatatgattatgcagttaagtgatggattgaagatttaaatccacttcttttgtatggcttttaatacttgactccatatgaattggttttttgcataggcagacattttaaaatgtcctagtttatttactatgggcttacctcatcatcattcataaaatatttttaactgtctattttttaatggacattgttctatatgttgagaatacagcagcaattaagacaatgttccgaacatcatggaccagaaaattagctattactcacagaggaacagatcggcaaattgaccagggtcagctaatttgttcccaaactttgttttatttttaactttttgctttgggcaggaaactataagatagagtataacatgaggcttcagcatgcaggattgccataaccacagtggtcctcacatgtgacttgaaaattacatgaaaaatatgaatgatagactgactctacaccgtgctgtcacctggatataaactctgttcttggcatgtaagtccctccttcagccctgacatttctccaggaaattctttttttctccagatttatgatgctgtgttctctcttcccctcttcataactcttaaattccacaaggcaactatctaattaattcatattttataacacaaatgacttaacactatccttggattatatctctctggacagtacttattttatcaaatggaattgatttataatggattggatttagagataacatattgaggcatgaagatttcctatctcctttattctgcttagatacgactggcatgtacaaagttactcttccatagctaactttcaagaaaggcagggtcacaccacttgagaacatccaatacttgacattattttttgaaatccagtacaaactgatctgtgaagcataacaacaaggccgctcttcatggtctgctcttgtcctaaagcacaagcaattggtgtgatgacctcaataagttatataaaatccacctgcagccagaaaaatttgaaattgaaggatttaaggggaaatggagacatcttcctttcagcgctcttgaatagcaaaatgtcccgtgattcattcatccttttatgtgaaggggtctgacagtgactttagtccaacagcttccagacaactactccgcgtatattagactcatatctgaatacttagtgcaataattgaattccaataacctctgcaagctaaatatattgcctttattcaaggaacactagaaattcactgtaacagtgccctttggagttcataatttgagatgtccttcaaagtaagattgctttataaagatgccattttactgcctaagtaactaaaccttcctggccatgaaccaagacagagtcatggcatttaatcttattatgcatattccacagcttcatatacacaaaggtgtattctgtggcaagtttttcaatatctattggcaaaatatttgcagaaatttatttttctatttctaggaactaactggattgattctgtttcaagtgaaagaaccaaggacacacagtaaaagctgaaggcaatcttgaatttgaaattaaatctgaactttatgtcagtcacataagtaaagagaaggtttcagcaattatttaatacacttatccggttcagaaaataatccagattattgaagtatacatgaaatttccttcagctttgctattttttctgtaccaagtgaaatctttacatgtatacactaattgcatatttaattataattccacttcatcttagcaactttaaattaaatgcaaagaccctaaagttggctacagagtagagctgtgccacctcaaaactccattcaaccacacaataaattcctgtaattatgtttttaattaaacaaaaattccctgaattttacaggaatctgtcaacattcacatcaaaatgtactgcaggaacatgactattttcccgaacactatatagtattaaatgtcataggccttatactttcaagtctttttgtcacattacagttttctgctaggagctaaaatggtatatgagctggttttatagccagaaatagtcgtggcaaggttatattttttgatattttattatttgttgttctcaagagtaataagcaattcctacttatatttgggaagtcagaaaacagatgaaccacttacctgacaaattaaatgtgaaaataaagaatagactgcaaatcttttaaacactcatattttgatgttaaaatattgcataaacaacaacttttcattaaaaaacaagaaatgcacagtatagaagaaaaactaagaaaaaagattaaatttagatgagaggcagtcagctataatatccaaatttctaaattttaaaaaatgacaatataaaaattaaactggctatcttcacattaacaatggctcccatgattcactgatacttgatgaaatactgatctttatatacaaatcagacatcgaaagaatgtaatgtaactttcactacagacttctaagcctaatctatgagtatgaatgtgtgcttgttagcatgtgagtgtgtgtgagaaactgaaaaatagttactaagactcaactgtggatgcacttcaaagcacctactccccaaaattgtgtgttaaatttaacatttgcaataattgaattccagtaacacctttggatctgaaaacaggtaaacagttttcatcagatcctgaagggaatttgtcacccacccaaagtgttagaaaccacttcaaatctcagccatttgtttccatacagtcactgtttagtgtgtcattccatcttgtaagagagctactagtcttgcaggttgagatctaatgttgtctatgacactaatgttgttttgtgcttccacagtagctgctctttatgtttttagtacatagttattgaagccaaaactgatggtgcaggggagaactggatgaaagagcacatttccgggagattactatgaagaggactctatattttttccattattattatttttttcaggtgaatatttgaaagctattcactgtaaccccgcattcacagattttaagattttaggaaatggtaacacaaattctcagaatgttccctgagaaatatctgaaatcaatctgcacaaggaatcaaaacatccaaattcaaatcccagcttcatctctagttgagggacataaggcaattcactcaacattctgggcttctcactctcattttaaaaagaaagtggtttgttccatgatctttaaaccctgtttttcaaatttaaaatgcattgcagtactattcacaatagcaaagtcagggaatcaagctagatgctcatcaatggtggactggataaagaaatgtgatacaaatacatgatggaatactactatgcagcttttaaaagaacaaaattatgtcctttgcaataacctggatgcagctggagaacataatccttcatgaaccgatgcagaaataaaaatcaaacaccaggccaggcgtggtggctcacgcctgtaatcccagcactttgggaggccgaggcaggtggatcatgaggtcacgagttcaagaccagcctggccaagatggtgaaaccccatctctaagaatacaaaaattagcctgcgcagtggcgggcgcctgtaatcccagctacttggggaggctgaggcaggagaattgcttgaacctcggcggcagaggttgcagtgagccaagattgtgccactgcactccagcccgggtgacagacagactccgtctcaaaaaaaaaaacaacaaaaaaaacaaaaaacaacacaaaaaaaaccacgttttcactcataagagggagctaaaaattgagtacacatggacataaagatgagaacataaacactgagtacacacagacatagacactggggagtttcgaagagaggaggtgggggcaagggttgaaaaactaacttttgtatactatgcccgctacctgggtgacaggaccactcatacaccagacctcagcaatatacaatttacccatataacaaacctgcatacacaatacacctgaaactaaaataaaaattgaaaaaacaattacagaaatcttaagaatacaaatacgtcttattttggatagataagataggaaactacatttttagaattatcttctgtaccatttgcatggaacatcccaggtctcctaacacacattaatttggatgaagcattttgtatatattataaaattaatgactaaaacacactaaaatgaaagagtatataattatcctcttagccttgaaatacacacacacacacacacacacacatacatatccccccacacagggacagacatagacatgcagatcctcctctacttacaatggggttatgtactgataaatcgattgtaagttgaaaatattgtaagtcaaaatagattaaatacacctgaactcccaaacatcaaagcttagcttagcctaccttaaatgtgcttagaacacttatattagcctacatttgggcaaaatcatttggcaacactgtacgctcatagagtctcaattattcacccttgtgattgcatggctgaccggaagctgcagcttgctaatgccgcacagcatcacaaaagaatgttcaactacgtatcattagacagaggaaagatcaaaattcaaaaatttgaagtatagtttctgctaaatgcattatcacttttgcaccatggtaaactaaaaaaatcacaaatagaaccttcataagccaaggattgcgtgtgtgtgtgtgcgtattcttcaagcgcataacataaatactaatttacaagtaatgtaattttgaataaagatcatgtacaaaacaaactaatgaaagctttgccattatgcagatattccggaataactgaatgcagatattacttaaataatcagacacaaaattagggtataacttgagaataattcttatgataattaataatagtcatacattcccatagtttttaggatttttttgaagcattgtcacatacatcattgtttaaaacatcacaagaatacttcatagtagatattgctatttttttccataggttattggggtgcaagaggtacttgattacatgagtatgttcttcagttgggatctgtgagattttggtgtacccttaacagataagaaaaataagcataaattcttttcaaatgatatttcaagctcacccaaaatagtagagttaagataagaagtggagtcccatgacttcttctaatatttaagaactgcaaaattttttaaatcgcttttgcaaaaattgtaacagtgagaaaattatgatggtgacagagatctgacttaaacaactccatcttgcctttaacccccaaactgcccctggtcattcctgggcttgggccaagctaactttgggagaatttcagtttatagtttaaattttaatagcctttccccaaattaaattgcctttataaaataaaacgccacaaatttagggttatgagacgggcctgaattttgctaaaatgtaggagtatttaaatgattattagctcttgttccagaggtcataagatttgtaacgtccctagtcactcctttaagtaacatcactattatagaatctaagattgatcttttgagttgtcttttcagacttttgcatttctgaaaccagatgacttcactggatgactccactgagacccaagactcaagacccgaccagtcctgtggccctcacgtgtaagtggattcagcccacgagtaccattttccacacccttatgattgcattccccaaccaatcagcagcaaccattccctaacccactgtccacaacactatctttaaaaaaccctagcattcaaatttgcatggaggctaatttgaataataaactccagtctcccatttagcaggctctatgtgtattgaattctttctctattgcaattcccctgtcttgataaattggttctatctgggcagcaggcaagatgaaacttttgggtggttatattttcatgattagaagatcttgcacacagataaacagcaaaatttcaagtcaagataaaataggtgcaatacgcattcatttcttcaaagtgaaactgtataaataaatgccaagtagcacaaggcaatatggagccaatgattatcaagtttttattcttgaggaattaataatcttactgggaagacaaactgtgagcagattttcacccagcagctatgggaacacaaagaaatggaagctttttctgaatggaaaatctgattcaggcttcctagagaaagtgacagcatatgggagaaacaaaggctctcttctgatgatggagaaaaaggaattcctggcagtagaaatagcaggcaatggtgcaggaaagtactttggggcagagtacattcagaaggtgctgaaactttgatgtagctataatgagatattaatggaaggtaatgatgcaagatggggcttaaaagggtaatttatacatgatgaagaagggtcttgctgccaggctaagggttttaaaccacattccaaaggggaagagtgccaaaagcataaagactaattctgaaatggctctagactgctgcatggagttgaggtggggaggtgggtaatggggtggcagatccagattcagattgcctgtgtgtctcagcagctgtcattcattctctagccagatttaggtaacagattaaatttatccaattaatctttgcctgtagatttttaaatttcagactatgcgcattgtgcaatagcttcataaagattaacaattatttaatgatattatagaaagttctttattttatactgtataattattaattattaatcagaaataagacgtctcttacaagactcaatttataacatggtagtttgtgttaccaggaaaaacagtttccttgctgttaaacaagtccatgtttctaattttaacttaaattagaaaaatatccttcttttattggtcattatagttataaattctgctaaaaccaaccacttcactctacgtacaaagatcaagctttgccttccctaggtttttggtgaatgctaattaacattcctcagtataaccttaactgtgacttgctagttagccctgaaggacaacattctattttaagaaaaatatgtataaattcatggttggtttaaatgcagatgtagcctgttcttgaaagttagtaaaataggttaagcttaggttgttaccccagtcatggtattgcactaaaaactccagggatgccatcacataaatgcatggtagaaataatggatttaagataagatagaataaagatcgtaagatttatttttgtaagatgtaattatttgaaaatcaatatttaaatcataagagctcttttttttttgtttctacagctacacagtatgtgtgaggttcaatctgactatccatcctttatggaaatgctacattacacattaactcaaaggctgagaatccattaagtcaaggtgagaatcctgagaattagcatcatcaattgtgagttttcttttcccttattctaggcctccacgtgaggctttcactattgtccttagtctcttagcccatgataaaaatatatattttataggaatggtttaaggagatgcctttctgagggaggggtaatgacagaaaagtacatccattttttattagtattaaggaaaccgtattggtcattcatcactgacaaaacaatactttgttgctggctgtctattatactaaactgtgaatccatgaaaataaatttctgaaaataataaaaaacatataaaagtcaaatttgagcagtgatggaagtagggtggaagtacaatttagcaagagtctgaagatttttaataattgtgttattttgcatgaaatattatatgattttgctcaagccactggcttaatatattttaatgaatcaaataatgacaaaaacataagggctgccaaactgagaggcaatatataacaataaaattagtggatctggctcttcactgttggctatattctaggcccatttcaacattcagatttagctgaattatttggattccctaatattccttttccagaaataatgatgaattggcttaggggagataagaagaatggtatagcgggagaacaacagtcaagaatcaccattcatactcctgtcaagaatcaatcagttttcttagctagagagggaagcacgagagcacattacatatttgatcatgcattacccaaaaaccatttgtgaagttgggcaggctgtcaacattactcaaatgcactttgggcttttcgagctcaacttttattagatggatgtacatgtgaaaatccatggctttaattgctatagcaaaagaagcagtgcagaatgtgtgtatgtctttgagccacaggaatagaatcctcttcaaaccttgtttcttcactggtatgtccctagtaattggagagatgggtcttgggctaggctaggtggaatatcatataccagtacagaatgcaatccttcaaacattaggacagctaatgtataaatccaaaacttgtataattttagtgtcattagctataagaaaaagccactctctttacaattgtccagcagataacacatcaacaaaacatcatgaaactggccccagcacagtggttttaaggcaaaacacttaaagttacctttcagcaatgtcacaacttgaaaaatacacgcgattctctggtacgaatcacccttgcccatccccctccctcccactgaataaatatagtacaaatcagagatctctatggaaggatcatgctgattaatctatttcagctcttgaccacttgctgtttttggtataaaaatcacttctactgtggggaaaaaagtgacacattaactgtagaaatggaatgttgtatggttatactgtctgctaaatgcactgctaaatccactgagacgcacagcatggttaagggcaccagcactttggcattcaaacagtcctttattgaaggatacaggataagatatatttataatactctgtagatcaactttcaccaagctctgagcagcaataaaggaaaacaaatagggattttgaggaacaaactgagccacgactcactttgacactccaaatactggtatttttcacttagcagtagtgggtaagtattttcctggagtgacagttgaacctttaaaaaaataaacattttttcactgtaaacaaaataaattctggctgctccctagtcactttaaacagatgaataaatcaattcagtgggtgcatagggagagaaacgacagtaacatagtttctcccttcttaaaaactggaagaagatatattgaaggtgatgctatctaaccagtagtgggtaagaaggaagaaattcaggctgttgacattttctggtaagatcttgtaatgaactttagatgttttgctattttgttggttagagtccatctaatatattcctagaagtttcttacagtaagaaaacattgtgtgcatttgtgtgcctctgtgtgtgtgtgtgtgtttaatgcccaacaactgcatctctcacagctaaatttcattatgggagccaaaccagcctcccaaaggtaaaaatttataggagaaacttgaatacctgcagttacacaatgactgactgcactgtttcagctttttctaagtgtatagaaacttttaaaaatcaaatcatccactatgatgatttgatttttttaaaaaggaaaatccaaaggtctaaacccaagattcatgtaaataatatagtaaattgtgatatatatatagaatatatatatagaaagcaacatacagataagtctgaaaggaaaacttacccatgatcagtttaataatatgtcaattatttatgtcatttctcatataaatgccttatatgttcaaaaatagattcttgtgaatagatgctgattataatgtaaatatacataaacacacacacaagaatgcatctattctgctgagatatatttaaaggtttcttgtaatttcaactgatcaatggttttccttcttctgaatattaaataattttctaatgtaaagttacttctgaaaattaattttcataattcatatttattttagaaatgttaaagaagcattcattataagtgtgatatcatcactgtgctacttttcactattttattttttattaatgttagtctaatttttaatctctcaattacacaatgataaacacatgaacattatcttcatattggccctgttactaaggcttccagacactctatgtttgtgagacatgttctgtatttaatgattctgtcctaagtcctatattgagctcatcaggctaccttaaatatcctatattctgctttttattgataaattattttaaaatggctatttctcaaggtgcttaaatgactttgatgaaaacacaagctgaaaatcatgcttccacaagtaaatatctggataattccttatggtctctctagtagtttgagagaaaatcaaaaaggaggattgagaattaaaagtgtttttcatattcgagaaagaaaaagattattgtttgaccaaagactcaaatctgagataacttctaatcagttcgcaagctgtaaaattcagtcaatcaggacagtctcactccagtggccatgcttctgaaaatcagtcattcaacaatggcatcactccagtaaccgtgcttctgaaagttagcaagttagtaaaaatctcaaccttctgaaactcaacctaccagtgacagccacatgcttctacacaagagctgatcagcaaaggtctcactccggtgaccaggcttctgagatccagccatcaataagagctttaatccagtgaccactctaacatagctaaagtccattaatctctaaatactcctgcttctgaaaatccatcaattcttgaacagcagacttccaaaaacttcatatatcagttctgggttcactagggaagattttgccttacaaacgcagctctcctttacagtcaatgaaaagtttgcattagctgtcaagttaaattattattacttcaaacatttgcgaacctttttatggttgaaccttgtttatggttagttttgaattggacttgtgagtgaaaaacataccgatgctttgacttgagattatcatgtttaatctttttaactcctctagttgttagtattatctttttttaatttgtgtatatgtgtatacacaaattatacacagtataattctgtgataaatttttggaacagaggacaatcattaaatgagggaaaaatgcttttgaagttatttgttcagggtacaattgttcagtcaatataaaaaatgctgaaaagatgaaatagcacagaatatagctaaggaaaagagatatataattttctcaactagtaccaaagaaaagtgattaatattaaaactcagaagataaaataattacagcagaagttgtaatggctgtccactatttatatcattagtttcatagctccaatgactgaacatattgctgttataagcattttctgattccaaaattgcaaattttcaagtgtcaaaatgaaattgattgcaaaaattttttaaatgaaaaagttccatttactattatagagattataaaaatctaaatgtctcatctttttcataacgtagccacaatgcaagttatcatacttcagaaaaacatttccctttgattgtgtaatattgttttcatgaaaaggcttgcttagccataaggctactgtaagcaaaactgtttctgataaaacttcagaaataatagcaattttttcagaaatgctcttattcaaattgaagttaataaagaaaaaaatttttcttttatgaattgatggacatactacaaataaacattttggtggatatttatctgaaggtacaaacaatatttattaaatgattaagcaaaatatgaatgattctataaaagatgttggctgttctgcccatattctacataatgctgctaaaacagtagttgatgctgacatggtttgaaaacatcccccaaagttcatgtttttgaaacttaatccccaatgcagcagtatcaaaagttttaaataactttaaaaggttattaggtcatgaaggttcttccctattgaatggattaacatcattatcaatcacacattggtgagagatcatggaagtgggctcttgatagaaaggatggatttggccagatttcaattctttctagtacacccatgtgccttccaccaggggatgctccttgccagattccattgccatgctgttggacttcccagtctccagaaccatgagtcagataagtttctattatttacataaattaccccatttttggtgttttgttacagtagcgaaaaacagatttagacacatgcccttctcattcacactgaagtaattttgataaacttttttcttactttagtatttatactgttcacactgagcaattaaaatatttttgttattctgtttacattcagtattgttcaattctttcacattcaaaaacctgttggctctctttaacaaatgtacttgagagcatctcattttatttgaagcactaaaatcatactttaattctaaacaaaaatgccccccaaattcctattaacactttgtataatccattgagcaaaacctaattatttcatgttcatagttcacaatatctctttagcacattaaaagaagagcggtgttattgcagtactcttgcttaaaataacttgttgaatatagtaaggaattgaccaaaaaaaaattatccctgtgtcgaaataaatacactattacttataaacaggaaaagaaattccaaattgaaatggataattattaaggctcctgcgatgactaattcttataatagattttatcacttgaataattcaattttttacatggttgttattaaataatcactagcttgagaacatgcagagtcatcatttatactgttgaagagagatcagaaagaaaattaaaattcatgagaatgctattattttgtcactaagtttaacatattttttcattaatgaatgcttaatggacaaaataactaaataaggctgatgtgactactgtacagttgtgttgcaatgtaaatgtaatatagactgtgactgcaagagattttttttttttttttttttttgagacggagtctcgctctgtcgcccaggctggagtgcagtggcgcgatctcggctcacgactgcaagagattttaaaacaaattttgtaaatcatggaactgttaaaaagaggcgagtcatcacagaagtataatcaaggaaagagacacgtaatttagatactcataattcgtttcatgtaaatgacaatagtgttttttattatttgtatatcccagacaacatttttaaaatctcagtgtatgtattcacaggtaattggaaatcattctgttttaactgggcatcttgtattctatttgataaatctgacaaccctaaggagcatgaccaatttggaaacattttagtgttgtttcttggactgtggctccttagactgagggtatggtataattcaagtcccaggactgctgagaggagagctatggataccaattattagggaagattattaatccagacagtccctaacttaaaatggttcaacttaggattttttgaagttataatggtgggaaagctatgggcattcagtagaaaccatacttcagtacagtattaagtaaattatataagatattcaacactttataaaataggtcttgtatgggatgattttgcccaactgtaggctgacgtaagtgttctgggcatgtttaagctattaggctaaggtatgatgtccacaagttagctgtattaaatgcattttttacttacaatattttcagtttaggatgagttgatcaggaattaacctcgtcgtaagttgagaagcattgatattaagaatactaagttcttcccaacaagttccaacagagatgggatctgttcttatttttgttgttggttcacttggtaagaatttccccttcaagattgtcattgttgagcacctgatttaatatgtttggggaatcatctcagttgtggctctcccactagtcgagttcagatcctgttccacagtggcactaatggccagtgaagcttcaagtttctgggttgagcatacctcctggtcagccctggcttctgtgtgggcttttccacctgtacattaattttgtttttttttgtgcatttcagaatatctgtgttaaactacagcagtagaaacatgataaagtctgttttagaaaatggatttagaatcaagtttatttatgaattttaaaattcagccaccgtggaacatacctgcaggagtttcttgtaatttaatttttttttatagtaagacatgcttgttattttaggaataaaacaagttctataagtctcatttaaaaagagcaaccttatccacacattcttctacaacatgccctgcctcccagtggtaaccactttgcacttttaattatttcatttctcattgggtttcacattttttaatgtgttatcaatttttatagtttattaattttaggcattgaatttgacctcttaccataaatgatgagaacttggcctttacagcctcccccattttcatgcaaccatccttttaaaataatcatatcataatattgaataatgtttagaaattgcattatcatgaatgtataagtatagtttactgttatgctaaataatattgtcatatttctcaatattttctgtttctcatgagcaagggtatttagtcttcccaaatatatctgtccttccaatagccaagtgctgctctgtctgttctgtgtttggaattcaggattagaaaattctagaaataaggattcaaggaaagaagtcaatttcagctcttatagaaggataacttgggtttctcaaaggtgagcagggccgtggagagaggttaagcctggcactgctcatctgccctagtcctagaccccttgctcctactcagaggaggtatttaaaaaaacatttttcataataatttcttaagaaaaaaaactacacaaaatgccataagccattcaggggcttttcaaagtgacaaacaatagagatcccaatgcaagacctagctgaacataactttaacctgtttcttctctaacttgaagtttatatagttatagacagatgggattcgtaaggcttcatacagctagaaatcccgcactcagtttccagaagagtaagagaaaaggagcttcatattttgcacattgggaactgaaagtttgaaggtggctgggccattgtgaggggaaaaaacactgaccttgactatgttggtggggatcagctgttacttgcccccaagatccccttccccttctgatggaggctgacaagttctgctgtgctaactcagcattaatgaaattctgaagcaatactgcaggtaccattcctatgccctcatattcagctagagcagaaaggcataaaaaacttcagctctgtattttgtgaacagtggagcagacaaagagattgttgctgctcctcttcaccttcctagtcacagagagaattgtttcttgctcaatggtcccattcaaagtcactagccttccctctgtctctcagctccggagaatctcagataggctggtgtgagtggtaaaggtgtgtgactatgtacagggtgaccttggctacctgactgtaggacacccagggcttagtatgcgatgggtatgataaagcagaatcctttggtctcctcctgtcatgactcttcctcatgacaggaggagtccaaagaacaaagcaaaggtcatagcaaaactgagaaggggaggaatagatgccacgtaggccaggagagggaatcttagcacaaaaactgaaagcactcgggttactcacctggccactgcagtaggtaccggcttcagagttacatacaccacatgtggacagggccacatttccccctccctaaccctaacagattctagctctgaagggcataaaggacaagaacatttttgtgaaaacagtggccgttttgcatttttgaaaatgttgaaagtgtcctgtggacaccgagttggatgaagaattgctgtagtaggcactgggctggccacgtatccatggaccagggatatctaacaaaaggaaaataacttctctgaggtcacatagcaagccatacctggctctcagttctttatctccagatacaaatccggaggaaagaatcatataaggatttgaacacactggggctagaaagtgacttgtccaaaataaactaaggacatagttcagtaaggcagcccattccccctctgtttctagcatggtgtttcctcctacacaacctcccacctatgtggaagagttaatatggtccaaaggaaagaaaaactctttagctgaaaaatgattggagaatgaagtaatattttactaaaatttttcaaggctttgtcctcagccagggtcagaagatttgaaaaattcccaggggcatcattcacacattttgcagacttgttatccagtaggataacaatggtgtaaaataggggaaaaagaaaaggggcttcctggaattataagacatgaagtcctataccataagtgtaatatcaggacaaccaaaatgtataagtgtgctgggagcctggggatggtgggagcataaggataccaggaatcagcagctggagtcacaaatatctctttaatgagttcaggttaaaacaaacaaacaaacaaacaaacaaacatgacggtgtgggcatggagaattgaaccagaatccaagatataagagggagtcaaggctagcatttggtgttcttctctttgaggtctttcatttagaaattttatagttccttaaatcctgagctaaaattgggctgtggttacaaggacaggtacagatattactagtcaggccatgcagcatttcaagaacttgtggcaactgcctcctatccccacccttgggactcaaggccagttccttccttctaccagaaagcctgagacatagtgcactgctgtgcaagcttagatgtcatgccagtgcttcaaagtaagaggcagtttgggctgccaatgagtcttaactatgcaaggctggttcaacacatgcaaatcaataaatgtaatccagcatataaacagaaccgaagacaaaaaccacatgattatctcaacagatgcagaaaaggcctttgagaaaattcaacaacccttcatgctaaaaactctcaataaattaggtattgatgggttgtatctcaaaataataagagctatctatgacaatcccacagccaatatcatactgaatggacaaaaactggaagcattccctttgaaaaccagcacaagacggggatgccctctctcaccactcctattcaacatagtgttggaagttctggccagggcagtcaggcaggagaaggaaataaagggcattcaattaggaaaagaggaagtcaagttgtctctgtttgcagatgacatgattgtatatgtagaaaacccaatcgtctcagctcaaaatctccttaagctgataagcaacttcagcaaagtctcaggatacaaaatcaatgtacaaaaatcacaagcattcttatacaccaataacagacaaacagagagccaaatcatcagtgaactcccattcacaattgcttcaaagagaataaaatacctaggaatccaacttacaagggatgtgaaggttctcttcaaagagaactacaaaccactgctcaatgaaataaaagaggatacaaacaaatggaagaacattccatgctcatgggtaggaagaatcaatatcgtgaaaatggccatactgcccaaggtaatttatagattcaatgccatccccatcaagctaccaatgactttcttcacagaattggaaaaaactactttaaagttcatatggaaccaaaaaagagcccgcattgccaagacaatcctaagccaaaaaagaaaaaagctggaggcatcacactacctgacttcaaaatatactacaaggctacagtaaccaaaacagcatggaactggagaccaaaacagagatatagaccaatggaacagaacagagccctcagagataatgctgcatatctacaaccatctgatctttgacaaacctgagaaaaacaagcaatggggaaaggaatccctatttaataaatggtgctgggaaaactggctagccatatgtagaaagctgaaactggatcccttcctgacaccttatacaaaaattaattcaagatggattaaagccttacatgttagacctaaaaccataaaaaccctagaagaaaacctaggcaataccattcaggacataggcatgggcaaggacttcatgtctaaaacaccaaaagcaatggcaataaaagccaaaattgacaaatgggatctaattaaactaaagagcttctgcacagcaaaagaaactaccatcagagtgaacaggcaacctacagaatgggagaaaatttttgcaacctattcatctgacgaagggctaatatccagaatctacaatgaactcaaacaaatttaaaagaaaaaaaaacagacaaccccatcaaaaagtgggcgaaggatatgaacagacacttctcagaagaacacatttatgcagccaaaaaacacatgaaaaaatgctcatcatcactggccatcagagaaatgcaaatcaaaaccacaatgagataccatctcacaccagtcagaatggcgatcattaaaaagtcaggaaacgacaggtgctggagaggatgtggagaaataggaacacttttacactgttggcgggactgtaaactagttcaaccactgtggaagtcagtgtggtgattcctcagggatctagaactagaaataccatttgacccagccatcccattactgggtatatacccaaaggattataaatcatgctgctataaagatacatgcacatgtatgtttattgtggcactattcacaatagcaaagacttggaaccaacccaaatgtccaacaatgatagactgcgttaagaaaatgtggcacatatacaccatggaatactatgcagccataaaaaacgatgagttcatgtcctttatagggacatggatgaagctggaaaccatcattctcagcaaactattgcaaggacaaaaaaccaaacaccgcatgttctcactcataggtgggaattgaacaatgagaacacatggacacaggaaggggaacctcacacactggggcctgttgtggggttgggggaggcgggagggatagcattaggagatatacctaatgctaaatgatgacttaatgggtgcagcacaccaacatggcacatgtatacatatgtaacaaacctgcacattgtgcacatgtaccctaaaacttaaagtataataaaaatatatatatataaaagtcactgattgggagattcctgttctgcttacttgcagtctgcttgacaatctacatttgtagcagaaaaaaataataataagctatttatgactgtctcccacttccagaggagaagcagatgagactagaccccaagagaaatgaaaaggtatttctgccctcctgtcttccagaaagttctggtcttctgtactcagagattgttaataacttgttttcccaaaccccaagtaaaagtgttaggcaccttttatgcaactcttcttgtgtgggaggtcaatttagatgggtattttggagaaggaagatgtgaaggttgggaacgcggcactgctaggttgaaaggtgaaagagatgcttaagggtgacagggacttgagaaagtaatgcagcaaaagattccaaagtggcaagatccttgtggaaatcttgaattaagtaagactcttgttttgtagagcttatttgatgcctggagacttcaccctccaatactactgtcttggaaactctagctatagctgtcagtgcccacacttggcacaaaggctgtggagacaactgcctttaatggaccataagggcttcacaatgagcttcctggcagcaatcacaatgggcagaagccagaagctccatctaaggtattttttggatattatgtgccatactaaagaagaaggtctccatttattacagatattgatctcttcccatagtcatggtgtgacttagggttaaaattaatttaggaaaatggagtaatgggatattttttgttcctagtgttgtggaacaaaatcatgctgttacatttattgtttcatttaatcttcataagcccttcaaagtagacattgtttcctttcacaaagaagaaaacggagtattaaaaaggtactatgtatttaatgaaacacataaaagaaggaagctgggttggagaacctcctcagattttaaaaaagcctgcggatgtaactgacagaaaaggcaatctaactaacttaaataactgatatttgtaaatgcaaaatctgggagtagggatggcttcaaaccccagagttgattcagagactcaagtaatgtcctaaggattcaagttatccccagtttttggctctctgtcttctgtactgagtttgctttcaagctttgtgttgtagcgagatggctgccaacaagttcagagctatattttcttatgttgaagcacagctgaataaatggtgcctctctcagcaaggcatctacatagtcttattgagccttattggctccagttagatcacatgtccatggttgaaccaatcaatccctgtggccaaaggtatggaggtatgggtgttatttttagtcaggcctgagtcacagaccaacccttggagaaaggatatggggaaaacacatctccacatgcacatggtaaaaagactgagaaacatagcttgtttttttcaatagggtacactttccaaaaagatgaaggaatattggatttcaaaataaaaacagtaacaaagcagatatcttctgtagccctctttcattgtccccaatcccatctattggctctctgccacgtgtaacatgccatttgagccaatggaactatgttccattacaatgaaaactgtatcttccacttacattatcttctcagccatattgggtggaatttggctcacttagaggaatggggatgcattatattaacaaatactaattacatttcctgctttaggtgtgaactctgcttctcctattagacttcagcaaatcaagaattcaacaaatcaagaagtcagttgattcgaaggctatattgtgcaatgattagatgctcttatatttcctagcaaaaaataagaatgataataaagctatcattcattaagcacctaatatttgctggctctgaaatgttccatacacataattactaatcagaaacatgccatgcacataattactaatcctcacagcagcctgaaagggaggatactattatccctatttactaaatgaggatactctagttatgtgtagtagataatttttgacgttctttcccaggtcatgatgaactgttaatcacccactcttactcacttccagtgatcttttcctaccttccatatgttttgtaaaatagagcaaattggtctgtagaaagaagaatgaaacagatggaccacagtagtctagtgtcttctaagttccccataaaaggtctgactattgctattaggtttcataaaatactcctaacatatttaaaacttctctgcaagccaagccccaaagaaaatgtatgtattttaatcaaaaatcaaaataaacttgctcaagatcatttcaccagaaagtactggggtcaagatttgaaaccaattctctctgataccaaaggcagggttgaaccactgcaatgtgctttcacttccaggtgctgcaacttgaattcccaacattgacatatttaattccaaagaacattacaccagcttttagtcaaatgaaaaagttaaccagctgctatcttagctgtcaaatttctaggaagcagcttaaattgtaggagaatatgaatcatcatggatatcctatgtaaatgtcaattagcatggcttctgttaacaatgaactccttgctttcactatttaaaaaaaaagaataggtaataaaatcaacatgctggatttttcaaaataaaaaaaaacacaaaagtacccgtgttataatattacagtgatgatacctatagttagaagtgaaatggcgttcgtgggtgttataaaagagcaaaatcaatttcatagtctaaactacatattatttaaaaggagcacatattgaaaagacatttaaggttctctctacataggaaagcactttttcttctgtggtctttgctaagtaatgagctatttataattagccaactcatatttaacgtaattttctaaagtatacagcttagattttattttgccaaaattatcatggttcatggttcattgccttcaaaattatcaacgtggttcattgccttcaaatcttcacatttggtttagagattctttcttgctttaatcctccactaagtcaaactgcttgcaaatacactttacagtaaatctgcactaaggggatgcctagttgtacttttcatttacgcttgcacttgccttcttctggaactggtattttacagtaatagctacacattcttagttgtttgctaaagtgaagtcttgtttacaatatatagaacagcgtatataaggcgcactatttcacaattgtgtaattacagcagccaaggcttaagttaatgagtttcctaaatagctttagaagagagatcgcaatatgaaaagcttagcgtggaaaacatagggattatctagtccatcagagctccatctcaactattctagaaagatagctttatatcctatttcaaaaactgtccaagaaatagattccaagttaaaatctgtatgaaagaatactccccaagactgctctattactgatttttcatgtgtgaaatggcactggagatgtggtgtataaatttgaaatgatgtctgaaccagttattttctttaaaacgtaagatttcatttgaagaggacctattaagtaattctatgagtaaattcacagtcattacctgacaatctgcttaactccatcacgatcagaatggatattcatgagcataaatagtcaatattggctctaggaaatcaattactccactgttatccatcaacaatcctcttgagctcaggcttcatatctatcacttaagataggtgagaaaaaacccctttcaatgatataaaaatagcacataatcatgtgaagttaagtggatgccacccagtattagatgtgggaattgtgagacagaaatacataatatcatcttaaatgtagtttcatttgcttgtttgtttgtttagtgtatgttgagctcaactttttccatctagtacctatctttcactcattccatctctgaatgatctggataggttttctaaacaaatgactttattaagatgatacctccctccaaatcattgaaagtgtttctgacacaaaggtgccctttgcagcctggaaattctactaattttcaaaatacaattaatttctcagggtttaaagaatgagttttagtctatagtcttatacttgatagtgtctgtagcagttatactattataccaatagtgagtgtacaaaaattacttgtggttataatacataaagtgaacaggatttttcttcatggaaacaactaatacttaatgtaatagaaaacgatataatatatgatttactaccacaatttcacctataaactacattacaatggcccaaagactgaggcagaaactaggaaagtaggatcacagcgggggaaaccctagagttgtattgtcacattgcctgtgcatctgttttcatgtttgtacaaattctggcaaccagataataatagctgatgatgacaaatagatatttgaccaattaaacataaagatactagctaaaatgggatacttttgcataaaggtaaaacacattgcttttttaaaaacggaatttgtgtatctttttgtgtatcattttgcacaaatgcacactgtgaatacatgtaaaactaaaattctgcattgaatacacatcacaaagaaacagaaaggctaatggaactttttactgtaacttttggtaaggtcctaatgatagcatatacttgagagggaaggatattataactatttttttgaacactgaaatttgaaatttgccattttccttttttcatacctaatatatgatacagaggtgcatattaaaatactgaggtagagtttctgcacagtagaagaggatttgccacaaattttcttggccacagggttccagttatcacaatcaagtgacttagtctattcaataaaactgactaaacatatttgacctgattttgaaagttgtttctttttttataactgtaaataaaataagtgttcactttttaccaaatcttaggctagtgtttcagttggatgcttcttaacaaatatattgacttttttctctagtgatatcataagaaaaatcaattcttagtagagaatattctataatagatgcatgaaccagccaacgatggcttttatctaattgctatatagattgttttaaattttctctgtaggctttagtgctggataataaacaagagaatccaactgtattttgtagtacatttaagacctagcttgtaaagtcattgcaaatattttatttattctcaacaatgtatgatatcaatgcctttagcataaaactgtagcactttctttgatgaatacataatatacatcattatctttataagtatatgcacagtctgatagtatagttcaaatgacccattaattacaactttgaaacaaagcaagttctgctcttttcaggacagctggattgataaaggggactgagcatgcctgtcttatccaggcacccggtaaacaagccaggctccagtgcgggtcccctgtgttccatggctatacatctcatgtttatatgctttaaaaaagacaaatacgtctatctatactggcaagatgcaaaggtatctatcaattctttataattagtaactgaaagcaatgattcaatgataaaactatgagaaaaatacaaagatattcttcacggggttgaatttacagtagagaggttgacataagatgagtaatattccctcctcgaggcatgaaagggtgtgcctggggaccaatttaatttctaagcatggggtaaggcatctactagctttggtccacacagcttaatagagaaaaaggctgaaaagtaaaaatatgaatcttcaattgcagcagtttgcaagtcctcaaaatcaactgcacttcttggaatggagtttgttaaccagaaatgcaatcagaagtgccgaagtgaagaaagagctattaatagagaggaacagtcactcaaagattacagcttagtgatcttaatgcagtcatgaaattggacatgtgggggtctctgcaaaagtcaaaccaagaattggtcaaggccacaaatggcttgtatcttaacaaagctaggcatcaaaagcaacactagtaacagtattttaaaagtacaaaggtcttttgttcaagtcttttcatcgttatcagatgcagctatttatcagaagctgtaagtttgaaaccacatatcataaggacttttgcctaagcaataagatattgtatagtcatagaagtacagcttccatgaactagtttgttggggttttataattataaaactattttgtatgtatgtctgtatgtatgcatgtatgtatgtatatatgtatttatttattttgagacagagtctcattctgttgcccaggctggagtgcagggacacaatctcggctcactgcaacctccacctcctgggttcaagtgattctctggcctcagcctcctgagtagctgagattacaggcgtgtggcatcatgcccagctaatttttgtatttttagtagagaaggggcttcactatgttgcccaggctggtctcgaactccaggccccatgtgatccacccacctctgccttccaaagtgctgggattgcaggtgtgagccaccatgcccagcctattttgtatttttaatagtctctcagttatgaatgaataagtaggtagcttatagacagctatgataactaataaattcagaacttctttgagagttatcacacttaattccaaaggaaacttatctaaaagaaggctaaataggtagtaaacatccacagaaacaaatactaacaacatcaaaatgcaagcaaaagttcttatatacatcttacactcattcatacttttgttctgagaactaaaatatcctcccagtattctcacttgagaaaaataaatagctcagatggaattgtatatcaataaaggagtgtattcactttggtaaagaagaatttgttctccatatcaaaaaaaaaaaaaaaacaaaacaaacaaacaaacaaaaaaaacgccaaataatgatctgcttattttaaaagaagatttccagactccagggaaaatagcaggtggccaggagcctgccaaatgagcctgccaggaacacagcagggaggttgggtgggagcgaggacagctcatgtccgcttgccagttcagtggtgtgagcagcccagtggccagctgtgtgatgtggatacaagccactccaatcctcatccttttccagatggtggagtctttggctgctccacctgtggcctccagcaatgcataattaaattcctggctgtgctatatacttcattcaggaaatgtccattctctcttttaaaatccaggctttgaggaattctactttggtctgtttcttcacagttgtgtagatgatggaggtataacaaaagcagcagtcttgaagcccttatactaaaaggatcaagagcaaattcagtcccctataacatcttttataagtaggatccaccattaaacttcatggatagcatgtcaaaaagttaaatgtttttcatcaacttgttgtcagatatgttggtttatgaatagttgttgctacttctgttatatagcaactgcaaagctagcttatttaaagttactataagtttttagtctttattggaagaagtgaaaacagtctctgcagcaagactcaaaagtacctttgttttctaggcctgccagggatttttctatgaggccctaaaccatggtctctgccaacaactcctccatctccccatggctctcaagaaatagaactgctccatcctgaaggtaattgaatatcttacctaagtgatttcctcattgtttatttacattatggaacatttttcttgcagagttagagtataatctgtatgtaatactgaacaatattattgtaagctgcacaaaaacatacccataaatgagttcattaagtattagatatttaagtaaatgctgttttaaatggtttctactgtgtaaaaattgttggtggcttgttaaatagatgtttgaaaatgtttaaattgggaaaaattgcttggtgtttttctatgaatgaggaacagcttttttttaatatttaaaataatgaaatatccaacatattttcaggagcaaatcagatttggataataaagaaagtttattgtttaactacttttcttctctgtaaagagactttaataatgtcttcccattttaactgacaggccatcaatagatggatttgtttattgtttacccaattattagtctaaaaagcacttgctttaattcactataaaaatgtatactcaactggaccattaaaacaagactaagtgatttatagaaacgctttttctatattaaataaaaataatttcagcaattaagcacaagattagctctgaggctcctgttaggcaaggaaacaagagaaaccatgtgtgttacatggtatttactgtttagtgaattgaaacataccagcatagggttggaacaaatgtatttcccaacactgtactcatttatttacaataaattaaatgaatacaaaatgcttttgaaaatggcaaaatattctacaataataaagtatcactagattctactataaagagctaccacaattccactccaccattgctatgaaaaaagatgatcattcagtgagaatgatattggtgtacattttccaagaaaactatggaatgaagaatcagtttatacttaaaaggtaattaatttcagaaaagcagatttattcaaaacacataacaataataatggcttaaagggacttctgtttgtttgtttccccagtaatgaggacaaagtcagctatgaatgagcttatttttgactccaccattacaacatgacaatattgcattcatgacacgttatagtttgtattgtttcattgttatatgtttatatcaatgaatccacaacattcactaaagacacaatactcttttcctagaaaaaggaagcaatgtgtttataataccaaaaatgtcataagcactattataataagcatctgagagtatcatctctttggtcacatggatgccactgaagcatgagaatctgtctgtgaaggccagtgtgaattactaaatagagtgatgcaaagtgtttcctgaggaatgaaatttttattttatttaatataaatcgaaggtcaaaatgagctacaaaacaaggagctgtctggagttgttttcaaacgaagcatttttaataacttaataacaagcagtaattagcatactagctgtttgtggctaaatacagccttttgaactgcatagaggcacgagaatagcctgttcacttaactaatttacagattctttctcaaagtcttgtttttaccatgaatttacactctgtatataaaaagaaagaatatcttgataccatgaccttggccacaccttccacatggtagatcctaaatccatagattaacaaaatggaaataagagaaaaaaattgagaacaaaaataaaaattaatatgttttgctccaaaataaaccatgttttttttctctgtaaacagatcccttggagcctgttgagttttgtggaaaagaaaatcacataaagttttctccgtgacacacctagcaaggcattttcaagtccaatttatttacacaggcctagcagtaccctggagaatgcatattttcatattttctcccactgtattgaacccatgctttgtagcagatgtcatagagctgatatcgcagatagccaagctttgctgtagaagcatgtgaaaagacagacatccaaagaaacattgcaaatgtgtactacattatcaaactctccaaatttaggcttattcctagaatacaaatatttctcaacccagcaggcagccaggtgcccgcaaatcctgaaattataaaaactttggccaagttgatttacttctgcggtctcttgttgaaaaatgtgttgattcacattaatggcttgatgaaggggggactggaggactagaggtatcagggtgaataggacttgatgggttttgctctgtaatcagagtgtcactcaatcagagtgtgtggcaattgagtgagtggcacaattagcatcttattatggtgtttgctttcttctctttttatacggcataatttggtactttattataccatttcacattcgttagcacctcatgtagcactcattcatttggaagtcatttctcagaaaaattctgaaagataaaactcctgctgagaaagaagtacctacaaaaatcccctcaagtcctcactcatagctgcatattctaactttatgcaaaagctaccaagtttgctttacctgtctgcagcaggtcagaactagcaaaatgaaaaaatctagaatgtgttatataaagctagtgaaaaaaggcagattgagagtaccaaaataacagctggaagtgtgagaagagaaaaataagtaacaaaactcaggctgaagaacttcaaaggtataacatttttctcaggttgcattctcaagaaacagattctaaagtacggatttgactaatttatcaaagaagtgctccctggagaaatgagcaagggagtggggaggcacaacaaggaggctaagaaaccaagcaaagttgtgatttttaggtaaaattccagcctaggcttaccctgattgaaattgtgtagaatatattgcatctcagagtttgtcttaaggcaaggaatatgggctgttttgtgttcctttattagtcattcattggcttggggccatggggaggttggtgcaggggaatataccccatgttgcaggagtctggcaaatagaaacaaacaaacaaacaaacaaaataaaagttaactaaaaacaaaaacataaattgatttggccaataatacatttggctattaatgacaaggaccatgagtggatagagacccagttatcaaaagcctaatacattttcagatactaaatgatatgttttacttaaatttctgatacatcaagttgcaggtacataatttttttctaatagcttatgcatacatcaaagtgagtgattattcttaaaaccgcctatgcatttaaaatgtgtcaatatgttgatgttatatttttccagagaaaagaaatatagtaaagacatacttataaatgctttagtttatgtatttttttattctaagaagctattcagagaaataaaagtcttccttttctaacatatttgttagtattttcagaaaaatccatatttagatttctgaaggcaatgctgtatctccatacagaaggctgaatgacaatttaaaaacaagccctaatccctagtgactgtacatctgtgtcacaaaacaatcgcataatctggcatgattaaaaggtttgctgttcagagctcaacagctgaaagccaaatatggcaaagtatgatctagttttctgcttcataaatgcaaataaagactggcacatagagtatagaaagcagttgttcttatacaatttaggtccagcacacttttggataaagaagatgtccaatagaaaacaaatcctttgaaaacaaagctagacactcaagttttctggcttacactattgagccaaagtttctgcttttacaagtatgtgtttaaaatgaaaatacaggatgacatgtgttttgataatctgtagaaggactttaaacaccctgatcctctacagcaagttcacaataaaagtctgtacagaattaggaaaaccaatgacttgtattttaaataatcattcagtaataatgtagacattttcctgcttgtagatactatgcagaaagtattgttatctttgtctgtctagtactgagccataatccctggtacacagtaggcactcaataaatatttttgattgaatggatgactatagactgaatggatcaagaaatagacaaacatgaattaattttcaaaaaaaagttgggaatcatagtggtttctgaactgatgtctgcagaatattctaaattgtagccacattaatgtaaataacccaccagaccaaggaggaaatatatattagcatgtcaatatttttaaaagatacaatttatattgccatatttgtgaggcacctgattataaatcttgcattctcttccagagctgtctcctttgggaaaaatgaaagaggaaatcacattaagaataaaattgtcatcacaagattcattttattaacccagtatttccttacttgctgcaaatatgctggcgattttggatcagacaatccaggacagtgttatttgaatttattctttggcatagttcctagtgtttttgatgtaacccagcaatatctccaacagcaaagctgcagaattctgctgtccatttttattgaagtattgaatgtaattgagactcgtctgcttagactcacccatgtatactagggctttggttttgataaacattgtttcttctgttttctctacttcagtgttttactcttttaatcttctttttcttgaattttagccttcgagtttttcttccgcagattttcatttctgaatattaaaccatgcaaattctctatggccttttacagtatgactttctatatatgccttaattccaggtggcaggacagaccatttaacaatgtgctacccaaactcactgtggtgatacgcaaactcactgtagtttgtgcaaagtcctacagttcaaaatgcatacccaggcactacagtgttaggcaatagtaaaaaactaaatgccccaaaagaaggcatgtaaagatagaaagtgcccacataatcctcaaattcaaaaacaccttataaattaactgtgtccaaagactttggtttttatgacttagggaagcctaatctttgctcatatgagcccttgttcaatttggattgtcttttagaaagacgagtctactgaagcagggcaaaatgtcactttattttaaattaagattagaaacaatgacatttaattatcataatcatgtgtttttcagtagataattataaaagacaccacggtttaacatttagcttgtttccaaaagaggaaaaagggtgggaagtatttttatttaacaatgagagtatttagaggcaaatgattttatctgaaatttactattgttaactgttgtactgtttgctgtaaattaatctgaagtaagtatccatagaaaaatgtctctttgaaataagcatttctaaaatccttgaatatatctagtttggcaagtatgtaattatataacacacatgtcatatttacaattgaaatggggcaaaattgtacatatagagagacctaatatgtgagaatgaggaaaggtattaactttttagtagtatcagatgccacttgagcactttctacatgtgcaagacactgtgctaagtactcttgcaaacatgcaggtaagcactatttttatttgcattttatataccagagaattgatacatggatatgctaaataaggagtggaattagggattcagactgaggaatagctaaatctgaagccaagttcttagccactaaacttgtactctacagtatgattactattcatacgtagttattgagaaatagaaatgtgtctagtttaaatttagaaaaactataaatataaaatgcacaatgtttttcattagtattagaaaataaatacctcaataattttatattgatcacatgttgagatatttggcctacaacagttgaaataaaatatattatttaaattaattttatctgtttcttttttcttttcattgtggttactagaaattttaaatcacatatggggttctcatctgttgtttcactttatttctactggaccgtatttcactacactgtatagcctccatctctgacaagttaggggagagactctgaaatgttaattccctgcttagtttgtcttttcctcttatttatttcttgtttctctctcatgacagactttattttcttcattttaatgtaactatttatataaatattgtatatctctcactaaaatgtaagttcctggaagtcaggcctccgagttctcatcttgtaacaccaagtaacaagggaaggcttttaaggcaaataacaatctcaagcgttttagcctaagttaagcttcttcttcttcctcacaagctgtcttctcattacacagaatggagtcaggaatgtctccatcaggactgctcaggggtgtgcaaactgcagcttgtggccaaatccaacctagcacctgcttttataaataaagttttatggaaacacagccacatccactcatttagtactgtctataggctagctgggatacaatagcagagctccatagttgctacaaagtcctatggtcgtcaaatccgaaatattcaccacctggccctttagggaaaatctttgccatttctcaggtagcttatgctatcagagtcgattctttctttttgcgccttccatctcaagtatcaattacactatagtgacattagaatctcatgaaataacaaacatttttcacattgtgtttcaaggatgcttacattttaataaccacttgtagaataaaaacccaggatccctttgtgactatttctctcagttaaaatagtgggtctgagaagatgttttgatatgtctgctaccgtgacaacataaatagggaccatcttttaaagtttattgccatctgaggccccttgatttcaggatttcaagacttacaatgggcacatctaaaacagctactataatacttttaatgtcagaaaagtcactgtgaaaataaagaaataaaagatgtctacctgctggtgagtgagctctttaaatgactttactggagaataaatgactttactggagactctactggagaataaatgactttactggagagactttactggtgaggaaagtaatatagatataataccactattcctgtgacctatcaatacaagctattttacactttttaactatgccaagtgggtcatttaaggataatacagactgagggaaattctcattttgtttgaaggaatttgtttgtcttgatacaatcaattgaccttaactttcctagatgtggaaaatgaggtaaaatttgttactcttaaacaagatatattgttcagcaagactagaatgaaaggataccaaaacatttactctttactgatgcttccacaactagctattgtcaacatttccaatatcatccttacagtgaaaaccactatgacaagtactgtgcatgcaattatgtaaaattgaatcataaaacgagttagtggaataggaggattatataaatgttcaaatatttttatcaaattgtacaattaactagtttgttctgacaagtgttcttacaaaaaacaaaatattaattggcatatttcatataaacatatttacatttcatttattaggagccccttatttgttccagtgaataattagaatacatttacagcaaatcaattgaaacattcagtaacgtctttaaaatatccgaaggaaatgtgggaaatacctgtcttggtattctgagattgcaaggaactgtcttataaaacaatgcttctcaaagaggactaagtacacaatgatccattggtgaccagaaagaaaaacactaaaccttgatttaaaaagcaagtcaattattaaaccttagtaatgttgaaagattgattgatactgacaccttcattgagtcctaaaagtcactgatcaaaagaagtcaccatgaagaaaaaagggaattgtacaatgtggaggttttgacagtggcattctcattcatatattggttttatcatgttggaatatacaggagtttatattttttcctattcatattttttcctactcacagaagctagaatgtatttcacaaatgctaaaaatagaactcacactaacttgagcaaaatagtagacatcatttgcttactaatgaagaaatttaagcctgaaactgccttgactccaaagtatgccatagaactttcactctgtttctacattttcaggtctagcttgtcagttgctcttattctctcatgctatagataagagtttcttcacgtgatcagaaagatgaccaccagccagcctgcctttcaccttacagctaaccaattctaaagaaaaagagaccaaaaattccccatctttcatgtgtcaaatctgattgaaatacccttactaatcctagttggtcatgggtcaattccttatagcaatcactatgggtgggtagaggggtggaacaatgtgatgggccaacttatgtatcaagtaaccaaatcagaaccacagagtaggagaagaaccattcctcaaagaaagtggagttccagaaacaacaaacaactggtgctgcctagaaatcttagaagatatgaaaataaaatatcccagttgcattacagcatgcatgttaagaaatcataatgtaaaacaaattaatggtttgcatatgtttccaatttatgatctaatctggacactcatcaaattagaaatattgcagtagggatttccatataccaactgctgaagtaatactgttttcacagattacactttttaattacattctgtagaaagataaaaaaaaaaaaacttagtactatctttcttatattctcattctatggattgattggggatattctaacactttccctaaaattatttttaagatactttattttagaacacactgacatggtaaggctctttataataatgaatcttttattaaaaataaatttcttttctggaatggacattatttttcaaaaaaaaagaatgaagagtttgaacttaagattgaatgcattctacacaatctctacagtctcttccaattcttaacacttctctttctaaaactgttttctaaaatatttcattacataaaccccctggaaggccttctttgcatgcattcataccggttattatgtgcataaatagcagaaggttctgctttttaaaacagaaaaatggagaactaggtttgttgaagtttaatagctgtttttggtccgcgcaaattttcaatatcttggtgagctgcttcttagattaaaagatctagtattattgtagggtaggtcttttccaaaatgaaacatcatttgttctacattccttaagctaaaactaactgtatcattttagctagagagaagcatgcttcacaggtaacttttccttcgaaccatggatgtagttcagatttcgtttatattattccttgctttttacaagtgtaaaaagctatgaaaacttagatggttacttagcatattcattttatagtttgtgttatttaattgagttcatttgtacattcctgtcttttaaaaagtgggagatatatattttgctcttcactttggtttttgggtggattttgataaaacatttggggcagaaaaatgttcttgaaatagttacatagcttcaaggctatttcaaaattcaatacaatcagatatgtccatatacctaaaacattatttttacttttgtgaaatctagaacatatgcatcagccatctaaagacaatatttgaaaatccagtatggattaatgagctaaagagttttttttttttttttacaaaactataaaaatattcgaggaaagtaaaacaatgtttattttagaatctttggttaggtatgtcctttctagcaaggatgcaaaatatatcattataaaatatcgaaacagttcataataatatggtgggtgaaaacacacttcaaacaatgttctaacatatgtgatagctggagaaaattttcagctcagcaataagtcaaatcatatataaacggttcatatgaatcaataataaaaagcaaacttccccaagacttctagttgaaaaaaagtatataggtaagcaattcatgaaagcaaaaatacaaataaccaataaacattagaaaagttattgaatcttcttttaaatcagaaaaaaataacaaaatgcaatgctatcttcacataagattaaataataaaatatagatatacacaatgcagagatcagataatgtcttacttcattttgagataagataatgaacaatctcatacattgattacaggaatgtaacttagaaaagtctttgaagcacaattttgtctgtcacaatgtcaggtgcacattctttcaaccaattatttgtcatagatagttatcttaaaatttttgcacatatgagtgtttcttatggcgtaccttaaattagcgaacacaaaaccctaggaaaattctaaaagtccttcaatatgaaaatgactaaataaagcaaaatatgtctgcataaaatacgtggcacctatgagaagattgctttatatccatctacttgtcattgaaagacatattatcatgtattgttaaatgaaaatagcaaaatgcagaataacatattatttttataatgccctttaaatagatctggaaggacacatacccaactgttaatagtggttaccccattggaaggtagagacagaggcagagaaaaaaacttctgtttatatgacatgattctccaatagtttgaatttttttaaaacaaacctgttttacttttgaaataaaagactatttttgaagtatttaaaatcaaaatacatttattgctaattatttttacctacacttttaaaatatgaatagacaagagtaaatgaaggcaggaaaattgtttttatcagattagtaatatcaatgcaagagcaagtttttctgtgttttgaaaactgaaaaagcaatttatttcacttcctccaattatcatgggcacatatttctatggtctgaatgtgtctatgaaaatacctatgttgaaacgtaatccccaatgtactaatattaggaggtggcagtgtttgggaggtgatgaagtcacgaggatagggccctgaaaggaattaattaccttatgaaagggctagaaaaaactaggtatgcccttctgcccctctgttccttccactacctgtgaacacagcattcaaggtttcatcgtgaaagcagagaccaggatttcaacagacactgaaactgccagttccttgatcttaagacttcccatcctccagaactgtgagaaattaatttctatcatttataaataaaccaggctcagatattttggtaaaacagaacaaaaaagctaagtcatatatagaatggtagcaaatgggcagaaggtgtaacactctttgggtgaactctaaaatgggttagtcaagtaatcactttctccacatctttagtaacttttaaccttttttgtatggcagatctctaacattttattttttcctttgaaatctaaattgtattctaataataaaaaacaatattaagaaaaacatgccattatccttaattaccaaaagtcagatgcagtaaatatttggggaaaaatgtgccaacaaaactattttaggcagctgctattctgactactgcagagcttcctgacataacagtagtaaactcacacaccatcagatgtgatcaaaggtgtttttgaagagaggttctattccttttgtcttcaaatacattaccagatgaaggtcaaaatatctttaaaggggaaaatactttttccagctttattgaggtataattgacaaattgtatacaattaacaaaatgtatatatttaggatatatgatgtgatgttttgatataggtataccctgtgaaatcactaccataatcaagctaattaacatccatcatctcacaatgttaacatttgtgtgtgtgtgtgtgtgtgtgagatgtgagagcattaaatgtgagagagagcatctactctctcagcatatttcaagcatacaatatagtattagtaactacaggcaccatgctgcacatcagatctccagaacttactcatcctgcctaactgaaacttctttaccttttgagaaatatctctctaattttcacacccgatccccatcccatggcaaataccattctactttctgcttctacaaactcatcttttttagatttcatatataagtagaatcatgtagtttgttctttctattcctggattccttcatttagcataatgtcttcctgagtcattcatgttgttacatacaacaggatttctttcttcataaatagtatttcattgcatatgtgtgtgtgtctgtgtctgcatatgaatgccacattttcttttttatttatgtatttattttattttatttatttatttatttttttttgagacagagtcacgctctgtcgcccaggctggagtgcagtggcgcgatctcagctcactgcaagctccgcctcccgggttcacaccattctcctgccccagcctcctgagtagctgggactacaggtgccagccaccatgcctggctaattttttgtattcttagtagagacagggttcctcggcctcccaaagtgctgggattacaggtgtgagccaccacgcctgggcttcttttttatttttaaggcggggtctctattgcctgtgaaaaagtgcaatggggcaatcatagctcactgtagcttccacctcccaggtttgagccatccttctgcctgtgccttcagagtagctgagactacaggcttgtgttaccaagtccagctaatttttttgtttttcagtagagatgagttcttgctatattgtgtaggctggtctccaatccctgagctcaagtgatcgtcccacctcagcatcccaaaatgctgggaatataggcatccgccagtggcccacattttctttatccattcatctactgacaaacattaatgttgattctatatctggacaatcaacaccaacacatgaaatcagctgggaggggggctatgtcctggaaagccacaggggttgagctgcccaaggctgtgggagtgagacatggagtcaaaggttatcatttcagagctttatgatttgaccatccctctggatgtcagtcttgcatggggcttgtagaccctttgttttagccagcttctaccatttggaatgggtgtatttatgcaatgcctttattcccattgtatctagcaaataccggacttgcttttgattttacaggcttgtaagtagaaggcacttgctttgtctcagatgagactttggacttggacttttgggctaaggatggaatgagttaagactttaggagactgttgagaaagcatgatttgttttgaaatgtgaaagggacataagattttgggggagccagggggtgaaatgatatggttaggctttgtatccccatgcaaatctcattttgaattttaattcccataatccccaagtgtcaagggagagaccaggtggagataatggaatcatggggtggtttcccctatgctgttctcatgatagtgagtgagttctcatgagatctgttgattttataagtgtttggtagttcctccggtgttcattctccttcctgtcatcttgtgaataaggtatcttgcttctccttcgctctctgctatgatgataagtttcctgagactccgcagccacggtgaactgtgagtcaattaaacttcttttctttataaattacacagtcttgggcaatgctttatagcagtttgaaaatggactaatacagatacttttgtggggaagcattcttgtgataaatatgtatcatatataatgtatattgatgtattagtatacataaatacgtatcacaaatgactatacatatgtattttctaaatgtatctacacaaatagtagaatatgtgtatatacgtatgtgtgtgtgtgtgtatatagctacagataggtacatatactacatatatatatttgcctatatatacccatatgatatatatatatttatctactatgaaaacacacacacacacacatatatttacctacctatatgtagacatactgatatgtagaaatgtcaggagattgtattttaatataaatatgtcacctctgccgtactagaatgtgtaaagttgagcccattgttggtgggatagggaggttacagaaaggactactggtgggaaggtagtgggaatatactcacacaagggggtaaggcataaagtagtataagaactaacttcataatactgccaaagactgattctgtttgtcagtcagaataggatgtaaaagactatttcaaagagttaaattatttgttaatatcagagatcagccacagacaagaagtttatggatgagtgcagcagtggtccattggacatgttaaatacttatggatatccacaatttgaattgacattaaaaatgaatggatacccaactttgaattccatatcgtttttcatatcaaaaatattattttaactatttaaacattttaaaattattctcagctcatgggccattctaaaagaggcaaagggctataatttgacttatgccatatggtttactgatgcctggactagatcatttataataaatgaaaatgcctctcttgatcattatttcaaatttggtcaaagaaactgcatgatatcttaagtctgtatgtctttggtagttactatattctttaaaaagtatcagaacacattttctttttgaatggacacaagtacaagagcatcaataatgaaatcattttttattatagaatacagatattaaagccagacctatgtgtttcctagctgaataaaaatagtgtgctatgtatatataaatcaataggcttttcattagtgaaaataacgaaaaataacaaagctaaatcattatgaatttcttaaatgtataaagtccatttcaaaagaattttctaataaagaaagaacataaacaaagtgtaggtaagtttctttcacattaatctagcatccctcttctcaatatttgcctcagaggatgtcataggtaaataaaaaccatatgaatatccatgaaataagttgatagtgtgagagataacttctaaaactaactgtataggctttaaagaggcagctagatttcatttggaaggcaggcagagaaatatatcggtgaaatttaggtcataacttccaatgttaattaatttgcacctcaagcctactagaccagtggaattaggatatgatagaaatatgcaggatgtattaaggttttggccaatgggaatgacctgcttctcatattataaccttagcctagttaatttactgggaacaagttttaatgttacagtcagggttttaactcctcaggtgtcaaccctacattcagctgaaagaatagtatacacaaaagaaataggttaatttgtttactgtgctagaggatgcagaggcttctattagcctccaaccttacaggcttctcacacagttcatttaatattgaataaatataactttaagttatagtcatcaaaactatacatttcatcttctttgtatggaaaatataaaattaagggaggacattttaaattttctgtaccctacatgggagaactaatttgcctgctcatggaagacaaaaagaaaatttaatgtcacttctgccatacgagaatgtgtatgttgagaaggaatcagggatgctcatccctagaatatcttggtcattgatttgtccacttcttagagggcccatggataattcaatgatatgtacactctaaatattcacttaatatgttcaaggtaatttaaacgctgcatttcacatttatgagaaaacaggatataaacgcctacgcaagtccaataaacagatctcagatttaacctcgaagaatgctcagtatagcagaaaaagggctgcaatataagctccatgagggcagtgatgctgccttaatgaatattttattcccagtggcctgcacattccctgacacaaagtagacacacaataaatattttcagaagaaatgttaaatcattgaatccgtaatatacaaaattattataaataattaacaacatactatataacaatagcaaaacaaaggtaaagtacattaacagatgatttataaaatacatatgaatggcaaataaataaaaagtagaaataaaccaatatatgccattgcattttgtccactggattggtatctttatagcattgacaatttcccagtgttggtgaggtaattaaaaagctatcattcttgggacagtttgggggcatataaatttttaaaaccattgtgtacagcattttaatcaatggcttaagatgaaaatagaaatctattatgtcattaaacagcattgatggatcttgtaaacaggagagtaaaaaaagcaggcagaaaagaatatatactgtatgactccatgtaaatttaaaaaactggagaaactaagctattctaagttgtcaggagtcaaaatagtaattatatttagggaggaaagattattgattgggaggcagagtgagtgaggctagtaatgttccattgatctggatgtgattattaatacatggtatgttcaatttgtgaaagttcatcaagctgtacattaatgatttgtgtacttttccaggtatatgctataccgtaatgaaaagtttatttttaaaatgcttataaatatttttgttcagctggtcaaaatacagcgtgaacaaaattatagtcgtatagttaccaaaatatactctttctagtaagtcaacaataagcaaaggaaagattttatacttgtatatgcatgcatgcacatacacacatgtgaaatattttctgaatagattcccacttaatgtcagtccgtttggctttgagctatatagctgacccacatcagctgctttcaaacagattgaagtgatgtgtctgaaggtgacaaaagatggttgaggtcatccttttacaaaggcccttaagtaatcagccaccagaactgccataatgcattattaaaattgcaaggcatctctgcaagtttgagccatgtgtatgagggcacacagaaatgaagtctccttgctcataaacatcctttgcacatatagaaatgtatttccctgccctgattattgccctttaatgaaaacagacagaactggaaaaaaatgcactgtttttagctgtgtggacactgtgcaatcatttggactgggcagtgcaacagtcggttatctaggccagaaacaaagaatgaaattaagaatcaatctctacttacatgaaagattttttccaatgtagtgtgatgcttggagttttgttaactgtatgggttctgaacttctgttttaaagtttcccctttcaaaagcacatccaaaagactctttcatcacaactataaacagaaactaggccagtactggcatacatatatgtttgtttgttttttttctttctaaaattgtgacaatttttcacttaagaggtattttcctttctttattttatggcaacaaagtatttataaacctcctattttctgttttagtagtaaattagccttggcatgaatatgaagtaaaaaataagtcctattaattatgaaaaatggagttataggatttagctaataacatattaaaaccatcttttcacacctttcctaaagacaaaaataagactaattagtttcatgattatagcattaaaagactctatctatctgtctttctacttttctcctctttccggctagtttaatctaaagaatatttctttcttttcttttcttttttttttcgagacagagtctcgctctgtcgcccaggctggagtgcagtggcgcgatctcggatcactgcaacttccgcctcccaggttcacgccattctcctgcctcagcctccccagtagctgggactacaggcgcccaccaccactcctggctaattttttgtatttttagtagagacggggtttcaccgtgttagtcaggatggtctcgatctcctgacctcgtgatccgccctcctcggcctcccaaagtgctgggattacaggcgtgagccaccgcgcccagacaataacatttctaatttattattcctgaagtcatttataacccagagactacttacatatgttctcaccaatgaaattactccctttattttcacactgaaaggacaaattcatccctgttttcatctttactttttttttattttcataattacaaccttacgtaaaactttgattagaatgaaaaatgtaattttaataggacacctgtatttcatattaactaaggctgggcaagactaaaattctacttatgtctttcccctttacacactttcaattgctttttggataatgttctttactagtgaaaaaagatacatggtataaatatactcatttatgaagatttctctagtgatgatgtgaagatatcactgaagttgaagcttttcccagataaaataggatgaccattgagttaatgaagttttaagagctgagaaccttcaactaggaactggatattagcagcaacgcaggagctcaagagctcaggttttgattatgagataaaactggtcttaaattctagagcaaccatttgagtaatcttgggcaaattagtgatttccaaattcacaaggctaaaacagaactcttgctcccccaaccccaacctggtcttcctttattcttccccatgtcaattagaggcggcatcaccacatattcagtgatcacgccaaaaatctaagctattttttattttatttttctcttttactcactacacattcaatcattagcatctccgagtgtgtttctctctctctccttttctttctaccattgctatccacacacaaaccaccatcatataatgcttgaattatttcaagaacttcctaattttcctccatacaattcattcaacaaacagcatccagagtgttattttttaatataaattgtcatttactcccctgcttataactctctagtgattcttcatcataaattaaacatttaaatccctccaccaggctcacaatgacctgtatgatcttgccctacttatatattcagtttctttctataacattctccttcttacccattatgatctagctcctttagttctatctgtaatgttcatcctttttgtccttcagacttcatcttaaatgttaccttgatctcaccagtctaaaggagacaccaagttactaaaataatataaacttgtattattgctttttgttttatttacttctatactttctgtatctggcacataaaatgtgttccttaaatatttgctgaatgaatgaatgaacttaaaggaaaaaaaatttgttactgtaatgcagataattctacctacctgtcaggcttggactagaagataaatgaggcaagataagttgagtgtttagcacagtacctggggcaaaataagacttcgtaaatgattgccacttgtgtttttgttaaaacagggactacaataaggtcttacaaaggacttcttattgagtaataatatctctcctaagtgtaagattctaaggacttttttccagtggaaattattaaaatataggggttttatatgggctagtgaatgaattattgaatgaatgatgttcagcattttaagctaacctgaatcatactattgctgatgtatgtaacacacctttattccttatttctttaccatcctgagattctaaagactaccatatttaactttcctatgtatcagaagaaacctgaaaattataaactagaaggattcgacaaaacaaagaagcagtttgggatttaaagagatctaggaatacgttatttctaccacttgctgatgagcttcagataaccacctatatatgctgagcctcaattttcttacgccacttctttacagacttattggaaacgatgaataagatactgaatgtaattaatttagcacaatgatttagcaggtgactgatattcaattaatagtacattttctccaagtgtgtcactgagaaatagatctaaaaaaagctcaggaattctgttcttgtgttaatatgtgagcttaggctgatttcaatgttgtttaggctttcttgtatttctttaccctgttcttggaggtgccagtgtggccatgctgcctactaggttttcttctcatatactcagtttcactggtgctatgtgcaactacactatttttgtaagtggtagtaatttctttgaaacacaaagccaaaattaataagtagtgacagcttataggggtgaagtaatcatttttaaaaaggtcttggcagttggtttcttgaataagaaatgcacttgtttccataaattggcaacaaaaactgaaacacagaatgctgcccagaatcttgagaaatttgtacttgaattattgttatggtccattaaactcactctaaaaactttaatatgtttctgcttcagagacttgtttgtccatgtacagccatgtaaccacactatttacaatgcccaaagagcaaattgtttgattcagctgcagcaatggtctttccacagagaaagtttgcagttttcaacagccctaagtgctgcattctcctaactgaggtaaatactctgcattgttttcttcccaggtgattcaagctgcaagatagatgactaggactcaaataccggaaaagagaggtaagtaaactgtgttatttgtctaagttttagacaaagtgtgttcatcagaagcagagttaaagtaagagtttgaacaatagttttaaaaagtattcagttttcccagctagcactgttcagcatgtgatttcattatcctctttgccccattcagtttgaaacatttttatacttcagatcatttgtaacagatcatcactcagatctaatacataagacacaggaatttatattgaaaataatgtgtgcaacaatacttagttcctaaagaggacctaaggaagcagtcacagtttgtcatatacatcagtgacctttcaaggccgggacctcagtttgctagatgggctattattggacagagagagccaagacagaaatgataatatatatgaccagttctaggcaattcttagttaaaaatataagaggatgggactggaggccattatccttagcaaactaacagatgaacagaaaaccaaacaccacatgttctctgttataagtgggagctaaatgatgagaacacatagatacacaaagaagaacaacacacactaggacctttcggagggtggagggtgggaagagggagaggatcaggaaaaacaactaatggttacgaggcttaatacctaggtgatgaaataatctgtacaacaaacccccatgacacaagtttacctgtgtaacaagcctgcacttgtacctctgaacttaaaatcaaagttataaaaaccagtggaaggtaaagtgcaagaaatgtctaaaaatttatttggatatatgtgtcaaaaactttgaaagagttcaaacattacatctgtttagtacttccattattaggagtttattctaaagaaagctgcagaaaatacgacaatgctcaaaacaaacatcctacataaaaacaattttaaactatataacataaaaatgtatatatgtacatagataggaataacaatatataatgtgttaatgatgattaccactaactataaaattatgagtggtttaattatcttagtcaaattttgaggtataattaagtaagtcatattttcaatgaatttgacatatagagtcataccataacaagatacaggtcatttctgtctttccaaaatgttttctcctacccctttgcaacagctccacagaactttttctccaagtgtgtcaccgagaaatagtcctgaaagcagaataccccaactggcacaagagaaccactgatttgcttcctgtcaccacaggttagttttacattttctagaattgtatataaatagaatatactcatatatatggattattttattccaaatgttcctgagatatataaatgtcattggttttttggcatggtgtcttttaactcagcaagtttctgagatttatcagtgtttttgcacatattaataaaggcatactatgaagatactatgtattctgttccagaccaccttaataaagcaaatattgcaataaagtaacaggaatttttttgtttcccagtgcatatgaaagttatgtttacactataatattgtatatatattaagtgtgtcacagcattctgtctaaaaatgtatatacctttattaaaaatactttattgctaaaaaatgctaatgatcacctgacactgagacacaaaacaagcatgagcacacactgctgaaaaaatgtgccaagacttgctccatgcaagcgttaccacaaacctagttattccgttactaggaatttattcttttttaatttttaatttttgtcggtacttactaggtgcatatatgtatggggtacatgaggtactttgatacaggcatgaaatgcataataatcatagcaaatgaggtatccatcctctcaactgtgttacaaacaacccagttatattattttagttattttaaaatctacaattaaactattattgactatagttacccagttgtgctatcagatactaggtcttattcatcctttcaaactaatttttgaacctattaaccatcccaacttcctcctaatcccccaataccctccccagcctctggtaaccatccttctactctctctgtccatttacttgtttttattttttattttaattttaattaatattaaaattgtttgttttatttttttggttcccaaaaataagtgagaacttacaatgtttgtctttctgtgtctggcttatttcacttaacataatgatctccagttccatgtatgttgttgcaaaagactggatctcattatttatttgtaactgaatagtgctccattgtgcatatgtaccacattttctttatccattcatctgttgatggacacttaggttgcttccaaatcttagctattgtaaacagtgctgcaacaaacacaggagtgcagacatctcttagatatacagatttcctttcttttgggattgctggatcatatggcagctctatttttttttttttttagttttttgaggaagctccaaactattctccatagtggttgtactaatttacatttccaccaccagtatacaaatgtttccttttctccacatcctcatcagcattgattattgcctgtcatttgtatatatgccattttaactggggtgagatgatatctcattgcagtattgatttgtatttctctgatgatagatgatgtcaagcaccttattataggtctgcttgccatttgtatgtcttattttgagaaatgtctattcaaatcttttgcccatttttaaattagattattagatttttttcctacagagttgtttttgctccttgtatattctggttattaatcccttttcagatgcgtagtttgcaaatattttatcccactctgtgggctgtctcttcactttgttgattgattccttttttgtgaagaagctttttaacttgatgtgatcccatttgtccatttttgcttttgttgtttgtgcttgtggggtattactgaagaaatttttgcccagaccaatgtcctgtagagtttccccaaagttttcatgtaatactttcatgatttgagaactaaaatataaggttttaatccattttgatttgatttttgtatatggagagagataaggttctaatttcattcttctgcatatggatatccagttttccaatcatcatttattgaagagactgtcttttccccagtgtatgttcttggcacctttgtcaaatacgagttcactttaggtgtgtgaattttcttcttgggggttctctattctgttctattggtctaagtgtctgtttctatgtcagtaccatgctgttttggttagtatagctctgtagtgtaatttaaagttaggtattgtaattcctcccgttttgttctttttgcttaggatagctttggctattctgggtcttttgtgcttccatataaatttcaggatttttttttctatttctttgaagaatgtcattggtattttgataggaattgcattgaatgtatagattgctttgagaaatatggacattttaacaacattcattcttccaatctatgaacgtggaaaatcattccattttttgtatcctcttcaatttctttcatcagtgttttatagttttcattgtaaaaatctttcacttctttgattaatttctaggtctttaattttatgtatggggattacttattaaatttctttttcacattgttcattgttggcaaatagaaatgctactgctttgtaggttgatttgtatcttgcaactttcctgaatttgttttccagttctaatattttttgttagagtctttagatttttctaaatataagctcatattatctacaaacaaggataatttgacttctccctttccaatttgaatgtcctttatttctttctcttgcctgattgatctagctaggaattctagtattatgttgaaaaacagtagtgaaatgggtatccttgttgtatttctgatcttagaggaaaagcttttagtttttacccattcagtatgatactagctgtgcatctgtcatgtacagcttttttttatattggggtgtgttttttctatatctagttttgggcggattttatcaagaagaaatgttgaattttatcaaatgagtgttcagcattaattgatcatatgctttttgtccttcattctgtttatatgatagtccatattgattgatttgcgtatgttaagacatccttgcataccttgagtaaatcccacttggtcatggtaaatgatctttttaaaagtattgttgaatttggtttgcttagtattttatcgaggattttttcattgatattcatcagagatattagcctgtagttttctttttttttaatgtgtcttttcctgtttttggtatcagggtagtattggccttgtagaatgagttttagaagtattctctccacctctacttttttttgaaatagtttgagtaggattggtattagtctagaaatgtcatctgggaactagggcctagaatggggtccttatggcttgtctggtgcccttactctactgtggctgagctgatatccagtgtaagacaaagcattctttactgttcactctcctctcctcaagcagaaggaaggagttacttttgttgctgccagctgcattgcctggggttaagggagaggttggacaagcactcctttatccaccccagctggtgtctccctagatcacatgccatcctagtcccctggctcgaagaccagcccagcactagaagttgcctaggaatttcagaccttgtgttctagacttcctttcaagtgtatctaggaccccagagccctttagcttgtggtggtgaggcttgccaaagctcaagttctgaccattgagataggttattccctcttggttagggctggtccaaatgctccttctgtagatgagtgccagccaaacccagcatagctttactttctgcgtgacaggatagcactgagttcaatgccaagtccctaagtcactgtgttctccctctcccaagtgcacagattctctctccaagccatgtggccactgccaggagatgggggagaggtgacataggcagttcaagactgtctttgctacactcttcaatgtctctttcagtgatgtggcattaaaccagttactatgattgctcacctgatttttggttgctatgatggtacttttttgtgtgtacatagttcttaaattttggtgttcctgcagggggaattattggttgaggcttctgtttggccatcttgctccacatctctatgagtatgttctctaaatgaaatttaatttatataaaaaagtaatatttgtaaagcacagtaaaatgaggtatgcccatttttttcctttttattgttaagtagtatttcattatggttatactaaaatttgttcatttatttattcctgaacatttgggttgtttccagtttttgaaaattataaagaaagatattaatgtagttattctagtctctcttagtcactgtttgcatcgtatagctttctctaacatttagcttttgaactttgtgttttttcatttgaaagatataatttaatcttaaaaaatatatatctacacaagtatttgtgaagacatacactttgagttttcttgggtaaataccgaataggaaaattatttacaagtgtgtatgtttgactttactaaaacaaaacaaaacaaaacaaaaaaaactacaaattgtcttcaaagtggtggcaacatttgagaattccgcttgcttcacaaatgccaaaatttgtattctcattcttttaaattgtaaccattttagttgttgcacagttttatctcactgtctttaactctcactgccctgatgactaatatgttgagtaccttttcatgtgcttgttagccattatcactttttgtatgaaatgaatatccaaatattttacacattttcttaaattgggctatttgtcttcatattgttgagttgtaaatgtcctttatatattctggagataagtattgtaattttttccaatttggggtttgcattttcatttcattaataaagtattctttaaggaaaaaaatgtttacttttaataaagtccaatgtgtcaatatgtttccttcatgatttgtgctttgaaaactgtctaaaatatctttgtccactccccactcataaagatttttctcttatatccactttaatttttgttagtagtacaaattaaagtttgaggttcattcttttatacagatacctagtttaagcatcatttgttcaaaaactttccttcttaatgaaacattttggcacctttgtcaataatcaatgactatttctgtatgggtgtcatgccaacaccacactatcttttcaacgttttttctctctctgttctccaatttagatagttcctagtggcatttattcagcttcactgattgtttttttctacattgttttctctgatctatatcccacctagtaaatgtttttttcagctctaaaaattctattgtgtgtgtgtgtgtgtgtcttccattatctcttcattattttcatgctttgaaaaaaatattgagcatgtttatagtagccattttacagcctttgtttgctaatctaataatatctgtcatttctgaatcttttttattagctgatgcatttctcctgggctacatcacattttcctgctttttttatttctagtaattttttttaacggttgtttttgagtttgtgtatttttttaagtactgaactttgttctgataggcaattaataaattttggataaattttatcttttcaaggctgacgtaggtgtagcccttactctagggattgtttagctctgatgcaaagatgaaacatttctgtactttctacaagatgttccaggtatttatgaaggtctctctattctgattggacagagatataatacgttttaatgttgagcagactcagtgattatgtaccttacagctctccaatagacctccaatagacaaataatattgtatagaattctccatagtttactttctggcaacaaagtccagggacccctatgtagattttgggagttctttccttacttaccatctgctctgcaaattctacctgacttaccttcctatgcttcaatgtctgttttctcaactgatctcctaatggtccccttttctgcactaaaatatggaaaatgcctccagacagaaagccaagatcactataggtctcatcttatttccattctcttctaaatcaccatcttgtgttgcttattgtttaatgtcagaaatcaaatgtgtcatatattttgacaagttttctggctgtttaaggtagggaaaacaagtctagtttcagttacacaaactgagagttcttaattatattttatataagtctcttttttcaaaattgtctataatgtgcataaaaataattgtgtaattaaaaatatgcacataataatccattggtcattctgcatcttttcccaaagtaaagatgatagtacaagctaatgagataaaataccaagcattttattttccctgttgttattaggcattagaaattttgaccttggagagctatattttaaatttttatataactatggcagaaagaaaaaagtttttacctatgcttacttgtgtggtcaaaatcattattgtctgctctctgtttctatctcaataataccattcttcatggctgtagcatagtttttatttgtggagttatgaaaaatgcaggctggtcacccaagcagaaaaaagaacgttgtcttcaaagccaaatccccagtgtacagaagaatcatctcaaaaccatgcagcagatttcagtacaattcacagctactgacattttatggaccaggaagatccaagcttaactagcatagaaaaagtaatacatttccttccttttgtagaaagctgcatataatatatctttgaagacagggttaagattatcaccatgttcttctatggataaatacaggagttcagtttctgaggctgtgtcagagtttgcagacaataaattcacataacagtaaaacaaatgctacttgcagagaaaaaacattggcagtttgtatttcagttctgtgcactatgccgggtgcgtatagtgtgctgatttacagagaaggttcctcagtactttatactttgcaaactcatatttcctgtcctatagtgtaactgattttccaaggcttttattttgggggcaagagggagataggaattcaaaacacctgtatttgtttgatgtgtgagtggtatttaatgacagaatgataacaaatggatgtgtcagggattgatgttacccactttatccccttggtacctagtctcttgatttctgctttcataaactaagcacaatgttttatttctgtacaataaagtttgtctcaataaaattatttccttcaattagcttcctcagcaatgatgagcctccggtaatgtaatgattttgtactaatagctgaaagtgtgttatcagctaatgcctcttttcataagtgctagtgtgtaatacttaaccagctcctaagattagtggatgaatctctggagatacccagagcccaagtagtttaccattcgtaaaagcataggtccattatcttattttatacaatgagtagcatttatgcatttattgaacatttattatgtggtgggcattacattaatgttttatgtgtactctgtcttacttccacaagaaccatccaagtaggcatgaaactgaactagtatgagaccatgagaagcttcagggttggagtatgggtggcaatgctaatgtcaagaaacaggaaaccaagctgatacaggagcagatgggtgatgtgccgctcctgctcaaatcctaatcaattctgaagctatctggaaaatagatgggagccactggacaatttccagggcacagagaatgtattataaactgtgctgagctacttaaatgtattctttggtaagtttgtgtccatcactggagcagaagaatgaaagactagaaattcctttcttcttcccttttctttacgatcctcttgtttcccccaaaaacttaatgttagcatatttaaaaatttccctttctcttaggagaaaggaagtaaattctcttcatggtacatatatgttttgcccatctttgaatttggatatgaacactttttatgttattttcatttatagccaaatacatactaaaaatgagaaattaaattctatatcattcatcaagcacagagcccacatctgaaaatacagcttgctgggttagaatacaataatgtataaaatatagactgcattttcagaatgctttccatctggcagatggtagaactagagtacaatataaaactaaggatactttaaagaaaactaagataaaaggcatataaatgggttcagaaaagtaataacatgaaaaccttcctggggaagaagtatgaaaaaatgcatgagggtcagaattgacatgacattttctactaacttaaaaagtttcatctagcattaggtatatctcccgatgctatccctcccccatcccccgaccccacaacagtccccagagtgtgatattccccttcctgtgtccatgtgatctcattgttcaattcccacctatgagtgagaatatgcggtgtttggtttttgttcttgggatagtttactgagaatgatgatttccaatttcatccatgtccctacaaaggacatgaactcttcatgctagatgacgagttagtgggtgcagtgcaccagcatggcacatgtatacatatgtaactaacttgcacaatgtgcacatgtaccctaaaacttaaagtataataaaaaaataaatacaaaaaaatcaaaaagaaaaaaaaaagtttcagtattcaaatgaatgcatcatcagtcacatgtcttttcaggattatagcatacgttgtatgttgtaactatattctaattggctcatctttttttctattattaatactgctaattagtcctaactaattagtcctaacttgacataaacactcaagaaattgatcagtttaagaacaatttcactttttgtcactgttgagtttttcttcagaggtttatatacaaagcctatatttttcctaatttatgaaaatgacagacatgatacaactcaagcttctgaacaaggaaattcccagtaaacagaattagtatctatcagactaacaacacacatttgtctggtctactttcatacagggaggcttctaatgctatcaaaactaaccttgacccactagtcaatggccaggaatgcagagatgaggcttgcaaagatatttgaatggcattattagttaatcaaatggttataagcaccaaaattcaaccttacataatatttatatctacaaatctgtagaatctacagctaatacttagtttaacactctactgagagtatgcagactatttttagtaaccctcagaatcaaaacagcctctattcataagatctttgtgcacataaagaaaaaaaaaaaagtagccccatggagagcataaaatattcaccccctttaaatgcattactagtgttgatattatactgtaattagaaaagatgttaccattggagaaaactgggcaagattataaggaaccattccatattatttttgcaacagtatgtaaatctataattatttaaatattaaaaaaattataaatgaaataccagtactccaaggatcaatgctacatttatttatttatttattgctttatcactttatttatttatttatttttttattatactttaagttctagggtacatgtgcacaaggtgcaggtttgttacatatgtatacatgtgccatgttggtgtgctgaacccattaactcatcatttacattaggtatatcccccaatgccatacctccccccacccccaccccatgacaggctccggtgtgtgatgttccccttcctgtgtccatgtgttctatggttttaggtctaacatttaagtctttaatctgtcttgaattaatttttgtataaggtgtaagaaagggatccagtttcagctttctacatatggctagccacttttcccagcactatttattaaatagggaatcctttccccacttcttgtttttgtcaggtttgtcaaagatggttgtagatgtgtggtattagagaaacctattttcttgggaaataagggtcgtaatattggggaaagtgtatgaaactttaataggaagagagaacgttaatattttattgcttgaggagtccttaggtacagatggcaaacagaagcacatatgttgctgtctccccaagtgccgccttatacctatgacagtcctcacttgtggaggacagtgaaatttgggacttcattcagactcaaattcatgatccctcttgaggcagttctccaggcacctgttaataaactggtggtatcacatgaaatagaaccttttggtcctatgaattaatccatccaacaaatatgtgttaagctactatgaaccaggcaatttttaattgttgaaaataaactgataataagacagagtctatacattcctaaagatcataggtttggtaaacagatttagttagagccaagggtggcaaatagatgtcaacatccagtgttgcaggagggagtgcagaaaatggctatctttagagataggcagaaggtgacacatagtggagtgtgactggtgtcttaataggagttaatcaagtggggaagaagtagaagagcaaacacgttcaatgcatagttgatatttaatcacatggcaaactcaaggaagtgttaagaatctataatgaagacagaattgcatacgttaaagtgggagagagcaatcaaatataaaaatggaaaggaaaagccttgactttatgaccacacacaaacacacatatcctgtgggcagggaaactgcaactattggcttgtagggagaagccaaagagtgggttccaaggttatacctacccagtctcacactatccagatgagagaaagaacaagaggatattcataaaataagcaaaaacgggggttttcaggtggattagtcagggttctcttagagagacagaactaattctctctctctcgatatataatatataacatatatctcaatatataatatatatctcgatatactatatatgtcgatatatgtaaatatgtagataaatatattatctatatatttatatatttttatatatatttacatagatattttatctatataaaatatctatataaaaatatatttatatagatctatatatttatatatagatctatatatagatctatatatttatatatagatctatatatatagatttatatattatatatcgatttatattatatagatttatatagatgatctatatatattatatattatatatataaatctatatatattttttatatatatatatatatatatatgtagagagagagagagagagagagagagagagaggagttgattaggtattaacttatatgctcacaaggtcccaaaataggttgtctgcaagctgaggaacaaggacagccagcccgagagccagcccaagtcacaaaactgaagaatgtggagtccagtgttcaagggcaggaagcatccagcataggagaaagatgtagactaggaggctaggcccatctctctccttttcatgtttttctgcctgctttttattctctggaagctgactagattgtgcccaccagattaagggtggatctgccttccccagcccactgactcaaatgtgaatcacttttggcgatacccatacagacacactcaggattaatactttgtatccctcaattcagtcaagttgacactcagtattaactatcacagaaggggaaagagaagctgcctttattccagagaataccttttccagaaatgaaaggtgaaaccgagatgcaagtgtaaagccctagctccagatatatgtggtgtgctgaataaatttccaaaaaaataagcaaaaataataaattcacacattataagaagaggttttacataaaagagacattaataattaaagaaattaggtgattttgaggtaaaagctctcaaattgcacttaaataatttatgtgtcttttcagtaacatgtactttaataagcaaacaaacaaacaaaaaccacattcatttgaaaaattgagatgttcatgacaggcctgccctacttcctctactatattaataggactgagaccttcacatggatcacagtactgtgacgctccttccaacaataaactaataatacacttttctctgttggcttagcctaacatctcacctaggaacttaatttctttgtagtgtagtaccaggcagctgacagccccaaagcctggaacacaatgcgtagtcaatgaatatttcttgaatgagtaaatagtttagaattttgcctcaaaatttcgattttgttttataggcacacactccaaagagaggacatattttaagccgctattactctgtcatagcttcctgtgagtaggtctcctaccttttcttagagcgtggtttgttaagcagagaccaagggctctggataagaacaagaaagaggcacaattaaatgagaggggcagtggtgactgcagagattattctctaaataaaagcaaatgtacaaagaacaacatcaaaatccagttttagccccatggaattacatttaggtcttactagttcccatgaaatttactctcacatatgttccacttgtttttataatacgctggttttcttaaactagctagtgattttccttacatttaaaatattatatacacaactgagggaatgttgtgtaactatctaatgagcatttaaatttactataagttgcataagttctctagaggtccatgcagacaatctcttttatgtttattacatataatataaacataccttttccccatccttcctttacgaaacagaatcttgattgtccctttagaaccaactcccctccccccacactttctttcttttctttttttcttttttttttttttttttgaaatggagtttcactctgtaacccaggctggagtgcagtggcacaatctcagctcactgcaaccaccgccttccgagttcaagcaattctcgtgcctcagcctcccgagtagctgggattacaggtgtctgtcagcacacctggctaacttttgtatttttggtagaaacggggttccatcattttggccaggctggtctcaaactgttgacctcaagtgatctgcccaccttggcctcccgaagtgctaggattacaggcatgagccaccgcacccggcctccctactttcaaccaaagtaacatgggaggagttaatcttttcctctgacttctggaacaaacacagagtctgtgaatagaaaaatcactcttttcaacccttttgccccaataaaaggtttacgatgtgtgctgtaccacaaggagagataataattctgagattctagttgaaacattagagatgggaaattaccatgtgtggctgtaagcctggaggtacagatggaacacccagaaggaagagcatgcctcacaaaggaaccagcactagaaaagcaaagcaaaatatgatgataagaaatagcttcttgatgacattttggagaatctggactcattcactcttgaaactttcagttgtgcatccaatatataaattttgctgttcttattctacacctgttggattaactgtcacttataaccaaaagagcctttttattagagtagctgtaattaatggcaaaatgcagtgagtaacattagaaagacaaatatgataaggaagcacaaaggaggtagacttctaccctaactgtgatattaagaagttgccctgaaacaatatgatatttgatataaaaatttaatgatgggtggtatcatgatgacagtagtaaaagttagcttaacttataagatacagtgaaattaaagaaaatggcatggaaaagtgtagagagtattcagagaacagggggaaacaggagacagggaaaataacattttagatgtggtattttgaaaagaagaggaagagatgggggaatcagcacatggaggttaaaacaagacagaagctatcaacatctggaattcatattatgaaatttatttataattaattactaaataaggtttaatttgggtttaaaagtcataagtaaaagtaaaaaaatattatgacaaaaaattatttcatagggataaatgtaacagaaccataaaataagacaccaacatatattagttttaatatgatccaattcagatgattctctttaaaaaagagttcagaggttttttgtttgtctgtttgtttgttttattatactttaagttttagggtacatgtgcacaacgtacaggtttgttaaatatgtatacatgtgccatgttggtgtgtagcacccagtaactcgtcatttaacattagatatatctcctaatgctatccctccccactctccccaccccacaacaggccccagtgtgtgatgttccccttcctgtgtccaagtgttctcattgttcacttcccacctatgagtgagaacatgcagtctttggttttctgtcctcgtgatggtttgctcagaatgatgatttccagcttcatccatgtccctacaaaggacatgaactcattattttttatggctgcgtagtatccatggtgtatatatgccacattttcttaatccagtctatcgttgatggacatttgggttggtttcaagtctttgctattgtgaatagtgccacaataaacatacgtgtgcatatgtctttatagcagcatgttttataatcctttgggtatatacccagtaatgggatggcggggacaaatggtatttctagttctagatcccggaggaatcgccacactgacttccacaatggttgaactagtttatagtcccaccaacagtgtaaaagtgttcctgtttctccacatcgtctccagcacctgttgttgcctgactttttaatgattgccattctaactggtgtgagatggtatctcattgtggttttgatttgcatttctctgatggccagtgaggataagcatattttcattgtgtctgttggctgcataaatgtcttcttttgagaagtgtctgttcatatcctttgcccacttgttgatggggttgtttttttcttataaatttgtttgacttctttgtagattctggatattagtgctttgtcagatgagtagattgcgaaaattttctcccattctgtaggttgcctgttcactctgatgttagtttcttttgctgtgcagaagctctgtagtttaattagatcccatttatcaattttggcttttgttgccactgcttttggtgttttagacatgaggtccttgcccatgcctatgtcctgaatggtattccttaggttttcttctagggtttttatggttttaggtctaacatttaagtctttaatccatcttgaattaatatttgtataaggtgtaaggaagggatccagtttcagctttctacatatggctagccagttttcccagcaccatttattaaataggcaatcctttccccatttcttgtttttgtcaggtttgtcaaagatcagatggttgtagatatgtggcattatttttcagggctctgttctgttccattggtctatatctctgttttggtaccagtaccatcctgttttggttactgtagccttgtagtatagtttgaaatcaggtagcgtgatgcctccagctttgttcttttggcttaggattgacttggcgatgcgggctcttttttggttgcatatgaactttaaagtagttttgccaattctgtgaaaaaagtcattgataacttgatggggatggcattgaatctataaattaccttgggaagtatggccattttcatgatattaattcttcctatccatgagcatggaatgttcttccatttctttgtatcctcttttatttcgttgagcagtgttttgtaattctccttgaagaggtccttcacatcacttgtaagttggattcctaagtattttattctctttgaagcaattgtgaatgggagttcactcatgatttggttctctgtttatctgttattggtgtataagaatgcttgtgatttttgcacattgattttgaatcctgagactttgctgaagttgcttatcagcttaaggagattttgggctgagacaatggggttttctagatatacaatcaagtcatctgcaaacagggacaatttgacttcctcttttcctaattgaataccctttatttctttctgctgcctgattgccctggccagaacttccaacactatgttgaaaaggaatggtgagagagagcatccctgtcttgtgccagttttcaaagggaatgtttccagtttttgcccattcaatatgatattggctgtgggtttgtcatagatagctctaattattttgagatacaacccatcaataactaatttattgagagtttttagcatgaaggttgttgaattttgtcaaaggccttttctgcatctattgagataatcacgtggcttttgtcgttggttctgtatatatactggattacgtttattgatttgcatatgttgaaccagccttgcatcccagggatgaagcccactggattatggtggataagttttgatgtgctgctggattctttttgccagtatttaattgaggatttctgcatcgatgttcatcagggatattggtctaaaattctctttttttgttgtgtccctgtcacgctttgttatcaggatgatgctggcctcataaaatgagttagggaggtttccctatttttatattgattggaatagtttcagaaggaatggtaccagctcctccttgtacctctggtagaatttcactgtgaatccgtctggtcctggactttttttagttgataagctattaattattgccacaatttcagagcctgttattggtctattcagagattcaactgcttcctggtttagtcttgggagggggtatgtgtcgaggaatttacccatttcttctagcttttctagtatatttgcgtagaggtgtttatagtattctctgatggtagtttgtatttctgtgggatcggcggtgatatcccctttatcatttcttattgcatctatttgatccttcactcttttcttctttattagtcttgctagcagtctatcaattttgttgctcttttcaaaaaaccagctcctggattcattgattttttgaagggttttttgtatctctatttccttcagttctgctctgatcttagttatttcttgccttctgctagcttttgaatgtgtttgctcttgcttctctagttctttgaattgtgatgttaaggtgtcaattttagctctttcctgctttctcttgtgggcatttagtgctataaatttccttctgcacactgctttaaatgtgtcccagagattctggtatgttgtgtctttgttctcgttggtttcaaagaacatctttatttctgccttcatttcattatgtacccagtagccactcaggagcaggttgttcagtttccatgtagttgagcggttttgagtgagtttcttaatcctgagttctagtttcattgcactgtggtctgagagacagtttgttataatttctgttcttttacatttgctgagcagtgctttacttccaactatgtggtcaattttggaataggtgtggtgtggtactgagaagaatgtatattctgttgatttggggtggagagttctgtagatgtctattaggtgcgcttggtgtagagctgagttcaattcctgggtatccttgttaactttctgtctcattgatctgtctaatgttgacagtggggtgttaaagtctcccattattattgtgtgggagtctaagtctctttgtaggtctctaaggacttgctttatgaatctgggtgctcctgtgctgggtgcatatatatttaggatagttagctcttcttgttgaactgatccctttaccattatgtaatggccttctttgtctcttttgatctttgttggtttaaagtctgttttatcagagactaggattgcaacccctgccttcttttgttttccatttgcttggtagatcttcctccatccctttattttgagcctatgtgtgtctctgcatgtgaggtgggtctcctgaatatagcacactgatgggtcttgactgtttatccaatttgccagtctgtgtcttttaattggagcatttagcctatttacatttaaggttaatatggttatgtgtgaatttgatcctgtcattatgatgttagctggttattttgctcgttagttgatgcagtttcttcctagccttgatggtctttacaatttggcatgtttttgcagtggctggtaccggttgttcctttccatgtttagtgcttccttcaggagctcttgtagggcaggcctggtggtgacaaaatctctcagcatttgcttgtctgtaaaggattttatttctccttcacttatgaagcttagtttggctggatatgaaattctgggttgaaaattcttttctttaagaatgttgactagtggcccccactctcttctggcttgtagagtttctgccaagagatcagctgttagtctgatggactttcctttgtgggtaacccgacctttctctgtggctgcccgtaacattttttccttcatttcaactttggtgaatctgacaattatgtgtcttggagttgctcttctcgaggagtatctttgtggcgttctttgtatttccttaagttgaatgttggcctgccttgctagattggggaatttctcctggataatatcctgcagagtgttttccaacttggttccattctccccgttactttcaggtacaccaatcatatgtagatttggtcttttcacacagtcccatatttcttggaggccttgttcttttttttttttttaattgttttttctctaaacttctcttctcactttatttcattcatttgatcttccatcattgataccctttcttccagttgatcgaatcggctactgaggcttgtgcattcgtcacgtagttctcgtgccatggttttcagctccatcaggtcctttaaggacttctctgcattggttattctagttagcgattcgtctaatctttattcaaggtttttaacttctttgccatgggttcgaacttcctcctttagcttggagtagtttgatcatctgaagccttcttctctcaactcgtcaaagtcattctccatccagctttgttctgttgctggtgaggagctacgttcctttagaggaggagaggcacgctgatttttagaattttcagtttttctgctctgttttttccccatcttcatggttttatctacctttggtctttgatgatggtgacgtacagatggggttttggtgtggatgtccttcctgttggttagttttccttccaaatttttgttgagacggagtctcactctgtcgcccaggctggagtgcagtggcgcaatctcggctcactgcaagctccacctcccaggttcacgccattctcctgcctcagtctcccgagtagctgggactacaggcgcctgccaccacgctcggctaattttgttttgtatttttagtagagacagggtttcaccatgttagccaggatggtctcgatctcctgacctcatgatctgcttgcctcagcctcccaaagtgctaggattacaggcgtgagccaccgcgcccggcctcagaggttttaaagaagtatcctccgacagtttttatgcactgaaataatactaaattaaagctgttaaaagcctgtaccactcacatcacctactacagaaaactggccccaagaaagtcactagtgaaaggaaacattcacatagcccaatataccattgctgtagctgaatgtacaagaggagggcctctaactagaggagacccaacatagattgagcaattgacttttgattcttgcctaaggactttcactttgtaggaaaatctaatctgacctgatttcacacatatttgcagtcagcaatatcatggagatttttcagttattatcggaaatttaaataagatataccaagagataaagatgcggcaagaaagtttacacagtcaaaatcagggttatgggcaagacacagtgatgtgcaaaaggaaactatgcataaggagtcagtcattggcagtggagagaaggaaagcaagtgtgatttttaccagcgttccattaatagtgaagcatgagactaaataaccatgtgtcctggaggggctgtggagatcttaagaactgttctcagttccagaatgttcttcttgtctccattctggaaggtttagtccttacaagttcccatgaaattcattctcacatatgctctgtatttataatactctgtttttttttttagctagctaaagcatttccttacatttaaatgttatatatgtgtgtgtgtgtgtgtatgtgtgtgcatataaaaatataaatgttttataaaaattaacatacacttttactcagatatgtgaacacatattaaatatcttcaatatactgtaaagttcattgtgaaaactgagaaaaaaagtttcccttttgaaaaagtgaaaaaaaaagtgtccttaaaaaaccccaaatttcagtaaacatattctgctaaaacttttaaactgtgagataactaatttttagaattgtgttggtcaggttttattcaaactattggccttgtgaccattgtccataatcaataccatcttaattctaccctgctggattttatttcatacatttcgaggatcaaaaatagcaatattgtcatagtttaacaagaaacacaaagaaagttgactttgaaacaagcatgacaattatttttaagttttttggggcaagagttatttagataatgattaaagcagacaactttgaatgtatgcttacattgtgactagtcttaagtgatttctactttcttaaaaaaatagtgaaaaatctactaccttaattctgttatcacaaaaatgcattgtggaatgggaaacttagacatgattaaagaagacacacatggggcataagatatgacaagtggcttatgactccttctgcttattataggggtatagagagaaatcaatctggcatatatgacctattatctttcaactacagaacaaacagctggtgtgaccgttagaatataaaaccattttaaattattgttaaattcaaggcagattttgtttcttgacgtgttttccctaacataaattactgaaggtcatacccactaatatacatatatatgatgaataaattaacaaaagatcactggtcttaaatacctaggaattactgaaaaaagtgaaatagctcaataatgaaaactataaaacactgatgaaagaaattgaagaggacaccaaacgatagaaagatatttcatgttcatatgttagaagaatcaatattgataaaatctccatatttcccaaagcaatctacagatttaatgtaatttctatcaaaatatcaaaaccttcttcaaagaaagagaaaaaaatgatcctgaaatttatatggaatcacaaaagacccagaagagccacagctattttaagcaaaaaggataaaacaggaaaaatcacatgacctgacttcaaattattctacagagctgtacttaaccaaaaaagcatgctactggcataaaaacagacacatagaccaacggaacagaatagaagaccccagaaacaaatttacacgctcacagtgaactcatttttaacaaagatgccaagaacacacttgggaaaagacagtctcttcaacaagtgatggtagaaaaactggacatacatatgcagaataaaagtagaacattatctctcaccacatgcaaaaataaagtcaaaatgaattaaagacttaaatattagacctcaaaccatgaaactattacaagaaaacattgaggaaacctaggatattggtctgggcaaacatttcttcaggaatactcacaagcacagacaagtaaggaaaataactggacaaatgggatcacattaagttaaaaagcttctgcatagcaaaagaaacaatcaatgcagtaaagagacaacccacagaatgggagaagaaacatgcgaactacccatctgacaaggaaacaataaccagaaatatataaggaggtcaaacaactctatagaaaaaaacataaaaatccactttaaaaatgaacaaaagatctgaatagacatttctcaaaagaagacatataaatggcaaataggcatacgaaatggtgttcgacattgatcatcagagaaatgcaagccaaaactccgataagatagcatctcaacccagttaaagtggcttatatccaaaagataggcaataacaaatgctgatgaggatgtggagaaaagagaacccttgtgcactgttggtaggagtgtaaattagcacaatcactatggatagtttggacattcctcaaaaaaccaaaaaatctaaaaactaaaaccatatgatacagcaattccactactggatatataaccaaaagaaaaaaaaaggaaatcagtatatcgaagagatagctgcactctcatgtttgttgcagctgttcacaatagcaaagatttggaagcaccctatgtccatcaatggatgagtggataaagaaaatatagaacatatacagagtggagtactattcagccataaaaaagaatgagatcctgtcgtttgcaagaaggttcctggctaagtgacataagctaggcccaaaaagacaaacactcgatatgttcacttatttgtgaaatttaaaaaccaaaacaattgaactcatatacatatagagtgggaggatggttactagaggcagggaagggtagtagggggagggtagtgaggaggtgggaatggttaatgggtgcaaacagaaaaaaaaaaaagaaagaattaataagacccagtatttgatagtgcaacaggtgactataggcaataatagtttaattgttctttttaaataagtaaaagggtataattggactgtttgtaaagcaaaggataaatccttgatggaacagaagccccattttccatgatgtcattactatgcattgcatgcctgtatcaaaacatctcctgcactccataaatatatatatctactatgtatctatgtactcacataaatcaaatttttttaaaaaaattaaagatcactgtttttaagcagaagcatcctacattttaaaggcttcctgatcctttaaaaagtagagtcattgctatatgatataaaagaagggacaatttaaaaatcccagatgattacaaggacaggccaatttgaagatgatatgcatttatatcatgtgataaatttagagagtatctgttagtttgataaaaaccctcagtactaatattgccaacaaaataccacagctatattctcttatccgatggttctaaaatccagcttctaggtttatatactataccttaattcggtgttttcctactgaattagttatggtgagttaattaattggaaaaaaaggggattcagttatagtcacagcagtaagaactggacataacccactgtgtgtcatatatgcagagcccacagctgtcaaccttcatggactgtgataggtcattcacataaacataagtcatcatttaatttagaataaagaaaatgttatgaagtgcctttatcctgtagtcaatcccatggtatttaaaatagaaatcaagctttaaaacaaaacaaagtccacctgcggaactgtttctgtaagtacactaatatctgaatctactgatagtagcaatttgataaaaggcaacgggccaagagctttttattgtgactgaaatcattgttgtctaatagttcaaaatcaatgagaatatgctcagagaccaaaaacctcattagacagcaactctccagatagatcatttgaggggactggtgactagaaaaaaataagacaagtaattgatgtgttagaagacatactaagtgctgttgaggtttccatttttatttttaataagaccttggtagccctatctactgaaaatgatatctaatatcagactataatcaagttatcaggtaaagagtgtggcatggagcagacaaaacaaggcagccttcagctggcttcagaagtgccttattaggcaactgtcttgaaggcagtgcgcagattgattagagtaccgtgctttagagctaaacagacatgagttgaataccaggtctcttacttactgagtttagtaattttaactatttacctaagtttctctgagcttcaattttttaaattcaaaatgattttaataatatttatcacatttaattgttttcatgatcaaattagaaactgtaggccaactaccaagtaatggcaactgactcaaagtgggtatttcataattcttagttattagtgtttttactttttgtcaggaaaatcttcatgaaatctcggggaagtgctctagcatcacatgcttagttattttccatgtaagaaaataagtaagtaagaagtccatggaaaagtcctcctctccacctacatcatccagaactctatatctctgttatccattggctggaatctcatttgaagctagagaaatagagctaacatgctgggatagtcattctaaggcacacacacatcacggctaaagctcctttcataggagcaagcacggtcagtgagtctggaacctcaaataacatgctagctgagatttgaacaattaacacctttaagaacttaacgggctaaactaattgagaaagtgaaagaaaccattaagttgtagtctggtaagaacagtctccaactaattttgatactaacatgatatgaaccaacaaaaaggatcagacaaaatagaaagattgatccatatgatctggggaaacactcttttttcaagcatccaacactgttgaagggagaagatataggatttggagaggctgatgtctccaggtctccattgtgattaagcaataatttcttatgaaatgtcacctttattattccacaattattataacatcaaagtagcttcctcatgaacaatgtagtttggtacatagcttggtagcaggataatatagtttgttcttgactgcatataataattctaatcattagaaagaattctaattgatactttagtgtttctggtttatataccagtctgagcttaatgagtatgagctaatcaccgaatgcattgagaacataggtcagtttctggaaagttaagagacataattccagaatgtggtgactcaactgagaaaggctgtgcctagattatctttagcatcttccaaactgagcaaagacaccacaggtatccctttctcactgtccctttgaaacagcctttgccactgctgcctctactgctactgccatgattgatacctggagaatatgcaaatcccattcaattcagtcttttaatacctctcaaaaatgatacgtagagatatgggaacgcttggttgccctgaaattgatcaaactcaaaatattaaggtataggtcccaagcacctcttacttcccataataacttattatgactacttaaatgtataagttaattgtttctttatgtttattctccactgagtaaaataatatatccttttatttccttctaactacttctttagaactttaacaggtttgctgccagttctaatattcggtgagcttttgtgagtgacacataatcagtgttagtgatttagaatgttttctgtctctagacatggttttataaataatactttataatgtactttatttcctactacctcccaatagcagaaaatgacatattttttcctggatctatacttttatatacttattaaaaagaatgtggaatgttataccagcattataaagaaaattacacagatgtactaaaatttcaccttagtctctcagtaggttgcatttatgtaaaggttatcttgcccttcagggattcaaaaataactagcctttgaaatctatgcttgcttctcctaacttcacaataaactgaaccttccaaagagtttgggattataccatacattaacttgatatattctctatttaacttttattattcaacctgtgtcagccattattgacaataattctgtatgatgatatttctttttctttctttcttttttttttttttttttactccttacatagcttgtggttaatcaaccctagcaaagtatttaaataaaaggagaccaagatgtagacacatgtaccgtaaacagagggctgcacaatagtggaaatgcagacgtgagatgcttaagcacaagacaagacagaatgaaaagtatcctggattattcataaagcacataatgatccctgcaaaattccactgtagaatgacagtaacttgtaattctcaaacataaagatagactggtttctatgagatggcaaataaactttacataaatttagttcaggtgatgctttgcaaaaaaatataatatgtaatccattcaactcagaattatgcttctctagttgctacagacattttacgagagagcatagactatcccagaataattattttgacattaaatttatattaacaaaacttaaatccataccctatacattgcctactcatctcatttctctaaggatcggtcaatgcatcttcacaaggtagacattcttttaaggagcatttattaagcacttaatatagtccagtgaatccagtgaacctaatgaaaatctgaaacatgctattattaacacattaagtctaataatcacttaactatctcatagactcagaaattagattcctctgacaggtagtctacaattattctctaaaatattatgctgtttaattttcatatccaatcatgtttgaacaaattaaagaaaagcaaaaacaattgtcctctttctcacagtggagtagaaagatttgacttcacaagtcttagtactcttagtctaatgctatctacttcttacatcattcctcacttgaaaaaaataaataaataaaaggtattcttaaagcaaatacatgtatgtgtgtttctatgtttctacacagtagttacaggcaaaggatctaccagaatgtaccttctgttggcagtttcattgattcagtgcctcccaacttccatgtcttggcatatatagaaatggtagggggcggtaaagagacaaggctgcttatgatcagagataaccaggtttggggctgaagctatggtaagctctccccagatactctgagagttgaagtagtttacatcttggcataagtgtgtcctatttcaacagcacagcaactcagaaacctatatcgaacatagtaaaatttatggcgctcacctttttccacttgaatgcctatgttttcagtcaaagcaaaccacacatacactttgcagcaaatttaaagaccagaaaatggaattgttatagtaaaaagcatactcccagaaaatgggaaacctttaaaaagaagcagtaacatagcttccaaacattctaatagcaatagtagtagtagaagtagtaaccatagtacataatgacaagcatgtctcaacaatgttgctcccactcaaactattatctgattaaatcctcataacagttctaaaatatagatactaatttatagagggaaaaactgaggttaatagaagttagctaaattgttataaatagctcatccagcatgtggcagaacctgaaacttagattgccctgccctaaccattatgctgcctcctaacaataaataaatacatacatacatacataggtccaaccaacctaaattatatgctacaacttaaatcagttaaaaaaattttaagttaccttttaattttcttccattctgcctcaattcctggagaatagaaagtagttaagaaattgtaaaagcttggaaacactggacggatgttgtgggaaaaaaattgtaaaagctgtaaactaatcactgggttgggaatggggggaggagaaaactgaggatgtgaaaaattaaaaaaataaaaatacaagaaggggttgtactgcagaatgtgaaacaaacagaaaaaggtaatctaaaggaaaaaccaaagagagagtgcagaaaggctgaacagcccctgattcaaccctcagaaggcagagaccagttttgtgttattctacagagtttggtcagtatgaaaaactaaagaacattcctaggatgagccttacccagtggaagagccatcgtagagtggctgaaggttgaaatgaatttactggcaggggaaaaaaaaaaacaacaacaaacactagagaggtagctgtactaaaggtctgatgaagtgactcactgaacaggcaaataaaaggaatattactatattaagaaatgaaaaaaaagaaaattggacaccctcagagttgcactggaatactagtgttacaactctcaaaacaaaacaaaaattgttccaaattgacatgcctggagtttcctcaaagactctagcacgtgggctcttttctctttcctaacctaagaaagcagattgagttgcttgtgaacctatcattcagagagctcagccacagtatttgcagattagtgcccaaatctccaaattcgcaaatgtagtgctggttctatggcaccaggatttaactatgctctcttttcatcctccagtgcttatggatggtgcttatggatggtccccaaagctaaatgaaatccccacatcagatgaggtcgccttttcctttgagattcaaataaagtcctcacttccctagccaaagtcctgtgggaagatcaatgccttcaccaagaaatttgcaaattctttgtgcttctgacctctctgacgtcctgtttcctgctgacatttctatttcattgacatttcctcttccctggctgttttcttctttctacttatgtctaataaacgagccccttctctacattctcaacaaacaaacaaactagtgcatatatatgttttataaataggacttatattttcattatccatagtgatcactgtcactgtattctctgaacactaatcatttggggaaagcaagtaatagccctttgtttggcttaccagccaattttaaaggtattactaatatgtgatatatttgaaaattatggctggatgcgatggcttacgcctgtaatcccagcactttgggaggctgaggtgggcggatcatcaggtcaggagatcgagaccatcctggctaacacgatgaaaccctgtctccattaaaaatacaaaaaaattagccgggcatggtggtgggcacctgtaatcccagcttctcgggaggctgagaatggcatgaacccggaggcagagcttgcagtgagcagagactgtgacactgtactccagcctgggcgacagagcaagactcagtctcaaaaaaaaaaaaagaaaattatgggttagtacagaagaggacctactctgacatgttcttaacagcttgaccacagtgtcctgatgagtcacctgtggacacaacttattcacacagaatatactgttatagcactttttgagcaggggaaggcagagtttaataggcttagaaattaatttggccagagtcacatgattaataaacagtaggacaagactagccatcgggttgtctccctctgagtcccagtgagatagctctgagaacctctcattctacactgctccccaatgcaagaacagaaaccagtaaatgtgtcctgtggaagccagccaccatgtccatcagagctctctaagggcttgatctaactcatcaggtttcaccccacagtccctggggaggtctctatttggcatacatagttgaggcaggtgaaaatttccataatcgtattaatgtactatgttttagtaaaacttgttatttaaaaaaaaacaacagcctttagcatcatttttctattctaacatttgtaatgggcccctctgccattgtctctaaagcaaattcatgtctcacatgcctctgatgagcttccaatctatatttatgaagttatccattactacagaaacatccatttaattcttctgcctctccaacctccgacaattcatcacccccttagcatatccagttcttttactggtttattacctttgtgcacaatgtattctttaactttatttacttgtattaaaatccaatattcgaaggctacctaattcacaaacacacacaagtacgtagccctcaatttgattttttaaattttaattacctttgtcctttattatcacagaactttgtttctaaactatcatatcttctcttgcatgataataatttctgcatatgccttttttctattctataagcacaaggacatgtttcatctttgtatattacccttttctcacttctccctccctaatttatttaagacatcgtgtttaacaataggctaatttatttaagacatagggtttaaaaatagtatactgaattatgttaagtcaatgtcttttcatagactattaattgtgattttttcttcatttataagataccaactactaagttggcactttccaaaagtttaaaaatcttaccaaaaagaagcttgatactgcttaatcccactttaagttctttgtttatttttggtgacagtttcaacaactccaacttaaggcttttggtcctcctgaaactcataaaggaatgcaccactacagagatagaagcagatccctgagtttccaatacatacaggttcatgctatgtacttgacaaaggattattgttcccaaatgatgaagggagaattcttacaaaaccataccttgttgcttcttaagaaactaataagcatacagaatacacattatgtctggttgttttaggcagtgagtttggtgtttccttcttatctagtaagacatgttgctgaaatcccagaaaaaaaaaggaaaaaaagtagtgcctcaggtagattaaaggcatccatgtatggtggaggaaggaaagaagaaagacaggaagaaaatggttgattcatttttaatttagttataaaatccttattaaacaaccatagtatattagtattaaggtcaaaagcctcatagtgagacaccagatttgaagcctggcccatcagggttgggatatatattgaatttaggagaaagtgcgttagttaaattgatagtaaggatatagctgaaactccagataaaacttacaaggattaatatattatctatagtttataattaacctcaaaattacttagatatctttaagaaaatgtttaatactttaattcaaaaatatttattaagcaccctgtggaatatgcattagtcaggcttactgtatacaaacaaatcccaaatctcagtgccttaataaaacagaagttgatttctcacaaatgctgtattgcccatgtggacacctcaagtgagaccgcttcacatataactaggatttctaggcagatgaaagccccataattttgtgactgtaccacctggagctaggggcctcttcagtcaccttggcaaaaaaagacaatgctagagaatcttgcaattaaatgcttagacttgggtatgactcactcagccacttctgctcagatctcactaattataataggccatagcccaacccaacaataaggggatgaagtatattccaccagtgtccctagagggataggaaaattaaataaatgaggacaatacacatctccatcacaggatacaaaaatttaatcaaccagtaccatcctggttctatactcagtgttttcatgacttatttccctctcagatatggctttattgttagaaagaaatgtgataatgagaagaattgatgcaaggaaaccaacacaatataaataagagtcaaataccagagcatctttatctccataccttcacaatgaacattagagctgaaattcatccaatatacactgtacgggattgttttttgctgatctttattctgattggttggttctctcttttcattcatcagggcacatgacacacccatttgttaaagattttgaacatcactctttgttaaagattacaggaatccataaaatatggagatgcctggagtagtattttaaaacaatctatgtattataaaacaacattatagctataataaaagggtgtgttaatgtatgcttttattgctaagtatattttttacgtttatctattttacatgtcaatgctaaatagtataaataacatgagtgttttgctaaatgactatgtatataatgacttgtcttcttagttgcctatcttatttacttgataagcagaaaagaaactttccaaattatgttcacaaattgcatcttcaaggattagttttaaacaaataagcagataaattatgtctaacatatttgcttaggacaagagaaaagctttgaactaacaaattatctatgcaaaaatgcatgggtcatccaaatcattcccctaaagcccttttatgtactaagaaagcaagcaaaagcaattcatgtttaattaatgtatagcatatctagcatattcatttcagaaatcacactttaaatctgacattgaagagttatatttttgtccctggtgggaaaaaataagtttagggtatttattttcattttaccagatatttatagtatatgatagaacatgaattggattgattgagtatcaggagacctcaattttacctcaactttattcctaaattgtaaataagccgaatttctttaagtttcagtttattcatcttgtgaagaaagtaaatgatttttaagttttcttccaactccagtctcccatgtcttagagattttacactaccatagaggtttatggttgcctcatagcttttgaagaggcaatcctcttcacggcagcaatgcaaaatagttacaagtaaaatcactagagatagactgtctagatttgactcacagctttaccactgtcagtcgtctagtcagtaaaactgagataataacagcatccaattcataaaatattcagcagattaaattagttcacacttgcaaatgcatctagaatattataatgtagcaagcactcaattatcatgagtcatgatatcgttaggcactttttgtttgtttgttttttgctgtgtgaaaatgctggtatcctaatggtgatggaatttactgagctactattcataaaacatttgaaataggctattaaactttttccatatggtgcttaagataacttggtgagtgatattgtttggctgtgtccctacccaaatctcatcctgaaggtgatttcccccatgctattatcctgatagtgagtgagttttcagaagagttgatcgttttataagggacttccttcttcactgggaactcattcttcttcctgctgccatgtgaagaaggatgtatttgcttccccttcctccatggttgtaagtttccctggcatggcacctgtagccccttagtttaggccagtttctcccatttggaataggtgtctttacccaatgcctgcacccccattgtatctaggaagtaactaacttgcttttgaatttaccggctcataagcagaagggacttgccttgtctcagataagactttcgagttggacttttgagttagcactggaataagttaggatttgggggtactgttggaagaacatgattgtgttttaaaatgtgaggacctgagatttgggaggggccagggatagaataatatggttagattttgtatcctcacccaaatctcatcttgaattgtacttcccataatccccgcatgttatgagagggaccaagtggagataattgcatcatgggggcagtttcctccatcctgttctcgtgatagtgagttagttctcatgagatctgattgttttataaggggctccccccttcactgggcaaacattcttcttctccctgctgccatgtgaagaaggatgtgttggtcttctcttcctccatgattgtaagtttcctgaggcctccccagacatgctgaactgtgaatcaattaaacttctttcctttgtaaattactcagtcccaggtatgtctttattagcaacgtgagaacagactaatacagtgagccaaaatgtatcaataattagggggctgtacatcacaggtttaacaagaaaatagtaaccacaatgccaagtgacagtagccaaagctatgagaagcaggtgaattatttaacattggctgtaaatataggtgtcaaattaggcaacactgcattggtttctaacagttggtggatgagatatcctggctgaccttcatgctgaagacaacctaagatattagataaaatactaaaacaaaaaatgaaacatgtttcctaaatacattaatgatctagcaagaaattttaaagtatttgttctaaagcaagtgggttaaagttaaaaaaaaatagcatatttacatagtctcaaagtgcgttatcctataaaaaaggaaaaatacaggattttaaaggcatcatattaattacaaagaaaaagataataagtatacaatagaaaaatcagtagtaatcaacttaaccaaatgattaaaattaatcgccctagtaataagaaaagtagacatcatgagccttcttgtatgatgcaaggagaatatgacttttgaaatatttataccaaaacgcataactgaatctaatcataaggaaacatcagacacatccaaactgagatgtaatttacagaataactggcttgcactcttcaaaaatgtcattatcttgcatgataaagagagattgagattaaaggacattaaagagacatgtgatcctatgctttctatttactataataaatgttatagggacaaggaggaaaatttgaaaaaatgtctacgcagttttaaaatacatacaagaatatttgatgcttctcccttcagaagataagcctaattcccctatccattagtgtgatttgtactttgtgactcacttctaactaatagatagtggtagaaatagagatgtcacttcccagactagataattaaatagcttcacccttgctctctctcctagatcgtgcacactgaggaagacagacaacaaataactctgcggatagatcaacatagtgaggaactgagttctccaaacagcagctacatgagtgagccattctgcaaatgaatcataagcccaggcaagcctttatgtgacaactgtttgaagataaccatacataaagacttgatccaaaaccattcaactaaatcactccagattcttgacccaccaaaaaaaatgtgagataagtgttttgttttgttcgagttgttttttatttctttaattttggtaatatatatataacaaaattcaccattttagccatttttaagtgtataatttaattggcatctagtaccctgatatttttttactgccatcaccaccacccatcaaaagaactcttttctttttaatttgaaaagtattactgttaattttacatcaaatgattcataaaatttaccagtgcagtcatctactccgggcttttttatttttttccttgagaaggttttgattacacatttaatatctttactaattacaggtttattcagattttctatttcttcatgacttattcttagtagattgcatgtttctacaaatttgtccatttcattaagattatccaatttgttggcatacaattgctggtagtactttcttataatccttttcattgatgtaaaataagtagtaatattccctcttttatttctaattttagttatttgaatcttcttttcttcccttagtttgtttagctaacggttgtcaacattcttgctcttttcaaagaaccagttattggttttgttgaatttctctattgtttttctactatctattttgtttatttctgttgtaatatttattattttcttacttctagatttgggttttgtttgttcttctttttctagttccttgagatgtaaatttagatggttgatttgagatatttcttccttcttataaatatttatagctacaaacttccctttaacactgcttttactgcctcccacaagttgttatctaatgcatttttatcttcattactcttgagatattttttccaatttcctctgtgactccttctttttcccattggtggtttgagtgtattgtttaatttacacatatttttgtgatttcctgttttctttttgccattgatttctaccttcaattcattgtgatcagaaaatataatttgtatgattttaatcattctaaatttattaagttttgcttattacctaatatatggtctatcctagagaaaattccatatgcacttgagaaaaatgtgtattctcctattgttgggcagtgttctatatatgactgttaagtcacattggtgtatacagttgttcaagtcctgtgtttctctgatctggctggctgttctatccattattgaaagtggaaaattcaagtctcctactattattgtggagctttctatttctctttttaattctgtcagtgtttgcttcaactgtttagtagctctgatgtttgctgcatatatctttataattattacatcttcttggtgatctgactcttttatcactatataatgtccttcttttaacctttaacaattttttacttaaaatatattttgtctgatattaatatagccatgtttgttctatttcaactactatatgcatggaatagctttcattttcaatctatgcatgtccttagaactaaagtgtgtctcttacagaaagcatatagttggattttattttttaatacaatccactaatatatgtcttttgatggggaggaggttgtccacaagtgtttgttttgttttgttttgaaccactgtattttggagtaatcacagcaatagaaaactaacacaatacctgtagattagttaacagtatcatatcaatgttaatttcctgatttttataattatactatggttatgaaaaacacattattagtttaagggaaatcatatgaatgtatcttcagggttaagagatataatgcctcaaattttccctaaatgtttcataaagacagcaagatgacaatgcaatgtggtaaaatgttaactgctggcaaaagagggtgaaagtaaattaaattctttgttactattattgcaactttgctttaggtctaaaattatgctacaattttaaagattaaataaaacttaatttggagactacaaattaaggacatattagaatccacagtggaaatatagcactgacactaacttttagcttctctgggtttccagaagaaaagaagactgaaaaatgaatagaggtaatatacagatagacactcactgaatattttacagaattgaggaaagatattaatatgaagattaagtaacctaaaattcaaaaaatttaaattaaaggaaattaatgcctggacgtatagtacaaatgcatgacactaaagccaatgaaaaaatattaaatattgcaggaggaaagattaccttcttcaaagacagcaatagcttgacagctgacttatatacttttttttccttttttatctttttttttttctttgagacaaaatctcactcaggctggagtgcaatgacacaatcatagctaaatgcagccttgaactcctgggatcaagtcatcttcccaactcagcctgtcgagtaactgggactataggtgcatgcaaccacagccagcaatttttttgtattttttgtagatacaaggttttgccatgttgcccaggctgatcttaaactcctgggctcaagcaatccacctgcctcagcctgccaaactgctgggattacaggcatgagccaccatgcttggccaatggctgacttctgaattgcaaagatgatgaccagagtccagtgtcgtaataggttgaatgtaacaaaataaaataactggtaacttacaatcatatacttaaaaaaatggctttcaatgaggagaataaaataaagaccttcatagacaaacaaaaattgagcttttgctaccaacagataattacaaagggacatcttaaatgttctgcaggaggaagtaaataatcctggaagaaaaatgtcagatagaaaaaggaataatgagcaacgtcagtgaccaatatgcttattcatgtatattaaacaaaaatgaagttgtcatcgggattaaaaactgtaatggaacaaaaatatataaaaattgcatgtaaaataattgtagttaagttattttgagcacctatattattgtgaaagtgaataaagattaaaactgacactttgatgagtttatgcatcataactgttctagtgtttatattagaaattaaaatatggttattaattttaccatattaataaaacatggttattaataacagaaacatgaatgagaataattaattcaaaatatctaagaaatacacaaagataaaagggattagataaataaaaaacaaaaataacagtgaagacataataaaaatatggtagcatttgtaataaatgtaaatagactaattacctcagctaaaatacaaaattcaaagctgtggctgagtggcagagaagcagtatggttccattaatgtacatttcaaaaatttataatttatatatctcacagtaaacatatactggtaaaaatgtagcctaaaatcataataaaaagcaaaataatgataataaaattcaaaagaaaagttatctctgagaagtcagagaaagggattggattaaggaagaacatacttgctaattcaggatatgttaattttttttccttacactagattctaggcataatggttatgcattgtatactttcacctacccatcatatattttaaaatgtttgtttccctccatagtcaataaaaccaataaaaaagaggtagcatcaaaaataaaagattttagatgaatatagaatgtattgtatctctggtctgatgctaccttttctgtcatcttgagaaggagagctgtctttgattgatgaaccagactgaatgaatacagcactgcaaaaactaaacctggggcaaatctagatgaccattaacctctgccaggtagttaaatgttgtagactgcaaaaatgtcccaatttctcaccactgcctttatagtgtgaccttgcaactacctctatccagaggtggagtctatttgtctatgtcttgtttctgggatgggcttgtaacctgctttgaccaataagatgcagaaaaatatatatatatatatgctgggtcagttctgagcactggtctcaagaaattgtaaatactattctttgtcttgaaatcctgctatccattctgtgaatttgtctaagctaccccattgtatgatgagagatatgtgacccagtcactcctgttgtatctgtcagaaagttgaaaataggtgaatgaggccatcctggagtagccagccttggcctgccctacagttgacttcatgtgagtaagtgagctcaggtacaatactgaatctaggatcatcaaaactgcctgcccattgaccggcccattgacaataaatgattgttgtattaagcatgtaagtttgggggttaatcaaagcagatattaatcagaaataaatggattctacaactttataagcactatttccttcctgttgctcttttgttgtgaaagtactcagaaatgttaacctggatataattctgtaaacatattgaaacatgaagtggccatgaatatttctattgcatttaaaatgtccccattttgaaaaatttgagacatggaaatcttcaaaaatgatagatttaaagttacatttttaaaaagccaatgggatagagtttcttaaggataaaacagaaaaactcaagagacacgcacaggttaggaaacagatgagctgattttccttctttcaatttgtggtgctgtgaaaaccttgtactatggacccacagtattcatgagaacaagagaacaggggtggcaggaggtatttttaacaaagtcatcaaggtactcatgaggatggcatattttccatgaacaagcagcataacttagtactttgctcaaacgccacacacagcataatggaaatggcactttcagaatactgattctcccacagggaactcaacagtgaactaggaaaagatcacaggctctgacagttgattggtgaattaattagatgttgaacttctttaatgctatggtaaattacatgtggaacatgcactcagagtcataaaaagattccaaggatgctaggtgtcacacaacagtagggcaaaatgtaatcagaatccagagcggggcccaatgcaaatcggtttaccagaggcctgctgagattaatcttacttgtatccttttctgaggggaaaatttggagtgagtggcacaattatttaggctacaagcaaagggaattgatgcttttttattattctgtctaaattgttcttgacacagacttagaatgttaatatttatcaactttttacccacctttacagtcccacctcctcatgtaatctatcaagtgataggagattttgtagaaaaaaccagtgagagggcgattttttattctgctgtgaccacattactgtcattgctgcctatatgctctcagaaaatacttattgttggcctttgttgctaaatacatgttggcatgtaatatattgttcttatctattgtgtgatcttaggcaacttaatctctttagccctcaatttcttcatttgcagaatggggacaatgacagtattcattttgtagcgctataatgttaattaattatgtaaatattgcaaagtacttaaaatagtgcccggcacatggcaagtgttataaaagttgctgaatgaatattgaaacaaaaacaatgttcacctatttccaaagagatccatcaccatttaaacttctgaccattcagcaaaaaagactttgatttccaacattgtgagtaagcaaaaatgagcctttccttgggaaaatgcagctttcatagaggtaaatagaagaatattaacaaagtttcacacatcaagggtagatgtgtgagggttcaagggagttttacttttcttctccattatcttctgtaactgggaggatatggaaataaatatagattaggaattataactgtcagaccaaaaaaagtcatctaaattcatttcaagcttcttttctgccgacaagtagatgctgctgctaacatattgaggtgcagttgtatttttttttgttgttgttggtggggaacggagtctcactctgttgcccaggctggagtgcagtggtgccatctcggctcgctgcaacctctgctgcctgggttcaagcaattctcctgtctcagcctcctgagtagctgggactacaggtgccggccaacatgcctggctaatttttgtatttctagtagagatggggtatcaccatattggtcatgctgggcttgaactcctgacctcagatgatccacctgccttggtctccaaaagtgctgggattacaggcgtgagccaccgcatccggcctgcagttgtattctgattagatatcctgcatgccctgtgagaatggcatgcaacaaaggcaaacaacaattcactgcaattcaactcttaccatgagcaaaatactgggaaaggccctaaagaaaatgcaaaccaaaaactggaataagttcctctgcttcatatctccaaagtatgtattaataatattttaatatctttcaacaaaatataagtgactgaaaatatatatgggtatataaagaacacataaaccatttaaaaaggttatttttaattgtagctcccttcacttcccctgtctgccgtatgctgaagatgactggtgagtcatgacaagtcttgcactgctgaaaaaatgcataaggattagtatggggttgagttgagataaacacgaaaagtggaccaatattcctggaagaatcaacttgagattatatatgaattattatacctaaaaaggcttgagttatttaagtcccttattaagactgatgatacaacaatattcatgaggaacaaaaatgttatctatagataatatgagatatttggtaaatagaagtaagaaattaaatatttatatcgagagaggatattgtgtcctgctttattcttaacaggatttgggatggtattataagttggttttgatgcagaataaaaatatgtgaggaaaaaaattaaaacagataaaataatgctagggataaaattagtacctactagaaattaggtaagactatggctaagggaatctaggatgattggacttcttcctcagcccacagtactgctttttttgttacttctaggggagctatctgcaaggaacaatgacaaacagtctttgagacctaaatgctaatatagagagctgtgataaatggggctggaaccacagtctaggttagaagcctgagagacctctactactcactcgcaatttaagcccacatagtagattttacgttgatcagattggatgccttcaagggaaaaatagtcagagagagaatagggagtaagaccttggtcaatttaacattttgagataagataaaaaggagaagaatgtattagaaagaaggatgactgggcttctcctgtggaagggcctttcagtttgaaaggaaaagagagaaacatacacaaattttcatcaaatggctatcgcacagaaccaaggaatctctccaatgagatcatcatatcctcttcttggggactagatttttttgtctcccagaatgctctttctgcagtaattatacagatattccagatattgaccttgttataattcaggtcccagcttaaaatatatctacattgacaacacaattcaaagtagccagctcttcaagctctcaccttgctttacttttaactgagcacttattactgaatattttctttcacatatttttgttattaacggactccacaccaaaactacccatctagaacataaggtctatgacaacaaggacttcatctgtattatttatgtatgtgtttacatatatatatatatatatatatatatatatatatatatatatgttataagcgaacacaataggtactcaataaagatttagcaaataaatacattcatgaaaatgtgttttagtaggccaaaaaaggtggtggaaaaagagatgcttcttgagaacttaatattgacaatagctgacatttatcaagagtgttaatcttcagaacaaaaccataaaataaacactgaagagaaaaatgcagtggcaacctgatcaaatctactctagatctaaataaaagatatgggttccatacctagactgatctcagagcagctatgtttcactaccacgtatgccattagattatgtttacatgccaaatatgtgcaacacatttagttctgaaattccttgtattccacacacacacatgcaaataaatctattacatgatccaatagaatcataagttaaaaataaatgagttgccctaaaaaaccttgctatttggagtggtgagactgaaggaaaatatgtaccatggtctccttaatggagaaacttcataaaggatgaagaaaaacacaccatgaattacaccatgaataatattactaaatgcaagcatgaacttccagcatttataatacaaatcagtgtaagttgatagcattgattcaagttttggtttagtgaaagcacttctatagagaaaatataaagcttttaatagccttgtttaaacaactggtaaaatttaagctatgcagatgaatgaaaatgattcatatcattcaggcaatcattcctcagtattatttctgacacctacattgatgatcaatattggctggtagaagttatgatgtatatattttatgatgagtaccagaccatagatatttggtgttacttttttttttttttttttgagatggagtttcattcttgttgcccaggctggagtgcaatggcgcgatctcggctcactgcaacctccgcctctgggttcaagcgattctcctgcctcagcctcctgagtagctgggattacacacatgcaccacgacacccggctaatttttgtatttttagtagagacggggtttcaccatcttggccaggctggtctcgaactcctgacctcaggtgatcgaccctcctcggcctcccaaaatgttgggattacaggtgtgagtcactgcgcccggcttagtgttactttttaagaatgtattcatgggtttgaaagcatgcataattttggtaacttctcagaagctgatatgcttaatcagaatatatacctgaacatgcactattgtacttctgcagagacatacaaatggaaatatatataaccaatgtcaagactttcctttgaaaataactccggttttatccaatacatgaaaagaagtctgattaatggccaacactttatccaatctagaaccctatatcactagaaaataataagtaaaatacccataaaatatttgacattaatctatgctttaaaatggctctaaaaggtactcctagtcaactaaataattgttaggctctagttcaaggtcagttaaatggcaaagcatatattctgtaatagtttatttgaaatcactctttcctaccatccttggttgtactataagcctcaatggcatcatgtggtgagcagtacttttatcctttttttcacagactagtaaactaagcctcagagacctcatataaattgaaaaagagacatatccagaaagtagagacccaggaatactggatctggatctgggattgtaaccactgaaatatttggccttacttttgtcagtttttctcagctagataaaactaatgcatgtttaagcacagtacatagttggcttcaggttcatatcctagtaacagaatgaaaatacaacaattatagcattttttaaaaaaatattctttatattaaaatcactttaaattaagaaaacatatagcttaaaaagtatcacttagtattaaataaaatgtatataaaggctatttctccacataaaagatcatcaacgacttatagaataataaaaaagatgtgaagtgttatttcttcaaacactggttgacaaatgcatgctccgtgagaagtacttggctgatcaaacaaacacaccaactattatctctagagtcagtagtcaattattcatgtaacagcccactctgtttatatagaaattgtaattttcacagttttttctcactttaactaaacccatgtaatattatttttaaaacctttctcatattgggtcacatttcatccaaatgtctgatggcctcccttagaaccacagctataaaatctaatctccttttcacctgacatcatttaaaacatttacagagagtcaccatcatctcttacacttttaaattttactttctccaaacaagtcatacctaatcctctcaaaccttcaaattcccactgggcacggtggctcacgcttgtaatcccagcattttgggatgccatggcaagtggatcatttgaggtcaggagttcaagagcagtctggccaacatgatgaaaccacatctccactaaaaattcaaaaattagctgggcatggtactgcatgcctgtagtcccagctactcaggggactgaggcatgagaattgcttgaacccagttggcggaggttgcagtgagccgagattgtgccactgcactccagcctgggaaacagagtgagcctctgtcaaaacaaaaacaaaaacaaaaacaaaacacaaaaactttcaaattcccaaattatgatgtctgttctgggcagttatccttgggtttataaatgttcttcttcaactgtggactgagctaacagttttgggcatgttcttctatacacactgctgacctattttacagcttgttcaatgtgcctgtattgtcatctacattccaagtgcatgttagtcatcacactggtgacaccttctcaacgtgaacctatgactctttggacaacataaaatgtctctgctatattcacaatttttctagctcttaactaatatcatggatttttttttaatattctggatggctttagaattgagaaaataatctttaaaaccccaccaaagattttgagaaaataaagacctttatttttcttggagattagcaataaaataataggcaaataattcagtacccgaggtggagtggtagtaggggaaggttaaaatctccttttcttattttaaatgaaatcttatctgtaggcaaaagaaaaggaaccagtgctgtggggtgaagaggatgaaagtggaagtgaaaatgaacttcataattagaacaagaacctagaggatattgacctatcatttcactctccctatgttacttgccttaaacttcggttaaaataaagttctcagtgcagaaaaatttgcatatggatttgattttttttaaatcccataaaagtgaaacaaaatattaatttttaaataacttctaataatttcttagattaataatgtgtttcactttcagctgataaaaaaaaaacctcctaactatacgctctgaaagtacatctaaaaacaactagtgtccattgggttcacaatcagagatatattgtagaatgtcacataaattcaagcaggaaaaaaaggttttaatttaccaggattacttaagctgactaaagaaactgtgaaagagtattctcagatatattcaaaaaagcaattacatttcactgtgtcttgaaatcatttcaaatttatcatattttaagtgccattaaatgttctttttgattggaagagccctataaatgacaggcagttttgtgctgtgcaaattagcagtttcccctaattcttttcacaagattgtcaatttttagttattatctcatccaagttcacataatggagactcttgaaattatgaaccatatgcctcatggtgcaattcacaatttaaattttatcaatgatgcctttaatttttaaaaaatttgaccaatattgtgtattttgtacctgtttaatttaccctagttaccccttaaatatatttattttttatattttaatctatatttctgcatatgaagaatacaagttttctttgaaccccaagatcccatcctagactaatgtgtacgtgtatttgtgtttctatgtatgtattcaccattcctacctgggtaatcacctatgtacaactccctgcttcctggctgttattgtttgagacaagtggacttggctgaaagcaagcatattccctttttagaaaacttcttttttttcagaagaaaattttgtattagtgcttcatttcttagccttcatgaggacacaagtgatgcagttccatatacctttctttagttcaattaaataagacatttcttaacagttatgagctaaacttaatcttcctgggcaccactggacttctttgttttttttctctgtaatttcagatagtaaaaagaaaacacagttgtaaatgccacaatatagtttccaacaattggaagaaatatgaaaatacaaaaacaaaaatacccattgtgatgcttggtaagtggtcactagcagagaaggcaaagataaagaaactaacaagacattccaagaaaaggaagtcactcccatcacacatacacaagccaccgtaagggccattagtactagtgggggaaataaaaagaaaaggaactcagctttcatttaaaatgtacagtacctcctatataaatttaaatttatatacctcttaaatcatgacttttattgtatgattgtatgtattaataaagaaacatcttcagtcaccgcactttcaaatgtatattagaacatgctaaaatggtgttttaatggataaaaatgacattaagcaaacagaaacagtatacagactgtcagaaacatatcatcacatatatagtagctttacagagaaaaatttataaacccagcagtggattgtcaacatgccaataacttcctccagtcactttggggctaacaaattagaggaactaattaaatatttgattaaattaattaaatatatgattaaataaaattatccacttccttggtataataaaaataagttttaaaataaaaaatcctatttcatttcatcctgaaaatacaattgaaataaatttggcatttacctcatgtgattaaaaatccactggacactttagaagtgcaggcagctcatgatacagctttctgatggcactcatcaattcctacaaataacaagagggtgaaagagaatattcagagcaatatatgtctttgtaaaatgatggtgattagctatgaaatttttattatcactctactgcctttttaaaaatacctgactatatattgctgttataatagcttttgttaaatgtgcaatatagcaatgaaaattatgtctgtctgggacttccgaggtactaaaatagaccctagattatgacatactgcaaaacatcaaaccacacaatagcatgttattttactgagaaaggctgttggattataaaaaccaaataatttgtaaatgaaatgttttcttatgtgcattaccacatcaaatcatttttctagtcatgatgctaagttataagaagtagagggtttagcttttaccactggctactttaaccaaattttagcaaatatccttactttatatctcatagatttcccagggaagagccataaaatgtaggaaatgatggttatccatctgataagttaatatgcaatatggtaggtttaaacttatcaaatgaatggctatcatttcctacattttatgaatcttcctcagggagacatagaaaataaaatacatatgcttgctaaaataacaagatactatatagtatatacagtataaaattatatagcaactcaaacttttacagtttcaattatctggggaagaaacttttcaaaaaagcattattttctcccatctacttgataaaagagaattaaaatgataagcaagatagatgagtattttgttgctgcatattgtcactttcccatgtttcccatacacaaatatgtagggtgataactgtatagcatcccttttctacatgcccattactccaagcctcacacatgttaaattcaggcacaaatctcagtgaatcagcaccatggacgtctgctcgacctttcccctctgcacatcgctgacccttcctataaatctctcactctttaggtgacaaaaaaagtcagtatagaataaaaagggatggtagaaagatggtgctcctctgatgataatagcaaagacctaaataaacctaaataaataaagacctaaataaacctaaatgctcatcagtggcagattggataaacaaaatgtggtacatatcaacacaaaattctatgcagccataaaaaagaaaaagattatgacctttttagcaacatggacagagctggaggccattatcttaagcaaaaaaaaaaaaaaaaaaaatacaggaacagaaaaccacataccacatgttctcacttataagtggaagctaaacaatgagaatacacggatacaaagaaagaaactggggtctatttgagagtggagggtgggaggagggaaagaatcaaaaaattacgtatcacgtactatgcctattcatcaggtgacgaaataacccgtacaagaagcccatgtgacacgcatttccctatataacaaacctgaacgtgtaccccaaacctaaaataagagttaaaaaaaagtagcactcaactaagaagtataactttgtcaaggcacatatagaagattggaacataaagacatgagcatttccttatcacaggagaagtcatataagttcatgctttaagtgttggatttataaatattatattatcatttcaatttttctaaaagctactatcagaaattaaatatatatatttcttattatgtgctttgtgtcttttgttcggaggtattataactcactttgaggagaagatgctttatagccaaataaattcagtagagtgaataacatgtcctattaggttctggaaagaaatcagaagctacacttccattagggggaaacagacttagaaagaaagtggcaaccacttttagcaagaaagggagcattcatatgtgcagaatagtaggacactaggcagaaaaaccctaaaacaccaagaatggttgcattgcattttacgaatttctgcatatgttgcagcatcattgctttcctgagaatgcttcaacttctccaatgcctggttgttttctaaatctgtatagtattcactttttttgtgccctgttttattttataatttataaattcacagcaaacaactctaactctattggaagctcaccgtaacaagtgctgtgataggcactttcatatgcatatctcatttaatcaacaagatatgtacactgtcacactttgccaccattggcttacatattggatatctcagcatacaaatcttaaattataagttgtatgttccatgaaataaagtgctgtttcctactcattataagttttaagttccatatctttaatttgattaaagtgctttctgaatgtctaaagtgtttattgagtgttttaaaatatatatggaatgtgaaaattattcaactaaatccatgatctatttgtttgaaatgtgaattttagcattacaatggagagaatcctgaaacctcataagatcttttgtttatgatcatatttatagatcagatacatgatatctttgaggaagaagaaatgtacattttatttacaaccacaaaccagaaattcctaattccttggaagaaaacaattttaactaagactcaatattatttgagggatgtgaaaaataagttatgttggtgaagtaaagagtatgaatgcaaaagaagaaacacaataaacagtattaaaaggagactatttttctaattagaaaactaaatggtcaagtgagtgaataaagaagttgggtgaaatgtgttgataaaacttacaatagcattgtgtttgtagggtattttttaaaggggagtttaagtaatacaattttctaagtagaaattccttcagagttttgtgggttaataataaaataatggataaaagaaatcaaagctgtaattcctaaaaaagtaaatcgaagtttacagtgatggggcatcacattctgtattaaatgataacaccagatgagaagccaggcccagatgtaatcctagatcatgtgatttattagattcttctcaccaaaatgatttagagaaacagcagaaagatattagtaatagaataaatattgttcaggccaggtgtggtggctcatgtctgtaatcccagcactttgggaggccgaggtgggtggatcacctgaggtcagcagtttgagaccagcctggccaacacagagaaacctcgtctctactaaaaataaaaacattagtgagttgtggtggcacgtgcctgtaattccagctacttgggaggctgaggtagaagaatcgcttgaacccgggaggcgcaagttgcagtgagccaagatcacgccactacactccaccctgggaaacagagtgagactctgtctcgatcatcatcatcatcatcatcatcatcatcatcatcataaatattgttcagaggataaaagaaaaatatgaaaaatcagtttcataagaattggtagatgtagctcaactgagctgggacaagactgagaacaaaaacgtaagaagcaataccctcaatactttaatcgacacaattcaaggtaagtgataacgtttataaacagaagacaaaaagtaggaatttgatgaacatgtattttcaagcagttaacagacaaaagatacccccaaaccatgtgtaaaagaaaaaataaaaaaaaaatccatccatatgcttagtatggtcaataaaatctaaagtagtcagtaaacctaattaaaaaaaaatacagatccagtctcatagtcttcatgatataatggtgaagagagaaaacaatgttaaagagaggtgaacatgctgtaacagtaactatagaggattaatatttttaaactacaaacaggcatgaattactcctcattcaaacaaacgtgaccctaacttcaaggctaggaatatgtaaatgcaatttataaaataataactgtggctctgctgacttcttatacaataatgtaataatctttaaggataaacaatactttaaattgattcaaactggagtaagcatatcatttaggtttatagtgatattctaggaataatttgaaaacgaaggaaacgatctccctagaactttcagtgctacttgaagttttacaaggaaaaatatcaacctacatttgaatgtttctaggtagaaatagtctgttgttattaattatgtctctacaagtgtttcagataaaagacttgaaaacccctgctttaaataaaaaggtacacattttttaccattttctctttttctaccacattttatagtgattctcacactttatttcaaggtggggaaaaagggagaatacttttccagagaaaacatatactatatgacatcttctctcaaaaggaaatgaatcctctaatttatttaaatatttatgattattgatactttatatacagtagtctagagcattaacacacgggacaacacaggctttaacacatgatgcagaactcatcatggtcaaaaggtctggctgttaaatttcttggatgattgcataaggctaataacacagcatcactaaaggatcatccaacagatcggcagcctctcacctgaagctccattaatattttggagagtgtagaatgtgacctacagaaatggtctacactacattggggaaagacggtctctcatacatccagtagaccaaatattttgaattgttatatgtaatctgcatcttctgtcatattatgctttttcttttcagttacagaaggaagaagagaaataaaacgcctactatgtacctagatatgatacctagtgctttaaaaacattatttaatttattcctcaagaaataaattatgtgagaaaggcggtattatcccacttcacatatatataactgaggcttagaaagtgatgcatttattttctcacgattacagatctttccattatttatcactgcctttaaagtttcaaaactgaatggctttggacatggaagtagtgggagcaaaggttaaattgaatgcaatggtacctaataaaacttgaaacctgtaatcattgcagttgatcaaagttggatgattcagtgttttattttcaatatttcgtgattgttaaataaaagtcaagttctaaataaaagcttgctctttcttttatttgttgttttggctttttgaaaggatggttattaaaatgcaatataatctgtttccctaatgaatattaacttttaaacaaacaaaagtttataaaattaatattaagttttaaatatacaaaagtttataaaaatataacattttgcggtggctcacgcctgtaatcctagtactttgggaggctgagacgagcagatcacctgaggtcaggagtttgagaccagcctggacaacatggtgaaaccctgtctctactaaacatacaaaaattagccaggtgtggtggcaggcacatgtaatcctagctactcgggaggctgaggcaggagaattgcttgaacctgggaggcagaggttgcagtgagccgagatcatgccactgcactccagcctgggtaacagagcaagactccatttcaaaaaaaaagaaaaaaaaatgtgtgtgtgtgtatgtatatatatatatatatatacatacacacacacacacacacacacagatatatatgtatatatacatttaaaaataacattttaaataaggcattttacatgaaatctagctgtttcaattaataatatgatattcctaacaaaatgacataatagaaatgacatttcctcggaacttatatttatttaatattacttttccattagaatagaaaaactgaaacatggcattaattccattttaattataatataataaaatagctttataaattcttaattttaatagcataaaatagttatgctaatattaaagattaagttatatgatgccaaattttaagacagcaaattagctataccattcgctggagcaatagagagaagacaggaacataggaaaaatatattcaatgaataatttgactctgtccttcactgaactgcttaatattaaaaacaaacatttttccaacttaaaaaaaagcacaatgacagtactacttgattgactctctctatacatgccacctgaaacatgttgtcataaaccataccacaagagaatcttacatttttactacactaaattctaaatcctattttagtatagaatgcatacagcctgttcttcaataaataaatccagtaataaaacaataaaagaaggcattttgactcttcttttttaagttgcctgcttttaaaacatgtgttgttggtggtggtgttggtggtggtggtggctctaagatttacgaggacttcactgtggattgctttggtggcttacatttccttttgttcttgccctttttagagaggtacataattggatattggcattttatttgctttaatcttttgaaaacccaagagtgaaagccatacatccttgtgtttttattaggttaatcaagttaaaaattgtcattgtgtttaaacttttaaaagttgaaattctcctatggctacacattttcttaagtggatggcatattttgtttggtcttaaaacatatgtttataaactctatctctttaaattacacacaaacaaacacatacagaaaactactgtgtcttgtacaacattagcaaaataatagcgataattaacggttactgaatgctttccgtatgctaggcactgttctaagtacattacatttatttgcatgcctaattctcacaacagtccaaatatattattttatcccaattgaaagttaaaaagttgtggcacagagggattaactaaccaggcaagtaaagagctaacatttaaaccaaggtggtttgacttcagagtgtgagctactaagaactgctacactatctctgattaaaagataccaataatggcattcggataacaattgtgcggacatgttccttaaccaaaaaatatcaaatcattaaaaatgcgatagagtggcagaaatagttgagtgagaaacaacagagctgaagctatctgaaggtatgggctattcctgcttactttatctcatactcacaatattggtagagcatctaagacaaagcaagccagtatccaagaaatatttgttgcgtgactgatggataaagaaggaggcttatatgagtactggtatttctgcacatcttggatgaaagtgcaaacttcacatactagtccagattcagcacatatcttcagtggattcacactctcaccttcaactatactgtctaacgctctcacataatcccttgagccctggccacctgtgttccatttacaactgcccatattcatattcattaaagccctttatgctacagtcatttaataaactgctctaatgaaaaaatccattgtaatttcatttaatataggtaattttaacacaggtttttgacagaaaatatcataattcaggatagtaattctaatggtaggaagatcaggcagtaacaccataaaccagaaatccaaaccgagaaaccaataccctgggatgtcctgagttcctccttctctctcacctgcccagaagcatcccgaatccatctacatgttatcattattactgccacccccactccaagctgttacctttctcctggattattctgatggtctcctaactagtctttcttcttgagctcctgccctttcaatctattctctaccttccaacgaaaattatcttaaaatatcaattggatcatgtctttccacaaatgacttcctgttgtgctttgaatattaaaaaaaaaaaaaaaactttatttttttaatgtttaatctaaaaggcctggcctgatctgtcacagtcaaactttccagccccaccttctggcctgctctcccactctcaccaggctccatctgtgctgaaagtttcattctatttcaaagcccttacatgggctgttggcactgttagagcaatcctctttccattccttgcttagtcatttccttctttcttcaggtatcagcttaaatgccccttccaaatgaatacttctttctaaatggcagtgctttttgatattctgtttggcttcctgaagttttcatccctgtcaatttttcataatagagtggtttcgagcgcaagatttatatccagacttactgagtttaaatcttgagtgcatcgcttgctagactgcatgatgttaggaaagctgtaatccttgttatgctctagtttccttatctagaaaatcagatacaatatcatttacctaaagggatggttgtgaggactgagtttatacaactaagcactcagaacagggctttgcacatcaaatactcaataaatggaactgtcattactaagtgaaattatatttatttgagtaatcttttgattatattttgctttcctgataaacatgcaaacttaagatgagctggagctctggctatattgttacccaaccacaaacttggtgcctcaacagtactttacttagaaaaactcattacatatttatttaattaatcaggtaaataaatgtgtgaatctataaatacatagaataaataattttaaaataaaatattacagatcagcgattttggggatggtggatctttgatatgcacaaaatcatacaatatgtggcagtcggctttggaaggttccctggatctagggaaaattttgatattgtgttcactcagctgtttctcaactcaaagatatttgagaaatgactgtaaaacacctagagaaattcttggcgggtcatctcatcttctttcattactggcaaatttggttgttagtgagtacaaaaactttgatgactttcagaaaaaaaattctaatataatatttctaagttttaaagaaatcttttcaccattatcaaagctacaatacagttccttggggccagactttaatccaagaaaatctcaaaactcagcttcccacatgatttatcttctaatcttctaactttggttctgatttcttagcattgctgttttgtagatgtcatcttatgatgcataatcaataaggatgtcttgctgatgcttttcagaaaactattgctatcccaatcctcaaaacggaaagtataagattccagatacctagagttcctagcccttaaaaactagaaatagcacttttttgaggtaggactggcatacgaaaagctgtacatatttaatgtatacaacttcatgagtttgaagataactttacacttgtgaaacaaccatcacctcacatatacaaataatagtaataaagagggtttataatttttaataattatatttaaatgtagatatggagataaaaacatgaaaagaaagtgttatactaaagcctaatgagttgctttgtcctgctttttcaagaatattaatttggtcctttttaaacatttttatttatgtattcatttatattaattgataaaaattacatatagttatcaagtacatgtttcaaaatatgtatacactgtggaatggctaatgtataatagtataattactatatacatttcatttcttcacatacttaccgtttttttttgtggtgaaagcatttaaaatctattctcttagcaatttccagatataattattggattatatctggaattatattctaggtgactgtgttattgactatggtcatcacattgtacattcaaactctgcaactaatttctcctacctaactgaaatctagtgtaccttgaccaatatctcctcaaccctgccctgcacccaccacacctgctctctacttctgagttccatttttttagatttcacatataagtgagatcatgatatactggtatttctgtgcctggcttatttcacttaacacgatgtccctcaggctcatcaatgctgttgcatatgacagaatttccttcttttaagagactgggtagtattctgttgtgtatatttatattttctttattcattcatctgatgagaaacaattaagttgattccatatcttggccattgtgaataatactgcaataaacatgagatgcaggcatctcttcaacatactgattttatttccttgggatatatacccagtagtaggatagctgcatcatatggtaattctatttttaattttttcataaaccatcatactgtattccataatggctgtgctaatttatatttccaacaacagtatacagggattacgtttctccacaacctcttcaacacttgttatctgtcatctttttttatcaggtgttatctttttattttaacaggtgtgaggtgttagctcattgtggctttaacttgcttttatttgataattagtgattgcgagcattttttctataactgttcactatttatatgccttattttgagaaatgtctgttcagatcctttgcccatttttaaatcaggttatttgttgtcctgctattgagttttgtgaattctttatgcatttttgacattaaacccttgtcagatatgtggcttgtaaatattactctgttcattgtttccttggctgtgcggaaggttttcagttttatataacaccattagtttattttccctcttgttacttatactttagggattatatcttaaaaatcattgcccagattagtgtcatggaacttttccatgtcttcttcaagtagttttgaagtttcacgtcttatatgaaagtctttaatgcaatttaagttgatttttgtatatagtgttggataagggtctaaattcactcttgcatgcagttagttccctggaaactaactgcatgcaacttagttccagttggtaccctggactaacttagttccagttagtagcctggaaaaattcatgtatcacacaccctgctatgccagatgcactagaaagtcttttcctgaaaaagttaattggcggttggtaaccagaaggttctaaagggcagctctttttaacttcttcctctgagaaggggcaatgatagcaaaaatccaaccccatactgtggtgtcctcatagaagccattacaactggcagtgcaaagtttcttatcaagctgctcctactgtggctttagatcttttatagaatgcaaacagacaagcagggatgtggaaaatgaaacaaacaaacacacaaaaaagaagtagtaaggaaaaagggatatgggaatgggtgaaatgtctccaagaagaaaagggacagctggctcctggaactgatgacccacacttagagggttaaagctacactggctaaatcaattcctggactagtctcatatctctgcagatgtaccatattatattcagagtattttcccaaactgtgttcctttacctataatcctaaaatagttcagcctaagtactattactgagtactaagtacttgtttggagaattttgaaagaaaaatctacagcagagaataggaagtagaatacagactagagagaaataggctctcttaagtgaaagcttatgattcaatcaaccaactataaaataattttagtctaaatggacccataaaatattctcaaatcatatttgaacacatcaagaagcagagattcagagaggtagagtgacttactgacagcaagctgaaatggcagcagaactttggcttccagatcctacatagtaagtgttttctgatttgtttcacccttagagttgccaatgcttgggcatagcggtgagatttctattcagtgctttcctggaattgctgattcttgatcctatatgctgccctttataaaaaatggatctgtaaacttatatcagtctctttcaatgacactgttcagtcacttgaacactggagcattactgaagccctgaaaaggatttggcagatggaaaaaagctcatggaacctaactattaacacagtggtctttcctgaacctgttccgcattcactggactgtgcctgacttgcatatctgtggccttgtcaaatatttgccttaaatttcacttcttgcaaaataatctgttaatgaaggggtcataaccaaagtcttgattcatttttgtacaggttatcttttagaccttctacatggtttttattaacacaggatattgcttaggaatcttgaggaggttttaatttactttcctaagacttttttatatcatttttcattttgccaggtacttttataagacaatttcacgattatagatgtaattctgtagtcacaagtctatatattgtttttgcagcaatatgatttgaaattgatgtaaaattatggcaattttggtcattctaaatgtattgtcatatatttaaaataatttgcaaggggttagtgaactacattaattatggatattgatatgcttttagattattttgaatatatttaataaaaggaatttatgcagagttaaataataggaagaatttcatattaaaacataattatagaaagttggttctctctatggcagatactttttttattatttttaaaacacaggaattgaaaagaaattcaaattttaaccaaagccacaatgagatgtctttgaatgaaggataagaaaacccatattctctgatggtaagtattcccactttccctgtccttaagtaatgattttaagtattcccactttccctgtcctgagataataatagaaagaacctcacagctaaacatactatagcctatttttggtattttttgcttgtatttatatgttttcttaatgtacccaaatctttgcccagtacttgtgcttcattttaaatcaatgtgcccataccctattgtattgctattattgattctaaacattgaaacaaatttcacaagtcatataacctttctcttggttccagacaatcaccactaagcaagatagatgagccgaacacattttttagttaagttttgtaccatcattttcctgtgaactccataccaatatctacatgggtacatctttgacaaaacctgtctggttttgcactgtgtttctttcatgggatgatcatagtatttttcacaatttggcacaaatatcactcttaaatcaagccttctaagttttcctaccccaagcaataggactgtttatgccaccgagcaattagatacatgcctctattattacatttatcttatttcatagcaattattttgtatacaatatttacctgttaatcaaaaccatagcttaatatggttctctcctagatgcccatcttagagccaggattaaatatttgttttcagaatgaaatgtttgcttatattttatttatacaaccatgataaaaaatctaacatgaaatgcaatcaagctttatcatgaaagtttgtcattcactcattcagcagctgctatgtggcaagcatgtctagctcttccttagttttgtagagacagcataggagaaactgtgtgcctagcacatagtagatgctcattagatattaatgtatttccttttctctctttcccgcattgtagccatgtctcacatggagtcaaataacagacttgttattaagtactcttactctttaagtatatgaggatttattaagcttttggtttcctgcttttataaatcaaaactttttttgtgaaattcaaaaattcaaaaatttcaaaagcaatattttttgcaaaaaatgtaaaagtttacatttttaaacacattttgtacccagtaattttatttccattgtatgcatcaataaattaaaaatattttcagtttagaccaggttttaaaatgtttatcttttttttttttttttttttttttttttttgagatggagtctttctctgtcgcccaggctggagtgcagtggtgaaatctcggctcactgcaagctccgcctcccaggttcacgccattctcctgcctcagcctccagagtagctgggactacaggcgcccgccaccacgcccggctaattttttgtgttttttagtagagatgggggtttcaccgtgttagccaggatggtcacgatctcctgacctcgtgatctgcctgcctcggcctcccaaagtgctgggattacaggcgtgagccaccgcgcccagccttttttttttttttctttttttagatggagtctactctgtcactgtcacccaggctgctgatctgagctcactgcaacctctgcctcccaggttcaagtgattctctgcaacctccacctcccaggttcaagtgattctcctgcctcagcctcccaagtagctgggaccacaagcacacaccaccataccaggctaaattttgtatttttagtagagacagggtttcaccatcttggccaggctggtctttaacttctgacctcaagtgatctgtccacctcagcctcccaaagtgctgggattaaaggcatgagacactgcacctggacatttttttcttttttaaccctttattttaggttcagaggtacatgtgcacgtttgttatacaggtaaattgcatgttgcgtgggtttgatgtacagattatttcgtcacccagggaatatgcataacacgtgataggtgattttttgatcctcttcctcctctcaacctccaccctcaagtaggccccagtgtctgtcgttcccctctttgtgtccatgtattcttgtttagcttccacttataactgagaacatgtggtatctggtttcctgttcctgtattagtttgcttaggataatggcttctagccctgtccatgttgctgcaaagaaaatgttctcattcttttttatgattgcatagtattccatgctgtatttgtaccacattttgtttatccaatctgccattgatgagcatttaggtttattacatgtctttgctattgtgaatagaggagcaccatctttctaccatctctttttttcctactctgacctcttccacctgaagaattagagatttatagtcaaagcacagtgcttagtaaacagtagttgacagctgtatttattagtttacactgtaacaaaaaatagatgtactttgcaaggtgatctttagttgtcattaaatttctgcttttataataataacatttcgtacaattactcatagaaaaagatgtgtttctgattttccatttgaggcttttatttgaatctattatactcagatatctttggaatcatatgatgtcatgtctctctcataattgatcttcacatgggccagtcattatttttgttttagtcattttggagtggagaataactcctttatctttgaagttctccctaaaactccttacagtaaaattgtcattttctacttgtcatatattcaaagtcagagatcctaaaaataatctacagatatggaaaaaattcatccacatatttatttgtatatcttgtgtgtgtgcaggtatgtgagtctagacatacgtatttcctcaccatccctcaaattctattatgactactcacttgcaccattattggtgaggtttgtactaaaagtcataactacagtccagactatatgaagacgagtagtgtgtgggtgcatgatttcttttatatataacatatatgatgtgtgtgtgtgtgtgtgtgtgtgtgtgtggacaagtgagagagagaatcaataaccaaacattctagcagtatacattggatagttttaaaacagctttattttctttctttctgcccagatatggggcagaaattggggaaattaacctggccataaggtcttgtaattggatatcacacataaatatcctcaagccttacatcttctttatataactgatgaagacattctacgtacaatgtaagtctttgtgctaagtgtaatataatgcaaatgcttgaccagatgattttgtaagggcaatattcatatttcaaaattaaacaactgatatttcatatgcccaaaggctctggtactgtacatattattgattaaagtgacattttaaagttactatagtgcaaaagagtttgttaaaatagaaaactaatttttatggcttttactagctcaaaattagccagaacactaacagagtaaatgtttgactgaagcaccaggtggaaaatttgtatcaatattcaaaggccctcaagtaagatttcatttcatagagtacaatcttggaactgttttcaaactacgtagatatataaatggcaagcagaacacctgcattaatcctggactatgcttttatttattttatttagtttttggtaatgaatagtcaatttctacacctagtcctatattttaccactttctagagacagtaacaagcctctaaatgcaggtttacatccatcggacacctttgtctgacaaattgagcttattggaatatccatttcagctcttgtttccttggcttaaattacaccagaatagattgtaataatttctggtgataggagtatttaaacgcccatggcccactgaagatccaattttgaaacggtggaatttatgttgaatataagaaaaagacgcctttaaaagatctttcatttcaaattctgtgtcacacctgtagtaggtatttaacttaaaggggatgagtggttatactacttttacggtacttttcaagacagttacatcattgaccatattcagacagaggagatggtaaaaatgcacctggacaaataaaatttgattaaaataaacattataacccagaaacaaactatgtgtggaagtcagtaaattacacagaatagaaaacactaatttattcatacccagacaacacgtcatctcctatttatgtatgagcacagcatttacataggtaagaaatatgaatgatattgcagtagagagggaggcattcttgatattcttgaatatagttatcccatttatagcttcactttaagctaatgatttaagcctaagtgtaggatttcattttcagtatagctgagattgacttcatgttaattttcagtgttatatttaagtttcaactaaacagtcatgccaagtgaaattccttggtcattcttaaaatgtcaaaggcagaaattatgagaaacagaggcttaccataaatactatgccagaagctgtcctataatatgtcttctgaagaaagagagagagagactattggtcataagagtcagcagtcctcactactcatttgagtcaacatatgtaggtcatttgtcctctttctctctcagatctgtcttacaccacagtgtgcttgctccatcatattaatctctgcaagctctatgcacatggatacttaaaaaaatcaatgcatgctcaagctcaataacagtatgaaaaagtcctgacaattatggtgatttttttttgtttatttttattcagctgttttaatggaaatgtacaacaattcaatattttgatgccaattttattttctttcttatttcctgaaacacggctatacagtaacatagtttcattataataggatataacgattatacccaaatcacaattgaaaagcttccaggttatgagcaaagactctgtgaatgggaaagaggagaaatgtgtcagctgcataaaacagagaaaaaaagtaaacagtttgaaaccttccaaaaagtttagttaactttgaaaaagctctaaaaatttcacaccaaaatctcatcccttcaaacacttgtatgcgcactcccctatttacacatatgatacaaatggaaacttcacatacagagttgctgcaggctacagtaaacactgtaaggcagaaatacattacctctggcagggtatatcacaatgaccccattaaactcctttaaggattctctttatgatctcagttcattagtcccttaaatagcatttgtcatgacaaaagagaacacttagaaggaaagccttaaagccttctcaaaggctcactgagccaagaacaagctcagaagttatcaaaacaaagcttcacaagtttggaataaattagcttgcttgggcacaaactgtgtctgtgttttttcagtgactaaacataatctacttgcctcaggctttttctaaacctaaaacctcatgctggcaatgttatctgtaaccacactcctttaaatggaggaatgtcactacttcaggtgacatggttcctcctaagggaaattgcccgaggaagaatgcaggtgtatctgccattcaaaagcctaaaagctgtgttcctcatttaaaaataaactcgtttaaacaacaagaactaattattacattaatttattgtcaacacaactaagcgcaggcaggcagatataataacctatgtgtaaactactaagcaagctgaataaaaaggaatctctactgtgagtcactttcatggtactaacacaggtactcactaaagccatatttcagattccattttgtagtttcattattactatacagatatctgtgcacataacgtcctataatatgtcatctgtctgtctttttccccttagctaattttgatttattaacgtgttgaggggatgtactgcatggcagccccccgatcctcatctgctgctgttcatgatcttgcaaaatccgtttcccttgatcctgagtgagtatgtgatttatatctaactgatagaatatggtaaagacgacaggatgtcatcacttccatgattctgtaagactgtcttgtaatacagttgctctagtctgctctagtccttttcatacagatgaagtaagtggccctattagggaagttcacatgtcaaagaactccaggtaaagtgtttaggaaatgtgggcagctgttaggagctgaggagaatcaacagaaacttatgaccacccctagctacagccaacaagaaatcaggaccttctgtcccacaactgcaaaataatgaatctgacaaatagccgactaatcttggaagtggatcttccccattttagcctccaggtaaaaaacaaacaaccacattaacaagtgggcaaaggacatgaacagacagttctcaaaagaagatatacatgctgctaacaaacatgaaaaaaaaaactcaacatcattaatcattagagaaatgcaaatcaaaaccacaatgagataccatctcacaccagtcagaatggctattatcaaaaagttaaaaaacaacagatgctggtaaggttgtggagaaaaaggaacacttttacactgttagtggggtgtaaattagtttaactcttgtggaagacagtgtggcaattcttcaaagacctagaggtagaaatgtcatctgacccagcaatcccattactgggtatatacccaaggtaatataaatcattctattataaagatacatgcatgtgtatgttcactacatacactgcatacactgcatattcacaacagcaaagacataaagtcaacctaaatgaccatcaatgatagactggataaaaaaatgtggtacatatataccatgaaatactatgcagccatgaaaatgaatgagatcacatcctttgtaggaatccatagatggaattggaagccattatcctcagcaaaccaatgcagaaacagaaaaccaaacaccgcatgttctcacttataagtgggagctgaatgatgagaacacatggacacatgagagggaacaacacacaatacaacctgtcggagggtgcggggtgggaggacggagagcattaggaagaatagctaatggatgctgggcttaatacctaggtgatgagatgatctgcacagcaaaccaccatggcacacattacctatgtaacaaacttgtacatctgcacatgtacccctgaagttaaaataaaagttggaaatgaaacaaaaacaaacaaacaaaaaaagacatagcccagcccacactctgattacagccttgggtgacctatgagcaaaagacacagctaagatgtacccagattcctgacccataaaaattgtgagataaaaatgcatattgtttccagctgctaaacttgtggcaatttcttctgtagtaaaagaaaactaatacaatgtatataagataagatagtatcatttatgactatcagttacctacttccatttctctgggtaaggccatcttcatttcttagtaggaaaatttgttgtagtcattttctagaaaactctactttccattcatgaatagtttctagaatagttttcaaagttgtttctaggggagactcttatcaaaacaataaaacacatgatttgtctttggaatttctatcttttacttattctcctctttctatagtcttctattcccacttaatcagatgaattccccagtcctttaatctattgtttcttcccctctcctcctgacaatgaatctttcagatccctcacaatccttctcattctaacaattcactcttaagattaatagaccaaaatagcttaattccatttgcatatgtacagagacttacacaaacacactgccatcccatggttattaagtggaccattattataaataaaagttgaagagaaatttcagtatatagaacaggtaaagcaaggttgatggtagatggtgttgtagatggagatggagaatgtgggtaggggttgatagaaaacccagtacaattccagctcaacatctgctacactctttaacacatgcaatgtcagcccagcagcatcaatgggcaaccataaggttttggttaagacagtttgaaaatcactgctttaaaccaaaagaattattctctgatggggatatatctcaatagttctcaaaagagattggtttacagtcttaatggaatcatgccattttgccaaagtttaaactgtatgatgtcaatttatcctcaaattcttaacatcctcaaatcacatataaacctactgtaccaatttcacaaactttattttcctgctcgctcacccttgggtaaagttgactggttgaaacaaaactattcacagaatgtagactttttcatttttcccacaacacagtgaatgcacttgggggcatcactgacccttactgtattggatcaaaaattgacttttttcctccttgtagcctcttatcttccatgtgcaagcaaaaccttatatcataatcactggtagaatgttttgttcaacttctctattgcatccttaagaaactgagaaaaaaaaattgcctcttaaaaaaagcagtacatctacatattaaaaaatttaaaagaatatccatcatagtagtgatcttgagaatcttggataacttgtatttaacatttatataaggtatgtgcatattattttattaaaataattcatatctccatgtagacttttagcaaaaagattttaaaagcttgtgtactaataggaatgcatctggctactagcaacaatagctacaattgaattaattcctactatatgccaaagcatagctaaaaactacataaatatagcaatttctgaagaaaacatataatgaagttattaactccatataacaattagtaaacaagctaggatgggtgaggaatcctcaaagcagagacagctagtaagctctggagatgaaatctaatctcatccctcattatctccaatgcttgtgttctgaatcactctgtcactggtttgattctaggatggaatgaggttgcaaagaaaataaaatggataattatttatggtaattggtatttgcactatgatattctcatatcaattcctaggtactctcttgcctttaagataatcccaaactttacaaagtggcaatttcggccgggcatggtggctcacacctgtaatcctagcactttaggaggttgaggtcggcggatcacctgaggtcacgagcttgagaccagcttggccagcatggtgaaaccccgtctctactaaaaatacaaatattagccaagtgtggtggtgtgcacctgtaatcccagccattcaggaggctgaggcaggagagtcgcttgaacccaagggtcggaggttgcaatgagccaagatcgtgccagttcacttaagcctgggcaaaagatcaaaactccgtctcaaaaaataaaaacaaaaataaaaataaagtgacaatttctttcatatttccatgtttatacttaggacctcttgaaagacctttcctttctatccaaacctatatgttgtcaaatacaggttttcctattttcctgcctccatacattcatgccattcaaaacataatcctgaaatatgatctctccatacaaggactacatcaaatcttacctactcagtgaaaccttctctaacactaaatgcaagaaaattgcctcatgttgggtggcactggtgctaataataacgaaggtattggagtttccatcttagtcacaagtgatttctttctcctctgaattcatagaacagtgggtgtcaatatcacatattcagaatatatattgccttatacttttaaaatcaaaatatgaacatgttgtatcttttctacaacattgtagaggaaaagactacttgcttcagagagtaataaatatagtttattatattaaggtatttaataattattttttgatgacgagaattcctagatctatgatgaaaaaaattgtcatttttttaaatgagcatacagttatcaccttgtcattttaggttgataattcagcattttagttttcctctactaacctcccgggcacttttctccaattttgtgctttagtcatagccacataatccaagcgtcaacgttgtgttgaggttgtattttacatgtgatttttgttggtgcacttccatttttaaacatattgagacattttaaacatacgaaatgatagaaatcaagaatatataatgtttaaagccaatattttcagacacctaaaatttggtaccatctctcatttactcttacctctgtaactgatacttcattcattcagtgatttaatcattaaacatttattgcactgctctcatccatcatacactttacgaggtatttgagatgcagggattttaagaggccattatgtggtgatccagatacatcaatagaccataaaaatgtaaaataataattattctaccagagatattcacaaggtgaaacagaagtacaaaggaagacatccttaagtcagcctggcaaggcttagtcccattcaagtgttaaccccagattttgagaagaggcttcttatgaatcttaatctgaactctgtcttggagttaaataagttctcattcaaagtacagctctgaaatgtcagggcaatctaatatcaatagcccttttagaacctgaaaaataattactggcttgaaaatgttggggggatggtaggtaggatttgtgtcttctttatacatttattcattatactttttataggttttttataatccctgagtaaatgctttgataaattgctttcccatgttgttggtgatagcacttactggaagtcatacacaaagtatatacatatgctattagaaggtggtgcttatccaatttattcttaccaacaagtattatacactgaccccatcaaaatccatgtccctactgatattttgagcatgatatcagctggtagttagtgaaaaaataagctcattattgcttccagctataacttctgcggtccagttaaaaactcttatgtaaggccattttcaattgaatacatggttttcaaaaaaaaaaaatcatttgtgagacagttgttttattatggacacatttttattttcaaataaagattgcaagtagaaattatgatcccagttcaattttctattaatctaatatattaaaatatagtagacaaatgttaataataaaatatatattctatctgctagtttccaaatgatttatgaagaaggatgagaaagaaactttttaattcctggttcataagtcaaactatggctaaatttttgaatatgtgatattcttttaccatattatttcctttctacatctgtattaacaatttcagaaactatactcactgctgtagctcacacgacatctcctgtctcccaaaggatttcctgatgaaaataatacctatagcaatcaggtaatgcttacttacaacctcaaaaatccttacatataccaactcctcctatcctcacagcaaccctacacctatgaggtagataatgctattatcccaatttttcatattaggaatccaaggcacaagaagttaaataacttacccacaatcacacagctagtaagggcagaactttaattttgactgaggcagtccagctgtaaaggccatgctgttaattatcttttcactgaattaattgtgtgggggctctagtaatgaaaggtggaagggcagtgtagcccatgttcacatgtgtcacttatgagctggattcttctctgttagagacttaagtatgtgtgtcatggtcaaaaacaatttaaaggcataatttctcactaaattagaggacacagtttcttttaaatgtgtttccattatcctgactgtttttttttttttttaatgcagcttattgaatttactgtaggtgagttgtatacccattgagctgtcaggacattttacctgccccaatctctaatacaaacaaacaaacaaacaaacaaacaagcactcctgttatagtacagaacaagaaaacatttcaatttgtcatgattgttttgacagtgaacaaagtttttcataactggcaggcttagctcaggccaaaccctatttaaaagatggcattgaatcctcacaaaaacttagtatattcattccaattttgcttcattaagtgataaacatataaagtgtttaacttcattaaatgtcaaatgaagcttttaattgatatataaatattggcagaattttaaaaatgataatatccagtttggtcaaagaggcaggaaaataggtactcatatgcattcttggcataaatatatatttatacagtctttttataggacaatttgtcaataactattaacttttaaaaaggttgttccacacaatttcacttcagagaatgtatcttaaagaagtacataaatgccttgataaatgggtagtaaatagatgttagacaaacaatgaagtgatggaaagatacacattttcaatgacttgtaaatagagatttctggaaaatagcttacatgcctgtcaataagtgggcagttaagtagactatggcactttcatacaagaaaatactataaagctgccaatattgttgaatgaacacagcaaattgaagaacaatatctggagtataaagagcatttctgttaaaaaaaaaaaaaagaagaatgagaggatattacttttaaaaaatatatagttctgaatcatttgctttttttgcaattaaaaacaaagataaaagcataacttccccaattgataatttttaaaatggtatttattttggtttgatgcatgtactacttgattcattttaataaaaatggatgtacgctctttacattgatgtttctttatgctatgcatattgtgatttcctaaaaacaacttgataaaaaataatagtgagaaaccgtttccttactttttcccctcagttgtgaacctgttgatctcattatctatgcctaacagaaatcattgaaatcctttcaatgtcagcctctttctctttagttgttagttctttccaaagctatcctaagctacaagaatattttcttctgttgtcagttggctattaaaacactactttgacaacaaacaacttgtaacaaatactcacaccaagattgctgactacttatttcccatgatttgggttcactttttaaaggtagacttctttacagcttgtagcaatctgtagcacgagaatgactgctgcttgtgctgtatttccattataccaaaaatttgaagtcacacagaagtaagatttgcaaaacgataagcaaatttactaatgtggaagggcctcttaacattcattccaaacctacagttaacttcttaaattaagagtctccaatagagctttaagttgacttactcttttgttcacaaatgaatgaatgaattcatttttgactatctcatgaaaatcaggaaaatttgggtaatactacaataatgaagcttattttcaatatgcttaaactctaaaagaaaagtaagccaaatgcataaagactcatcatattaagataggaggattaagaatccatgcatagtcagagatgaagtatgattagaagttcagattagggaaaggttattgtatacaaggaggattcaaacatgttacatgggtagtaggaagccagaaatcattaatgtcaaataagaaagctatttaattaattgtatttctggctttattgaaaatgaatttaggtgagctaaggaggttagattttgtcctgtcaaaaacaatatacgttttgtgctatacaagtgacatgatctaaatttttttttccttggcatacttactttgcttctataattcctttagctaggtgtcctcgagttgttttgtttgtttatctatttttcaagggaatccaaaaactaatccacataatctttatacttactcttctggcatgtagaagtggggtgtcatattctttgaaaattttatgaacagtatgttatttttggctattcaagtagccttttattccttgactgattagaactccatgggaactcacaaggcaactagagtggaaattcaatttaaaaccagagaccttgatataagataatgatccctagctctgccctcatttcctcttcttcctagtgttctgtctagacctgcttcctatttattcactttgtcacaacaccgtagcatttctggccagcaaatcttctggatttggaacaggttaggtaatttcagtgaatataacttctgaaaatggaatttcactttacagaataaaaaccgactatatattttttaaaaaccctttataaaaattgttttacctagtggttagaaaatgttttcaaattgtactataattaatcatagttttaagagttattaaaattatggtaccacctccttctaaaccatagttgattttgtatctaaaagtctgggtctttgtaaaaaacaaagctgctagtttgaaaaaaaaaatcactgtgaaatatatttgtccatatttaactgaagtagaaatattattaaggaaaatcagggaaacatatctaacataagataggctaaggagtcacatttcatccttgttgtaactcttgctatgctttttgttaaatggagtccacattatcaagtaaactgtgaaagctaatcagctcaaaaaaccccagggcgcttcttattgctgcaatattttataatgcttccctggttttggacaaaaaataatatttggtgttgcaaagaagcatacaacattttgtctagatgaattttataacttggctttaatcacctaaacaaagcacatgtaaaatttagatgcaaaattttgtcaaaatcaggtaaggcttaattcattgaatcacttccaaatattggtaattggtgaagtttctatgtaaaactggttctatgtatgaacaaattagactcagaaaggcacctcataagctgatattggcaatcccaagaagacactacatatacaatcaatgtgcacatattcctgaaggttaaacttcagggtgatctgagatgatggacattggttttggtttttcatgctttttacttacacgataaaaatttgctcaatggtatttgcatcatggctcttttatttccagtatagatacatttataataagccattcatattatcataagatacttgcacaggtcctttatacatccttctaagttagaatcctgttattcaaaaaaattatcatatcttttcaatggaactagatataccaaaaactcatgttgtatcaatgtttaatattattcagactattcttcattcagtaatatctccaaacgtctgatttcaggtcccttggagttgtgttttggcaattgttttaaatcatctagcacaaaatggcatgttttgtcaatttctaggtatgaatactttgcaacataatgaaattctacagataaaattattgactagctctacaacatgctatattgtgtgtgtggtttttttttaagagtttattttttagaggactttcaggttagtttcacaataacattgaatagaaagtacagagagttctcacataccccttgtcccccacacacaatcttctccactatcaacatcccccaccaggccaggttagatcactggctcataccagtcatctaaacactttgggagtccaagactggaggattgcttgaggcccagagttcaagaccaacttgggcaacatcatgagactctagctctacaaaacatttaacaattagctagatgtggtggtgtgcacctgtagtcctagctacttgggaggctaaggtgggaggttcactgaagcccagaagtttgaggctgtagtgagctatgatgataccactgcactccagcctggtcaagagaatgagaccctgcctcaaaaacaaaacaaaacaaaacaaaacaaaacaacaaaaacaccgaactggtacaattactatggtcaatgaacacactttaacacatcattatcacccaaagtccaaattttacattaatgttaactcttagtgttacattttctgttggtgttgacaatgtataatgacacttatccactattataatatcatatggactgtatttttttggccctaaaaatcttccatactccacctgttgtgggaagtcagggaccccgaatgaagggactggctggagctgcggcagaggaacataaattgtgaagatttcatggacatttatcacttccctaacaatactcttataatttcttacgcctgtcttactttaatctcttaatcctgttatctttgtaagctgaggatgtacgtcatctcaggatcactgtgatgattgggttaactgtacaaattgattgtaaaacaagcttgtttgaacaatatgaaatcagtgcaccttgaaaaagaacggaataacaatgattttcagggaacaagggaagacaaccataaggtctgactgcctgtggggtcgggcaaaatagagccatattttttcttcttgcagagagcgtataaatggatgtgcaagtagggaagatattgctaaattcttttcctaggaaggaatattaatagtatgaccctgggaaacgaattgtattcctggggggaggtctataaatggctgctctgggagtgtctgtcttatgcggttgagatgaggactgagataagccctggtctcctgcagtaccctcaggcttactaggactgggaaacgctagcctggtaaatttgaactcagacgggttatctgctcttgaactctgttttctgttaagatatttatcaagacaatacgtgcactgctgaatatagacccttatcaggagtttctgattttgccctggccctgtttcctcagaagcagtgatctttgttttcctttttgccctttgaagcatgtgatctttgtgacctactcctacccttttgaaatccttaataaaaacctgctggttttgtggctcaggtgggcatcatggtcctacctataagtgatgtcacccctggaaggcccagctgtaaaattcctctctttgtactctttctctttatttctcagccagctgacactaaaggaaaatgtaaagagcctacattgaaatactgggggcaggttcccccgataccacctattcattcatccaaatttcttccttagctattggtaaccaccaatatttttactttttccatactttttactttctctagaatctcctatagttgggggtcacacataatgtattatttcaaatttgcttctttcacttagaagtatgttcctccatgtttttttgtgacttaatagctcatttctttttagaaatgaataataatccattgactgaatggaccacagtttaattatccatccatacactgaaggacattttgggtgcttccaagttttggcaattgtgaaaaaagctgctataacatccatgtttaaaccattcaggttttgtgtgtatgcgtatgtacaaaggttttcaactcatctaggtaaataccaaagagcacaactgctggattgtatggtaagatatgtttcattttataagaaacttccaaactgttttccaaagtggctgtaccacttttcatgtccaccagcaatgaataagaggtcctgtcactccacatccttaccagcatttggtgttgtcaccattctggattttggccattctaataggtatgtagtggtaactccttgttgttttaatttgtaattcactagtatcatatgatgtgaagcatcttctcatattcttgtaatatttgtcttctgtatattttctttggtgaggaatctgtttaggtcttttgcccacttttctttgggttgttaattcttttactgttgacttttaagcattctttgtgtattttgggtaaatgtcctttatcagctattttttttcaaatattttcttctagtttgaggcttaacattcacattatcttaacaatgtcttgcccggagcagacatttttaattttaatcaaacccagattatatattctttatttcatgaattgtgcctttggtgttgtacataaaaagtgatagccatacccaattatatataaatgatctcctatgttatcttctaggatttttatagttttgtattttgtgttcagacctatgctccatttttaatctttgtgaagctgtaagttctttgtctaaattcattttattttggccatggatatccagttgttgcagtaccatttgatgaagaggctatttttttctccattctattgtctttgcgccttagtaaaagatcagttgactatatttatgtggaactatttctgtgctctctattctgttcgatcgatctgtctattcttgcttcaataccacactgtttggttactgtatatttaacacaaattggttaacgtcagtcctgtgaccttgttttttctttcaatattgtgttagctattctgggtcttttgcttttccatatacattttaaaatcaattttttaatatcaacaaaataacatgttgggatttgactgggattgcatcagatctataaatcaagttgaaaaaaatgacatcttgacaatattgagtcatcctattcgtaaaaacagactatctctccatttggtacttctttgatttctttaatcagtttaatagttttcctcatatagcttttatacatattttgttagatataaacctaaatatttcatttttggggtgctagtgtaaacagtactgtgtttttaaattaaaatgcacttctttaatgctgatatatgggaaagtggttaacttttgtatccgagaagcttggtataaacacttatgagttccaggactttgttgttgttgatactttcagattttctacataggaaatcacatcatctgcaaagaaaaatagttttacttcttacttcccaatttgtataccttttatttctttctcatcttgttgtattagctaggacatcaagtcccattatgttgaaaaggagcagtgagtgggaatatccttcccttgtttcttatcttagctggaaagcttctagtttctcactattaaatatgaagttaactttagaattttttttgtagatgttctttaccaagtagaagaagtttcccactattcttagtttattgagtgttttatcataaatggagttggatttctgttaaatgatcttcctatatctattgatacaatcaagtggtttttctgctttagccttttgatgtgagggtaacattaatagatttttcaaatctattacctggaataaatcccactcacatacctggaataaatcccacttggttctgttgtataattctttttataaattgctgtattcaatttgctactatttgttgaggatttttgcatttatcttcatgagagacaattatgtctactttgtttttcttgtaatggtctttgcctggttttggtattaagttaatgctgttgtcatagaatgagttagaaagtatttccttcacttttattttctggaagagatgacagaatgtttgtaataattcttcaataaatgtttggtaaaatttaccagtgaacctgccttgcctattgctttccgttttagatcattgttaactactgatgcaatttcatatatataggcttacttcttctcgtgtaagctttgacaaattgcactatttcatctcggttttcaagaaatttggccatttcatctaggctttctaatttgtgggcacagagttattaatagtcttcctttatcaaccttttgatgtctaaggtatctgtagtgaggttacctctttcattcctgacataagtaatttttatctttttttttcttagcctggctatatgctatcaatgtttttcatcttttgaaaaactacgtttttgtctcatagcttttctatattgatttcctgttttcagttttactgatttctgctccattttttgtttcttttcttctgcttactttgcatttaattgctcttcttttttataacgttctaaggtgaaaacttaaattattgattttagatcttttttcttttctaaactatatttgaaatgctatatatttccctgtaatcattgttttcactctatcccaacattttaaaaagttgtattttcattgccatttatttcaaaatattttaaaatttctcctgaaatttgtttggaatgaggtgttatttagacgtgtgttgtttattctccattggcattttccatttatctccctttatgtatttctaacttaatttcactctggtctgagaacagacattatataaatttgttaggatgtgttttatggccaagaatctggactatcttggtgaatattccatatgagcttgaaaaaaacgtgtatttccttgttgtggatgaagtagccaatagatatcaattacaagtgattaattaatggtacctttgagttcaactatgtccttgcttattttctgcctgctgggtctgtccatttttgattaaaaggcattgaacattttatatgatgccattttctctctctctttttttaactctttcagttgttgtcctagaatttgtagtatacagttacaactaattcaagtccactttcaaagaatactataccctttcacaggtagtataggtaccttataataataaagtattcttaattccatcctcctattccttgtattatttttgtcattcatttcactaatacatgagttctgtttatcaaatacctttttgataatttttggatacattgttacctgttaggtaagtgaatatgaaatataaaagattttatttggccttcatttgtttcttctctaatggttttccttttttaaacgtagatcagagtttctgacctatatattttccttcactctgaagaactttttaaaatcattatttttaaaagcaggtttattgatgataacacattccctcaatatttacttgtctaagaaatcttccttttatcttcacttttgaagggtgaattctaggttggtgtgagttttctctcaaatgtttaaatatttcaccccattctcttcttgcttgcaagatttctgaggacaaataagatctaattcttatctttgcttccctggaggtgaggtattttttctccttctggtatttttcaagatttttttcttaatatgatatgttcaggtgtagtgttttttattggattttttttttcgcatttatcctgcttaatgttctgtgttccgtgtgcttcctggatctgtggcttggtgtctgacattaatttgaggacattctgagtcatattgcttctaagatttcttctccttctgtcttcccattatgtgaagttataccatttgtaattgtaccacagttcttgggtattctgtatttttttttcagtctttcagtttttcagtcctttcagttttggaagtttctattggcacatcttcaagctgagagattcttcaaccattctcagtctactagtgagtgaatcaaatgcattttcatgtctgatacagtgtttttgagctctacaatgatgttttgattctttcttagaatttcaatctctctgcttacatcacctaactgttcttgcatattgtcttaatgttgttctttagggcccttagcatgttattcaaagttttaaaaaattcctggtctaataattccaaattcgtgccacatttgactctggatctgatgttattcaattgcttcaatctgtgttttcctgccttttggttgtaactttttctcatacagtggctcaatctcagatcactgcaatctctgcctcctaggctcaggtgatcctcccacctcagcctcctgtatctgggattacaggtaagcaccaccatgcctggctaattttttgtatttttttgtagagtttgagtttctccatgttgcccaggttggtctcgaactcttgagctcaagcaatccacccgtctcagcctcccaaagtgctgggattacaggtgcaagacaccatgcccggccaccttgtaaccttttcttgatagacagatataatgtactaggtaaaagaaattatagtaaataggcctttagcatgtggtggtaagatgttaggggaagacaaataacagtcctataattataattctataatctctgtcttttagtgagtttgtgcccctggactgtggacttcacaagtgtctcttcacaagtgtccacaatctgtctccttgggacagaatagctagaggaagctggaatcaggtatttttcttctcttatatcagttgggacctgataaaaccccaatatataaggctctgataaaatagcttctcctgaaggcagcccatgctcataagaacagaatgctccggagtatttcaaactagttacttttctgctcccactgccagaatcagcaggggatctttccctgatcttcactttgaaagcctggtagagattctggagttaaaactcacaaaagtgtgagggccccagtatgaatgtcctcgctggactattttactctcagacttgtccacaccaagcctacagcagtttgtcaattacatctcaggttttcctactcttaactaattccagtggagcattctgctctgctctgttaagttgtgattctctatatccagtccgtgtttccaatttggagggcataagtttgctctgtaacctcacttctctgatgaatctaaaaagagtggttgatttttttttcaaattgttcagatttttacttgttgttaggatagagtaacaacttccaagctccttacttttgtgactggaaacttacactccagcttttcagacaataaaaataatttctaaactgagggcacaaatcttctgtataccattgattttgtatttataacctcacgctaggaagcattcatatattcagggctttgaagataaaccagttcttcctaaactctctatatgacaatctactgcctttttccattgtcttgtctgccttcctcaaggtcggtttcaaacagtgcatttaaagcatgcaacagtacatgggttaaaaaacagagaacatattaaggactgcataaacaacaaaggcattggaatagtagccattcaaaaaaggtaagaatccatggccattcttaagcacaaacatagtttttaaatcagcttattatgatgataatagcttttacattcaggaatgaaggaatagaatattttaaaaaattaatgttacttaggattagtctattaaagattagtttttcaaagaaaaatggtaggcctgacaaaactagaaaacttgttttaaaatttcaagatgcatttttgccagctaaaactttaaagtcaacttttgaagctttaaaacaagatgacccttcttgtcttcatgatagacatgctattccatatttttccctgaaataggccaataaccttcacattgaaatctgttgaagttggtaattccctcccttaaagttctacaaagcattttaggggacatgtaactactaggctaacaaaccttgcagtctcacacttgtgtatcactcatccaccatattttgactaggagcattttcactttgtataatctttaggttctcaaactattagccctgatgatagacctgaccttatctgctctttacctgaaactttgcttgtaaatgttcctttatctaaaacactttctcgacaccccaacccaaaataaatatatctaaaaaatcacccttcaaatttcaggaaaggaaccttatttaatcattcctccctactcctggactacatgttcttatagatctatgttcccttctttcaaaatatttatattggtttgcaatatgaattcatacagtgtgatgatttgctatgaaaaattcacatgtggtaaccgcttttgctcacaactgtattcttatatcctaaagatggcaaagaaagagtgataaataaataattgttgaatcaataaaatattgaggtgtctcatgaaatcattacatcttccagacaattaaactaggagggccctaatagaatcatacatatggctgggaataaagagagacacagcatgtaggatgcaaagtacctaaagtcaggtctcacaacttttctcagggtaaatgtttccccattgaccattagataaatgaattcccctgacagtccaaagcttcttccattttctccatccatcctcctgaaatgcatatatccctgagagtctttcgaagttaatttatatattcttttccatctcattcgctgcactggggaattcaaaacaaaacaaaacctgaaataaacctcaaggagcactagaattgaaattcagctacagtgaaaactgattcatttttgtctcacactatctgtttcaaactcccaagggtggtggctaggtctgctcaactgtcttgtaatgatcctgtcctcccactgtcactctccccaatcatgagatgctgtctggtctgtttggaggcctaagacatgaatgaataccttagggggctgtatcagtatttattgtcggggtggtgaagggtgggaggaagaagtagtgtaataaaaaccatctgtgctgagaattatagaagccagaaagggactcgcagggagtcctgcatctatcaccacatggaagcccaattaaaacacacattcaaaaaacaggatcctgtcagaatatgcctcagtcagaaaaactgcaagtgaaattacactgaactcattcactgttaagtagaatagaataaatggaaataagaaggtgggaataaagacctaataaaatgttctcagtgtatttttttaacttcctctatttcaagtaaacaaaattcacaattctaagtctactaaatggaactttgaatgaaataaagattggcagaagtgatgttatgtgacaataagaataaccaaattccataacaagtatcaaggcagcatataattagaaggcatgtttcgcaggcattaatatctagaaatatgaaaagatatattctttaatgccctgaaaagcacagaattcagctaaaatatgaatattcagaaaataaacataagcacacctgttaggtatgtatcatgtataattcagggatccccaaggagagctcctttgttccccatctgattagttttgcatcatgaggttgactcttgcagatgcctcatcactgtgaccatttttatctgtctgccttagctgctctctttctctgtatacctgaaactgtataagcagtttcaaggctgatcagttgactgtactatgaataataaaatgcttatctttgtctggggggagaacttggttaaccctcttccagtggaacagtattcatagtaagaacaggatgaacagttcagtgtgaaacaatgagggaactcagccgagaaagccagtctttccaaccacctatgtacacggtgcttcttcgtgtagcttcctttgcctcagccaccctccagatcagatttcagagtcacagcaagcagaagcctgctgtctgttttaaactaattatctatctatctatctatctatctatccatctattattgtctgtctatctatcatctatccatcatctatctatcatctacatctgtccatgctgagtttaaatcaaggtaatgaccctagacctgatctataatagattatttatgttttcttgttcagatgcaaccaacaaacaatgtatctttgtcaaattgataataatgactatcatgctacaattaattaagcaaaacacacattttaaccatttttcctctcccacatgtcttttaatcttatgtcctcaagggttctaacacagatagtctgatggatgttctgcagaaacctgaaaaataccttgttcctgttctttttattcctgagaacatcaccctccttcaggtaatagtgactataagggtaagatttaacaagtttctactaacatgccctatctctattatttctaataaagtgttttgttttgttttttaactctcatactatgtcagttaaaggatgcctgactggacattcctaattgctaattggttttagtttagtgtgttttcaggtgctgacttcttttatgcaaagttgagaaatccagtttgattattatccaatccaatgttaaatgaatagtgttttgagtaagaatggtttgttgttttttgaattttagaaagataaattttcttttgtatgtttactttggatgtatttggggggaaaatctaatatatctaaggccgtgttccaagctttccttaaataaattttcaaaattttacttcaaatcaaatgcaataacacattgagtaattatgaatcatatataatttttaatgtcaggaagtattagtacatgtcacaaatacaaacagaaatgcttgcacaaagaataatacttcatttatctaaatatagtatatgagtgaattctgcacataaacaaaacatctattttaaagtactaattaaaattatatatgtatactaataatatatttaatttgtagttatctagctacttacacaaatatactcagcatgattctcaatatgattgataattcagggctatttaataaatgtcaattatttaactagagattaatatgccaatgtctcttgatttatgaagggctattgcacctatgatttaatggttcacatatatggaaatattttttaaattccagaggctatattttatgcttttagtataatcaacctttttgtgaataatacaaattctactaacttttatccaaactgaaatatacatctcggatgccatggtttgaatgtttgtgtctcccccagatttgtatgttgaaacctcaataccaacattatgatattaagaggtggggccattgggagctgattgggtcaagtgctagaccctcatgagtgaaattagtatgctcataacagaggccccaaagagttgccttgaaccttgcattatgtgaggacacagcaagaaggtaacatctgtgagtcaggaaatgaacccttaccagatgccaaatctaccagtgtcttgatcttgaacttcccagccaccataactgtgggaaattaatttcagttgtttataagctagcaagtttatggtattttgttatagcgacccaaatggactgacatcttataattgaggttgttggataagtggactctgaataaaaaatgtcatgcacataactattagatgcctatttagctagagatatttacgtgactaaaccacgagattttttttcaaaaaatgccactgtaaaatagaccctcatcagccaatggaaaggtttgtgcaaatacttgttcaggggttaatagaaaaatctacttgggatgactggaacagtctctttctaaatttcactggttatctttgaactatacacctttcacatcttagctaaaatgccactgtcctaggaatagcttccaggaatcaccccatttcaaactagatcagtccttgattaaccctccaattacatatttacatgagttgaataatatatgcttcccccattagatttaaaaaaatatcttccaagggaaataaactattttactcaatactgtgaataaaacacagaacagtgttaaagaaaaacagagtgggtatgtaattgacatgtaacaaatagatgagtgaatatggtaatggtgattctgggtagagggcctcaaggaaatatggtttggggatgatgtaggctctgcagacagacagatctgggttttgatactggccccagcatttattattagtaatttttaattgtacctcatctctgtgttaatattccctactaccttgagcttcagtgataataaaattaggtattttaggtaaaaaaatgtatttattaagtgcttaatgtatttattaagtgataagaaaattaggtattttagattaaaaatatatttttatgtgcttaatgctaaggaagattcttagtttaattgcaataatctatattttagggctaaccctacgtttctatcatagccttgcacttaacagcttagtgatcaaatagaagttattaattctcctcaaaattcagtttcctcatctgtaaaatagtgataacaccactcaagaactgtgaagatttatatgtcatattttaaataaagtgtttagcccagaggctagcacatggcaagtactcagtattccctctcatgatccctatcattattctcttaaccacctaagccccaccacactccctgaacagcaaggtgagcaaggttttcaaaaagaactgatatgtatttaactatgcatcctagagaaattaatataaaaagatgcattaaccttgggacaacacataattcaagtgtgggtcagaagagtgagttagtagagcagttaagggttgcttctggagtcacactccttcactaactacctgattctgttatttaagtattgtaatacttaatttcctcatctagaaataaaaacagccccaatatatacagcttttttgataattaaatgagccaattaatcaaacacatttagtacagtgccttgcccagataagaactcacaaaaacttactccattaaacaactcacaaatactatatccgtataggaataaggcaatgagtctattaaagacaagctatacttacaatggctctaggctggggacttggttatcttctctgttggaaaagagatgctaggaacaatgaagacagccttttcattggattacagcagtatagtatccagtaagtccagcaagtccagcaattatataaaaaagatttaagaaatactctacatttgacagaataaaatgtaaatatgtaaaagctaataaagtaaagaataatgccggtaggagatagtagagacagaaatgatgaaggattgtaaaatgtacccggtaattcagtagtgacacatttatatcgctatagaatattaagtgagaaataaacgtttttgaccctttaagggttttatattaaattcagcattgcacccacttgaatgatcaaaatgaacttgaaaatgtatgtgtgtaaatataaacagcatatgctgaagtttcaccatctcttatatataaaaactttattaaaaagaacatagttttacaaagcatcttagggagcccaagcctagggttctttggattatatcttttcttctcagactgattaagtagctcaagctctgaatctagaatgcctatgattgaaactcagctctaccattttacagaaaaattacttaaattatttgaggttcctttaccccatttgtaaaatggacataataaacagtacctactttgtatgactacaataaggattaaataaactagacatatacagcatgtagaatagagactggcatataatactagatgttaccattaactccaaatttttattcatgattaactacaataaaagattctagaagaaagcaaaatctaactatttcaaatatgtagcaaacatttttgttgcatgtgttttgcttaaatatgattaagaaacatagaatttaaaaagaaagtgtattacaactcaattcctaattttttttaaattttcatttattcatttatttttttatgaagtcttgctctgtcacccaggctggagtgcaatggcctgatctccgctcactgcaaactccgcctcccagattcaagtgattctcctgcctcagcctcctgagtagctgggattacaagtgcttgtcaccacgcccggctgatttttgtatttttagtagaaacagggtttcaccatgctggtcaggctggtcttgaactcctgacctcgtgatcaacccgcctcggcctcctaaagtgctgcgattacaggtgtaagccactgtgcccggcctcaattcctaatcttaccgcttcaatacttatttttttaggcttcaatatattttatttatttgcttatgaaagcctcaatgatgacatttctgtacacatatacaaacggtcatacaaatataataactaaaactgataaatatgaatttgccactattgactttctcttgatggcttgtatgagagagactctaactagtcatgaagctgactgtctcttcttcttggtcacacaatttgccctccgtttcccagcttctcttgcagttagttatgatcatatgactatgctagccaaaagaacgtgagcaaaaatgataagcacctcttgaaaacttggatcataaaatgctccatgctctttccttctggttgtccaattggtatttctgtgtctattttctagcatttctaacagggctttttgctgtgttcttctgtgtttacatgtgtattttccattagaaggtactgattttggacacaggatttgagtaagcagttttgtgtgtggaggggtgtggtcaggaacagcagagaacatctctcttggaagacagtaagaagcagtggctaccacaataaagaaagcttaacaaaattcatatctggcattgactggggatcattaatacatagaatccttgaataattctactgtcttactatgctgtgacaactaaaatacaataaaaatatatctccactggggctgggcatggtggctcacgcctgtaatcccagcactttgggaggccgaggcaggtggatcacctgaggtcaggagtttgagcccagcctgcccaacatggcaaaactctgtctctactaaaaatagaaaaatttagccgggcctggtgatgcatgcctgcaatcccaggtactcgggaggctgaggcaggagaatcgcttgaacctgggaggtggaggttgcagtgagctgagattctgccactgcactacagcctgggtgacaagagtgaaactatgcctcaaataatatatatatatatatatatatatacacacatacacacacacacatacgcacatatacatatatatatatctctctccactacagtcattaacatcttctacatctcaacatctcaacacttccatgcactttatacatttcatgccaatggtagcaaaaataccagcaggatcccaatcaccatcaaggctcaaaatgcttgccaagcacttttcagatccaggttgaagccagagattttgcactaaatctgccagttgctctgtaatatgcagtgttttcacagtgtctcgtagatagcctgagagtcacaatattctcatgagccctactgcaatgctgattgtcacgtgttgaagatggcagagccttttcagcccagttctatgcaatgctgaatggaacataagccctttactattaacggcagtcattttggtgttttaatgagcaagataaaatcctttgtgtcaagccatgaattttgggctcttctctattacaacagctagcgttatctagatagtataattaattttccatgatgttaatggttttgataagtttgagtcactggaataaaaatgttgattcactctaaaataaaataattgtttattatagttacttaaatgtttcataattattacatatgcattctactttatgttatgtttagttattatgtaggtagaaattcaaatttctaccatgaaagttctgtaatgttactcatccagaagcagtttttagatgaacaatgtgatatttacaaaagagtgaatttagtgaattctaataattttgtttagtttaactaaactatgagtccatctgtatcttttgtatttttataggttacacttcttagaatgtgagtcgtagtcaataattctagcatactgtaacctgactaaacaaaaaatttaggaagatcaccagactccaacccaagactgcagaaacatttggactggtgatggatttttccaattactgctttcagtgttcactgtctatgaacatattgaagccatttaggatatattattctagtaaatgagcagactgttcacacacattaaattcctgtttctgtgtagactgtaaaatgcaatacctttatctatttcatgctggaattaaaaatccatatcacagattcttagaaaataaaccattattccttcctgaaaaatgtaaatgagaatgagcatgtatattatcacaaaagtgctgaaatatatccactgtttttctgggtaatgtatctaagattaatttattctgcaatgtacacttataatgtacagtcccctaacattagataacggaattagagaagtggaagggtccagtggaaggatgaataagttatttgtatgtgagctgagaggtcaggaagaagaggtgggtggggttgctaaagcaaataaataggtttagtaaaaccagaaggtcatcgttctggtttcctcattgcatacattttaactgtattataagaagctatgccactgttaatttaaaatatctactatgattattaacacttaccttacatagacaagccacttttctgaaaaggaatctttcagaagatttgtttggcaggagttgaagaataacttagaagaaagaaagaaaagaactaaaggtacctgtggctttaatctacacaaatgatgcctgcctatattggacttgtgtcagtggaagaaaattaggtaaatccagagggcttttccaatacattattaaatgtgtgggccaagttgaatttgaatttggtagttgggggtctagaaacaaaaataatagtgacaataaaatgtgttgtgatacctttatacaggcatcgtacaagataaattacatgcaatactcctgtccacattatgagtctgggagctcgaaataatacttccatctcaaatggatataccattctcctgtttctgtacacttaaaatgccttcaaaactttttcagcattaaaaaaaaaaacaacataaacaataaaatcttctcagcaatgcgatggctccttccacatgtaagattaaaattagaaccactttccaagttattttctttttttaattttttacaaagagaaaaattagaaaaacagaggtagggattttaagcagaaagagggatggagtatgtgaaagaaagaatggcattaaggaaacctagataggaaagggtccaaaatattcagactaagtaaatcttatgacaaggggacagggaaagtaatgttataagaggtctaccctgacacaatgacataattcaggtgtatatttggttgcatgagccctaagacctgcgttaaaaagaagccagtataggatcacgtatttgtcacaaatatagtttcctttaaagcaagagcaaagaaaaacagattgtgcagtgtattctgtacaccttgatttagttctaaatattctgttctttgaggccagaaattgtgttccatttatctttgccaaatacagtcatttttctggtagataagacagaaagatagataggtagctagacaattcatttaataatcattttcaagatgatatagcaacccaaaatttttaaatctctaagtgtttgctatcaaactatattaaagtaatggtacagatatatgctattaaacttagtgtataattttaagccagctatcataaattaaccatttccatttacctagagactatgtctggaaattcctgatgagttttaaaatatacggtttctatcaatggggtatcatagtgcaaatatacattttagtataaaatctgctatacaattatagacaataatattgaaaatttaatataagctgtaaaaacaaccaaagggtaactatgagacagcaatttttttttcctgatttgttaatatatgacccccaagtaggtgaaggctctgtcaagttcacagaggtatccaagaaattacattctaggcagaggctctcagaaaactgcagactaatggctgctttaaccctattgtccagtgtcaaaggagtcattcatattggaggagtgtgcccatcagctgcttaaagaggccatggcacttaactgagctcaaactaggggaaagttacaagatttatttcccatggccacaacttgattaaagagaccctaatctaaaaaaaaaaaaaaaaagatgaaggggggatttttaaaaaataaatgttattaaggtctagggacaggcttacaatcaatagctgaaatttggtaggggtgaggtaagtggagatagggatggaaaattacaataaacatgagattttggaaagcaatcaacagtaaacaataaagactaaaactctaaggagatttccctctcttttctctcccacacactcaagagcaaatgtacacagagtcataatttcttctctctaaacaatgccaatgaattcatagacacatatagaaactaatggtagacagagtgtttttccccactcaaaattataaagtaggcaaatattttcaacattcatccctcctgtctcttcttactagtccagttacccagtcctcagtgtttttatatgactcctcgcttctcagatctagtgggaaatttttcaggtgctggaccactcgttcccaactactgtcacacaaacctacacctcagtaactctcagaccttactatgatagtcaatatatcctattacctaattcagaatgaggggataatgacaacttaaattcacagagcatttactgaatatccagatttgaaagacaagaagccagcgatacagttaatgaaataaggcagtgtccccaagcaacatagattccttataaatcaacagaatacaggaagaatataggcaatgttataacagagatggcagggacagaaaaaatttaaaagattaatttcaacaaagaacattaagaaaagcttcatgggggagatgaaagttaagaagatgcttatatggcttaagtataaaggaaaaaaaaaaacaaaccatgtgagactttaggtttaataccagttaagatgataaatagcctgaataatatgcccagtattttctcagtttgtgaacagagttcagatacttgatgggccagctcaaagctggatacctcactgccctaggacaatggaagaaatagcttgagtctcctggcagccctctaatcatgaaatatatgtataatacataaactacacaacctcttgcttttatctttctcttcaaccaaacattgctatcataccagacaatttcgaaattatacccttgggcctatcatggcctgattacttacttcataattgcttgatttctttccttctccccttcatcacaacatagctttatctctctgaaatccctgctctgactaaaacctcttaaaattctctcatccagtattttccactaaagagtcttacttttctcagaaactccatttgttcctaggctaaaagcctaccaattttttatttcttttaaaatctcaactactcggctatcttggtgacacttactggcatacttaactcatttttcctttattctttgctctagctttgctgacaatgtgtgaacaaatgagcccaaacacttggttttttctgtacttcccctcctgaactttctggtcatcctgaaaaaattaaatagtagtctgttaatttgtattataaatctatgatctgcccccttcttctaggtctgtaacactgttcagtatccatttactttctctgaaacagctgttacaagccatcatcactcttctcagtgcttctactcagactctgcaactcccacctttagcaaacctgccttcttcacagcaaacaacttgaaaccatcggatggaaactcccaaactctcatccttcccacttttcaacttacctgcatttgtatctattgttaattatcctcctactgtcatgaaggagtagagtctccgagcatttcaaggttaatgtcactcctgttcctctcatttgagagcacactccttgattctacccgtttgtgtctttaagctcctctctcttagctctttctcttccacaacgaacatgttgaacactccctacatcttctctaaatt

SEQ ID NO: 1256 - DNA, 80620 bp, Homo sapiens
gctggagccggcgcggaggagcgggcggccgcggctgtgccctctcctactcctcaccgcgcgagcgcggggaaccagtagccgcggctgcttcggttgccgcggtcggtggtcgttatggattctccatgggacgagttggctctggccttctcccgcacgtccatgtttcccttttttgacatcgcgcactatctagtgtcagtgatggcggtgaaacgtcagccgggtgagtgcggggcgccgcgggccggacccctcagagtgctcctgacggcgaggaccgtctaagtcgggtgggtcgggtgggtcgggtgggcggctgagtggccgctagcccagacagttcgatggtagagttggaggggcgccaagggccggttggtctgacttactgagtgcagatggggaaacagcgtgggggaggacggaggctctagtactcctcaaaggaggcgtgacctggggtccgcgaggccgtagcctgggcgagcagggccgaccttgccaaccgcccgcagaagtcccaggactgacagaagctgccgcagcgtttcggaaccacagatatccgcgccagcccagggcttgggcggcctcctcgcggtaccgccactcgctcgcagtgtcgccactcgctcgcagtgtcgccactcgctcgcagtgtttgaaagtcatgtgaggagacagcaggtttctgactcagtctcttggagtaatagatggttgcggactactctccagttatgaaagttgtacaagcactgaaacaaaaagcctcctgtagccagaccaggattccccttcacgcagtgtcctaacaccctgcctagcatgtgagaagcgagtgcgttccccttttcacagtcacgacggacactgtacaagcaagagttacctggcgtagtttcactatctgcagaatggggatatagtcttgaaacagcattttgagttcttttagcaatgcgatcaagggacagtagttgtattttattggattttacaccagggtgcgtttgctctaatactgctttacttttgtagttattctactgtgcttttagttgtatggacctcttctttctttgaggtcagacatttctttgcctactttctttgtgttcttgctgtctttcatctgccttgccctacggatagttgatgagtgaggtctggaggatgatgctgtatctttcttatggactacttactggttttaaaaaatccttagacctcagaaatatttttcatttatgttgaagtttgtagctcagtttaaatcgttggtacaaattttgacctggatgaggatggtattactgcattaaagtagaacacattatctgcataagatattatttctttgatttgaaaaaagtaagttttgttgctactacatgttcagaatttgattaaaaaaatttttttttgtataggctgaatcagatgttcacattgtggtccagggacccatgggattctctgacactgccagtttaaaattactttcgtaataatatgcagatgttatctttttcactctcattttttcagaagtgtacagtggagttttccagaggctacctgagttgtgatactgtaacagaaggaagtagatatgagaatctaacagttttctatttgaagccagacatttgttagaatgtacacagtgtgattcttctcactaaatgttttttgttttggaaaagttatttttcataaagaatacattatcattattattattattatttttgagacggagtctctctgtcgcccaggctgaagtgcagtggcgcgatctcggctcagtgctgcaacctgtgcctcctgggtttaagcgattctcctgcctcagcctccggagtagctgggaggcgcctgccaccaagttcggctaatttttgtatttttagtagtggagacggggtttcgccatgttggccaggcttgaagaatacattatttatgttaacatttaatacatttactttttaaaaaatgaaaacatgaagaacaattgttgcatagtggacaggtctatgcagtcctatccccaaaggctgaggaagctgagaggctgaggaatccagtttcttagaaagaaacctttaaaagggacttaagaacagaagccatgtcttgggtggccccaaggagatggtggatcaccccattacccgacccccaacccccaaccagagatgtgtaggacagttgcttaagagcaggatttatggtaagtgaaatagcgtcaaggttgtttgacctaagggcaagatcggtaagtgtatacttttacacaaggaacagtagataaaatataaatcttagaggcaatcccagaactggggttaatcataagtcaacatggcggatgttggagttgctttagccgccacaactatttaaaattttctcagttataatttctaagatgctaagtattgatacttgtagccaacataaacaaaaccttttggggttgtcaagaaatttaagtccgattttttaaaagatgtaattcacatagaatctgttcaccatttttaataaaaagttctgtgtttttggacagacacatacagtcattcaactaccatcacaatcaagatactgaacggtttcctcacccaccctaaattccttcctgcacttttgtgtaagctgtcccctatccttggcaagcattaatctgtttactaatttttagggatgtagagggctcctgagattccataatttgagaaccacgtgattattgaatacttatatagtatcatacagtaccagtacttgtaaggaggtaaaaatgatggaattcagacacaagagtgaacagtgtacctgtttagccttttacccgaagtgtgttagactgcccatttcctttgacagttctattattggtcttcaatatcttgccattctgatgatcagaaagcaatttttcatttatgtttgtcatggtactgatgtgtttgtgcctcttattggtcatttgtatttcatgtaaattgcttaatttttttttgtccattttcttattgggctgtaggttattgtcttctatttactgtctttgtggatcatggatattcattctatttatgtctgtagtccttttttcccataactcttgctatctttaactttgtttatattgtcttttattgcagaagtttaaaaaatctcataatatttttacttttccatgaaaaaatctattaatttttttctcctatgtcactattgggatttgtgcattttaagaaggggtttctcaggcctaaggttataaaaatactcgtccttgatctttttttaaaaaattctatagttctataaaagtataggttcgtaatctatctgcagtattttttgttgtatagatgttcctttgcaagtctggtcatggctggatagaacagttggaactcaatgatctcagcagagtatgctctatgctcattgaactggttctgctctagacctttactaagatcatcccacgtgcatagacctctggaatgtccttagttcttgtttgttttctttagcgtcccattttttttttttctgtgagctactgaagtccttccaatgaattctttatggcttaagtttgttggtttttgctgcttgtagccaagaacccgggttccatttctttttctagcctcttatatattaaagagtgttttgttgaatactaatgatagtgagtgactttgtcttactcctgatattcctgaatttaatgagaatgcttttaaagttttctcaagagtgatgtttgctataggtttttatgagggacactttaaggaagttttactttattcccaactttctaggatatccctatatctttacaccatcctggtggagaaggtgacatattttatcaagtgctatttttttttcaaaatctattgagatcatattgtgtttcccatttaaaaatgtaatgtagtgaattacattattacgttttttaaaaaatgatgaatcatccttatattcttggactaaactacttgatacattattttaattcattagggattttgatttggcagtacttcatgtaaaatttttgcatttatgtttataatagaaatgagcctattaggttattttattgtgtgaccctcagtttgggcccaaggttatgctgtttttgtaaaatagattgggaagctttccattttttaagcttggaatggtttatttaataggcattgcttgttctttgatatttggtagacttcaactatgtagttttatgtttcttggtatattttaatgggtaaatcttattttttttccaatccagacctaagtcattttggtaatttatgtctctctcaggaatcatctatttcttttagacttccaagtctattggagtaaatgtttacattatattgtagaaaatttctctggattctttggtagttaattcttaaatgttatctatttcacttgaatcttctggatcttaatcactttatgtcctatggtaatttttttacactccatatatgtctttttttcttctaactcattttgaataagatacatttgttcaggctcagtagatggagtgagtagcttgtattactctctatttatgtggtcagcattcctttttcatagtcagaactgaagctaatatgtgtgtactcctcctactccaacaccacttcttttagatttttacttagaatatgtatgcattacttaattggcaactttttcctatccccccagtgattgattctctagaactcacacctacagtaaactgtaattctcatatatcctactgccagagttcttcatatatttaccctctcagacgtgttactccttgagactttattttggtatgcactctgccactaacaatacctcactccgtactttcccaccatttatatcggatcttttgtactgtctgcctagatcttaaacaatgccaccagaagcaaaatgataaaggggattaactcttttctgcctaaggtgtgaaggactgcatcccatttttgtttggttcaggttttcggctttaaaatcccaggaaagataatactcctccagccttctatgtaacttttgcttcataagcaaagacataaaagacatcaggtaatacaacaagtgggattaattttttctttgtttacctccatttgtctcgtgaacaaacatgtgaatcctcctgaacccttgcgtgtgattggctatagttttcagtttgggctgatagtataagttttttttgtttgtttgtttttcttttctctgtctcctgggcattttattaggaagttggaatatgctgttttggtggttgctagtgagaagccattttaacaggaagtttacatcattacttttaatctatcttatcttacattttaaatgtctcttaagtcttcattaaaataaacacatttcttcaatcctacattcacatcaaaccaccattttgtgtaagacttcctgactacagtaatttctattacacacaaaatgtattgttttactctaaattctgccatgactattctgctaacctctctgaagtcatacataattaattttagcaaatattcattgaaactctgtattgggcattatattagatgtttaggataccgccatgaaagatgctgttatagccctaaagagacttattggtgctttttctttatttttgatagtgtcacataaggttgcactaccttttctacacaataatagtagccatcattgattttagatactgggagaacatttcagtatgttaattctattcctcacacattcctgtaaggtaggtattatttaactcattttatagatgaggaatagttttaagggataaaataacctcccttaagtcacatggtttagtaaattatggagctagttcttgactccagatctggttcattccaaaatttcttactattctgtgccttatctttgcatgaccatttactgttcctggtttcaataattagcaatttctcaataaggtgtcacttgacatggttattttctccaatgatttctgtcgtttctatgaattaaatcctggaataaagtttgtcattgttcctttcctgtaatttgtgggagatgaaagtttgtaagtctaggatttatcagttctgggcatcctggaaaggtgacagcagtggtggcagctgagttttgcaatatctttatgagtccccatgtaaaaacagggaaaagtgcaaaagtcataaatgtacagctcagtggattttcaaacacacccatatgcagataaaaatagaacatttatgacactccccaaagcccctttgttacatgatttaaagagccagaggccatgtgcacgggttcacatggcctgtggaggaaacacctgagcagtgtttcctccacaggggtctcagtctgggctctaaagagctcctccaccaagtttctaaattttaataatttcagcctattgttcccccagagtagtaactgctttctggaactgaactctgtgataatgtagtatttactttttgccttttcaataacctagttaacaattttatacctactgagttctatttaaataatggtattttctatctcctgactggacagatacccaggagtagggtttgaacttcctactttctggtttgcatatatcttattaagataactaaagtacttgctacttgccagtcttcagacccggtcagtgtaatgtcatcagtgcagcagatcagtgtgatgtgtgatttctcaatgtgatcaaaatctctggactattttagagagcaagagtgttaacatagacctgaagcaagactgtaatggttgaacaaagcacaaagtgcttctgagattttttgcaaattaataggaagaaaaaagcatttgcttccaagttataagaattgtgttgatttgaccccgtaaaaatactacatcttgaatactagctgcaattacagtcacgacctttctgtgtttataattcatagctattctccaagatccatctgtcttatatttagatcaaacaggtaagttagtggaatgtggtagctatcaccacctttttgtctttggttgtggcaccaatttctgtggtattgtttttggttactttgttggtgaggagaggaatacctaggggcttctatgtgatccattataccatattgctccttatgccataaatcagagaatctatatgggcattgagtcagttgccaagtatgtctgttctaattactcattaaggaactggggaataactgcaaggtgagtatgtggatctacctggcccactatgattcaaacttgatctaaggctgggtgcagtggctcacgcctgtaatcccagcactttgggaggctgaggcaggaggatcacttgaggccagaagtttgagaccagcctggccaacatagtgagaccccatctctgaaaaaatttaaaaaaatttaaaaaccaaaaaaatcccccaaacttgatctaaaactccttgaattgtgtcatagataatctgtaagcctctgttgcttacgtgattatttttaaataattttgatgaaaaagcatacttgaggcatataggatatgttgttcatttttctctctttttaaaaagaagataaatctataaaggggaaagactaaagcaaaagtaaactaatatgcaatttaaaaatatgtaatatgtagagttgaagttttaagaaggctagaacattcccatgcttctttctagaagttatgtcagccactagcaagttgaatgtcaactgttttgaaaatagctacagtgcaagtagttcttaaaaacagggacacactctggaactaaaatagactgagtacaagaaaataaagaagtcatgtatgcagtgcattaacaaaatatctttctaacttttgttataactgtaagttcataaaactattaagcgtagtctaatgattcattttgccagaatttgggattattttgtagatgtgattttaaatgtatttatggaagtacagtgtgactttatttttctttgtagctttcgtttcatgatgaagttatttatttatttatttatttatttttgatacagggtctcactgtgttgtctaggctgagtgcattggcactatcatggctcactgcagcctggaactcctgggctcagtgattcttccactttagcctcctgagtagctgagactacaggtgtgtactatcaagcctggctaattttttatattttgtggagatgggagtcttgctatgttgctcaagctggtctcgacctcctggactcaagcaatcctcccagcttggcctcccaaaccaaagtgttgtgattgcaggtgtgagccaccatgcctggctgaaagcattttgatattaaagttcatatgtaattatttgcattttaaacatcttatatttggaattagatttaggtctcaatgtgacaaatgttgctaagaattttggggaaaataattctattgatagcgtatttcaaacatcttaaggtaggacagagaaatttcttttttctcttctaaatgccagtacattaaaataaaataatttgagttggaagccaggtgtggtggctcatgcctgtaatcccagcactttgggaggctgaggcgggtgaatcacttgaggccaggagttccagaccagcgtggccaacatggtggaactctgtctctactaaaaatacaaaaattatttccaatttcatccatgtctctacaaaggacatgaactcatcattttttatggctgcatagtattccatggtgtatatgtgccacattttcttaatccagtctgtcattgttggacatttgggttggttccaagtctttgctgttgtgaataatgccgcaataaacatacgtgtgcatgtgtctttatagctgcatgatttatagtcctttgggtatatacccagtaatgggatggctgggtcaaatggtatttccagttctagatccctgagtaatcgccacactgacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttctctgatggccagcgatgatgagcattttttcatgtgttttttggctgcatagatgtcttcttttgagaagtgtctgttcatgtccttcgcccactttttgatggggttgtttgtttttttcttgtaaatttgtttgagttcattgtagattctgatgaaactggaaatcatcattctcagtaaactatcgcaagaacaaaaaaccaaacaccgcatattctcactcataggtgggaattgaacaatgagatcacatggacacagaaaggggaatatcacactctggggactgttgtggggtagggggaggggggagggatagcatcaggcgatatacctaatgctagatgacgagttagtgggttcagtgcgccagcatggcacatgtatacatatgtaactaacctgcacaatgtgcacatgtaccctaaaacttaaagtataaaaaaaaaatacaaaaattagcctggtgtggtggcgcgtgcctataatcccagctacttgggaggctgaggcatgagacgtgcttgaactcaggatgctgaggttgctgtgagccgagatcactccactgcactccagccttggcaacagagcgagaccctgtctcaaaataaataaataagtaattaagtaaataaataaatatagtttgagttagagacattgttcatatctagaatgttttattggccttttttttgggtgtttttttgactttgacatttaaaaaatataagccagttgttgttgttgtttgttgtttgtttttgttttctcagagtagccctcagtttgggtttgtctgattcgattagttcaggttgtatatttttgttagaaataaccacagaagtggccgggctcggtggctcacgcctgtaattccagcactttgggaggccgaggtgggtggatcacgagatcaggagtttgagaccagcctggccaacatagtgaaaccccgtctctactaaaaatacaaaaattagctgggcgtggtggcaggtgcctgtagtcacagctacttgggaggctgaggcaggagaattgcttgaacccaggaggtggaggttgtggtgagccaagatcgcatcactgcactccagcctggggaacagagcaagactctatctcaaagtaaaaaaaaaaaagagataccacagaagtgatgatgtgttctcagtgtatcatatcaggagtcacttgatgttatttacagtgatgtctgaaaggtttcccccactctcaagttattattttcctctacaattaataagtaattagttaagactcgtgttgaggtagtataaatatctattcctaagaaacctttcacctttaggtttattttgttactctgtttctcacctgtcttgttgaaagcttagtttatttatttcaacttctttattttccaatatacttaagattgtaaatttttcttaataaatcactttgacatattgtctgggagtgcttactgtagggtttgggatggaaggagacaataagtgagaatatcgtttataataatccattactaggaaactggcaatgacagcctaaacagaacagagtattttaaaggtgccaaagtgccaaaaatcacccattaacaaaatgtttccagtcttgctttaaagaataaaaggtatgatttttaatgattttgactggcacacctatgaataatagttgttgaaaattatgaatttaagaagtttatttgtttagtgcaacttgtactttggggcttgtttaataaatgtataatgatcacagaccatattttactttaccatttcaggagcagctgcattggcatggaagaatcctatttcaagctggtttactgctatgctccactgttttggtggaggaattttatcctgtctactgcttgcagagcctccattgaagtttcttgcaaaccacactaacatattactggcatcttcaatctggtaagctgccagtatggtgacctatgtgacatttaaacaattgtgttgtaaattgttagtaaaatgaatttttttttctttgaacaatattttacgtgcttgaaaagttaatgcatctgcaaggaaggaacccaaataatgctaaggggttttttttttttttttgagacggagtctcactctgttgcccaggctgaagtgcaatggcataatcttggctcactgcaacctccacctcctgggttcaagtgattcttctgcctcaacctctggagtagctggaattacagcacccgccctcacgcatggctaatttttgtatttttgtagagacggggtttcaccatgttggccaggctggtcttgaactcctgacgtgaggtgatctgcccgcctcggcctcccaaagtgctgggattacaggtgtgagccaccgcacccagccatgccaaaggctttaagtgtaaagtatatctctttcttttttattttcccttatcttctcccagaagcaattattgtctgccattgtcttatgtaccttttttgttgttgttgagacatagtcttgctatgtgcaagactgcaagtgcagtggcgcgctctcagcttgttgcgggacgcagaggattagagagaccagtatgcgtgaatacaggaggatatttattgtgaggtacacaccggctcagtggatttacctccaaaaagctgggccttgaataaagacagagcgaggtttttataagtgggctcataagagcaaaacaaaggtagttaatcatatagtgcataacttgtggccttgcatagctggtggccttttagctgtgtcaaaagaaaaacaagaattggctaaatacaggcatttgtaaaacaccgttatgcttaagaggcaagggaaaggagtaacaataaaggaatttgtctttctctctcttttttttttccttaaccttgctctggagggggcgggggtgtctggagcccattcctctgtccttggctttttggacagtgttataactgttcttgaattgagctgctaagcagaggaaaacttttttttttttctttttaacccttattacaggctcactgcaacctccacctcctgggttcaagcgattctcctgtctcagcctcccaagtggctgagattacaggcatgcgccaccacgtctggctaattttctgtatatttagtagagacggggtttcacaatgttggccaggctgttctcaaacttctgatgtcaagtgatctgcccgtctcagcctcccaaagtgctgagattacaggcgtgagccaccatgcccagcctgtcttatgtatctttaatagaagcatttccaatatgaaagggcattaagtatttggccctagagtttatcttgtgaacctaactgatacacgcagatatacaacatgataaaatcatgtatgtgaccaactgaaactaaccaaaaagtccaaataattatggctcatatttaattattcttctcatactctgttgattttatgagatctttaaattttataattttgaagtgaagaaaaaaatgttacccggaattgccttgaattcttgcaaatccaaattcgttatccttaagaggattgatccatcaagtttaaaataatctataataaaaattatagtttttttaatgtataaagcagaaactgttttctgttaagaaccatatcattaaatatataacaggaacacttacagttcatttttattgtgataattttaaaatgaatatgtaaccagttctaaaagggatattacaaataatagtagcaatgggaaaaagtaatcctgggaacctatggcaatgttgagttgttacgatatgtcagttaagttctttatattcattgttatatttaatcagaggagtactataaggtagctattattatttccatttgacaaatgataaaattgaggcatagggaaatgctgctataactttcttgtctagtaagtggttgagctagaatcaaaacaagaagtttttaactttagagtcttcacactttgtagccactatctctcacagatttgtttaaccatctcttaaagtgtagtcttccagttgctatgtgttttaaaaaactttcccaaagacttttatttctataacaatatttttaaaagttattagcattttggaagaattttttgatgtgtatagatgctgaaactatacaaaaaggaagatatccagaatttgatactttctgttatttctacttctgttcctataatactaacctcctggatgattgcaggagcttcctaagtggtcttgctgcttctttgattatccctttgagtctattcgttattcttcatggagcagacaaaattattacagttggccttctatacccatgggttttgcatgcttgaattcaaccagctgcagatcaaaaatatttggaaaaaaatccaataaaaaataacaatgcaacaataaaaataatgcaaataacaataatgtgtaacaactatttgtatagtatttacactgtattaggtattataaataatctagagatgatttaaagtgtagtggaggatgtgtgtaggttatgtacaaatcctctgctattttatataggggctctcacattcacagattttgaaggagaatcctgaaaccagtcccctacagatactgagggacaacttaagttagaacatgtcactcatgtgctcagtaatttcttatcttattaagaacaatatcccaaacttttaccatggcctgtaaaaccctgcaaaatactcgctttcactttcttttatgtaacgtcttacaactctattcttgctcagtttgctctagtcacatgagctttgctatttcttgaatgttccaacgtaaggtattcttctacctcaatgcctttgtactttctttcttctctttgtaatctttttttcctcagaagtctcatattttgttttatcagagaggccttccctgactaaagtagcacctcctctcccatgactatcacatcatccttctttatttttcttcttagaattattgctatccaacatgttatctgttgatttttttttttatgttgctctaactatactggaataatagcccatcagagagtgagccatcatgcctggcccctggctaatgtttaaaatttttatatttgttgagatgaggtctcactatgtttcccacgttggctattttttttttttttactgtcaaagttatttattcactatacatagaacatgtcccctataaaatgtacatgtaaatcactaaaaagtaaaatttggtgaacattttctcaattacagaacatactacatcagttgggataatagctgtctaccttaaaataatctaattatagcacccagtctcgtttatatctaatgcaaagttaaatacttattttgggggttatttcctagtatgtgtttggtgaggctgagtaaacaatttaatataactccagtatattacagtcactgcacaataaatcagtttattacagattaaaacaaatcattttttaattatttgtaataatgggatcagacaaacacgggataattttaaatggcatataaccacacaattacttatctttgatagtatattgggttctataattatattaagatatgaatggtgtaaaatattgtaacgaataatacatctcaaacaagacaattaggccatactgtaatcattcactagattgtacccagtagacatttactgaataagggaattatctacttttctcctcaattaaccagtacaatgttttgcccacagtgtcagcactcaataaatatttgctgaacatactgactaggatagaggtgagaagagatgggccctcttagctggatgtcgaatataattggaatttacctgggaaggagagtagttaaggaagatgtaaactgcatgtggtgtacaagtaaataaacgcagatgccaacaaagccaatgattaagcagaaaacactgacaccaaaataaacaaaggcaagatttgccaataatggcgaaaatggaacttttatattggaccataacttttcccacctaaatcagtttgaggcagaccaacagaggcactgtaagagactacggctgtcttccttgatattcagacatcctagtttccaataatttattatggacctattacccatgaatcaatatacgcttattcatatttagggattagtttccgcaagtacaaagttgaatgtccttttatttgtcctaaaatgcttactttcaaacttgaggggacttcaattattccatgtagttttcgataacattcttttatcttttcagaccagagtcaaaatatttgtacagtattcatactgcagcaccttccacacacccctttgtcacttgaactgcccttctttggttctttttccactttcagatctttcttgaagtctagtaagcacaactgtactggatattccagctacagtttggtctgtcattgtcggaatggcttctgctactctgtggtcttccagccagtctatttctaggattatatgatcttctatagttgttatgaaaagactgacttcatgatctccttctttcataacttcggcttctaggacgtctgtatctgtcataatcatcatagcgtgaagaactgtacatattcctcccttccttggctttcatctgatttggtgtcttccgatccccctgggcaaactgtatttcaatctgccctccacaaatccactttctgtccaaattatataaagtgtcttcagcatcaggaacaccctcaaattgaacagaagcaaatcctctcttggatggtgagtgtggaaatcaagtggaacatacacatcaactataggatcataacgaccaaattcacaccgtaaatcttcagacctggtgtcgttggctatgttcctgacaaacagagacatgttggggagacggcaggtagcgggacatgaaggctgcgtgtctccactgggtgcactaacgggcccagcaaaccgtccatggctctggctgccaagcctcagacacacacagccagagggctccgctatggcaaccgcctcttttcctgagacttcactcccacctccactgcccacctcctacctctgcgcaaagctgggaccacggtggttctttcccgcaagatcaccaggcagctggtgatttttttaaatgcaaaatttcaagtaatactgaattagttacaaaaagtatttataaagttatgcaaaatagaattgtgatataatgaagttatatatccatcatttagattaggaaaaaaattgtcacttaaataaatctttgtattaaaaagtgaaaatagctgggcacggtagctcaggcgtgtaatcccagcactttgggaggccgaggtgggcggatcacctgaggtcaggagttcgaaaccagcctggccaacatggtgaaaccctgtctctactaaaattacaaaaattagctgagcgtggtggcctgtgcctgtagtcccagctacttgggaggctgaggcaggagaacagcttgaacctgggaggtgggggttgcagtgaaccgagatcgtgccactgcactccagcctgagtaacagacctagactctgtctcaaaaaaaaagaaaagaaaagaaaaaggaaaatacagaaaaccacaaagccaaacataagacctaatgaattattataaggtacatccttgtaaccactacccaaatcaagaaatacaactttgcgcctgggacagttgctcatgcctgtaatcccagcactttgggaggctgaggcatcgcttgagcccaggagttcgaacaactggtaaaacctggtctctaccaaaaattagctgagtgtcgtgacgcatgcctgtagtcccagctatttggaaggctgaagtgggagaatcacctgaaccctggaagtcgaggctgcagtgagctgtgattgcaccactgcactccagcctgcacgtaggagtgagaccctgtctccaaaaaaaaaaaaaaaagataagaaaagaaatacaactttgtcacttacctccttaccttagaagtcctttttgtgtgtcccattccaatcctaacccccttctctctcttttttttctggagacggagtcttgctctgttgcccaggttggagtggagtggctctcggctcactgcaatttctgcctcccaggttcaagcagttcttctgcctcagcctgagtagctgggactaaaggtgcatgaaactatgcccagctaatttttctatttttagtgcagccggggtttcaccacgttggccaggctggtctcgaattcctgagctcaagtgacctgcctgcattggcctcccaaggtgctgggattacaggcttgagccactgtgcccgaccgacttcccactttaaataaccattatgataacataccagtatcctgacttttatggtaatcacttttttgaatattttaataattttatcactcagtgcttatccttagatactatagtttagtcatgcctattcaaaaatttcatttgtttcttaagctttttaaaaaaatggttaacccttaatttctttcttttccttaaactttatctgttgaagaaccagagccagtcgatttgcagttttccatagtccagagtttgctgattgcataatcatggtatagatcattatattcttctgttctttgtgtttcctcacagttggaagattgatgcagaatccaaatcagatttaggctagatccctttaccaagacttctaagaggtcccattttgtgacattagcacccttttacatttagtgcctattaattagaaattgcaaaatgaagatagtctagttttatcttttcttcttatttattagttggaatattactataaatgatgacagccgcaggccatctggtgtggctgctgccatcatgtcagctgcttcagggagggcacagggagaaggcggacagccccacaccccccacagcccaccagccacccttggggtctccacgatggggctgggccaggctggttcctgcaccggccaagggggagcttcaggtcgcccctgagctttggggccacaaagggagcttgcatggcaatgttgcccctgtcctggatgccagcccaggcccagtgaggacctggagcccccaccctaggctgtgaggggacttggcccagtgccatgcaccacggagcagagggagctggggacatgcgggagccctgccccttccaagttggtggggctggagctccccaggtgcaactgcagctgcccaagtcatggctgcaacccaggcacccctctgctcttgggagccaggagtaggcagtagagggcagggctgcagccttcaagtagtggctgcaatccctgacctgccgctccacggagcaggcaggatccccactccaaacccctccccgacagctgcagccccccaaaccggggctgcagacccaggcatacctgcactcttgtggggtctgggaagggcccccttgctgttgcaggcttggaggtgcctgctcccgctgcctggcctctccccaatcttggagcaaggttggggctgggttggggctgagcctaggcgctgtcacagcctggctgggtgtgccattgcttggggcagtgctgacgtgccagccccctgccaccttggccccctctggactttgggtgctgaagagtgcgggaggggaaactgaggggtggctgagggtggccaggcgctggcctgcaggtgccccttggtgccaacagcctggacatgatggatgacgtgggaggcagacaggcttcttggtggaagggggcgggttcccagtgaagccccaccttcaggcttgggcaggtctgaagcctggagctgggctgccagtcctgccaccagaggcggaactcatagtgccttttcctgggcccacccatggcttcccatggctgctcatggacaaatcagcatgcatttctctcctctgaggcccataaaagctctgggctcagccagggcagggcagagtaggaagagttgactggccagttgcagagaggacctaccctctttggggccacctctgctgagagctgtagacatggggatgaccagctgcagggaggagctaccctgtctgctgagagctgagcacggaggagttaccctctctgcagggcctcctctctgctgagagctgcagatgtggggatgaccagctgcagagaggagctaccctctctgttgagagccgagcacttgttgggatgacctgcctacaaaccgcagagaggagcctcctccctgctgagagctgcagagacaatgggaggacctgcttgcagagaggagccacccaccttcctctcagctgacagctgcacactcaacaggatgacctgcctacaaagaggagctacccactgtgggtcttctctgagctgctctaacactaaacaaagcttctctttgtcttgctcaccctccacttgtctgaatacttcattcttcctggacgcaggacaagagcttggtcaagggtgccaccagccacaaaggtttctgcccagaaaagtgacatcccaaagatcccaaaatacaaatagatacttcctgtttatcatctatttggaaaccagctatacagttcatactggaaaggtaatgcttggttctttcccttcatttaccagttttcagtataatgaactggatgtctgtcattgtctaaagataccagcttaaataaaataattatgagctcatggactaactatatttcattggtttcaataaaatttcagttattttcatatcgaagctcaaattatcccatcttcagccagtggaagcctcttcagatagactcctgagacagattttgaattagtttactttctacctggtgttgtaagattcattgtgtgcttttcttctggaatcacttgtttctctaagacgttctggtttcttttggtgagcaatggcatttcaagaccacaatttgagtgctagagacgctcactgttattgggttgatcattatgtctaggcctttttagtgaacagagctaggaaaaatgaagataaaataactcatgactttatattcatatttctaattcaaattcaggaccatatagctttttaaaattttttccctgttacatatatatctcctttcttccaccctaagaatttggtttcttaaggacataggatgtgattaaattaatatattctaacattactgatttttttctgtattatgcacacagtagtcttagagtaatgttaaagactaccaaagaaatgattacagaaaattattattgcatatgttctattaattctcccattttaacaataaatgtactattttacactgtcattttaaatatattactccattttcttctggcttaaagcactgctgtgaaagtctggtgatcttttaattttctttctcttttaagatcttttttttctagatccctaaagatttattttttcattaaggtccagtcatttaaataaaatatcttggtgttcgttgttgtgcgacagtattctcttctacatggtgtgttctttttggtacctacacttttttttaattgagaaagtaatactagtatttgtattcttcctttgcattggttaagaactcttattattggtatattggctcttctttgcctttcttcaaggattttttaaaaatctatatttctaaaaaaattaacctgcttttcacttgtttttctcttttctcttttctcctgctgtttctttgaagacactatctgttatgtttctctttgtgttttctggtttgttttttattttggaaatgattttttttcttttatctcttactctctcctgagtgttgaatctttggttctcagttttgcttattcttatgtgtgttcttttatgtcttacatgactttcttaatgtctttagcttgttttgaaatcatagtttacagttttgatctgttttgtttgcacattttcctgagtgcttacattgtctatagggatttattctgcttattttttttcttgtaataactttgtataggatttgatcttgatacttttggtcatttttatatgaaattggctttcataaacttgcagaatgtggtggaaatattttcttgacttcacagagctcctgcttttgtttttatgtagtgttcaaaagatgaggacctgctttttgatatttcttggatctcttaccttccttggcttggtgtggaccttttctttcttctgttctattctgctcaggtttgattcttcccagtttcttctcagtgtggggagctcaggcttgattcttctcagtttcttctcagtgtggggcttattatagaagagagccctggtgggtcagtttcaaaagcttaaagctcagagggactaaattgttccaaccctttcagaacttcttatcatgggctctttgtcttatctggtattagagatgccagaacctctgtcagttgtagcatttgtgtgtgtgtgtgtgtatatttccaaatgagtctgctctgctttccagtgaatacccgttagctattttggtatgattttggtcttaagttcatcagttgccaccttgttgctttcttctttctgccaagtagtacagtgttgtgggtgttagtgatttttctctacccacttgcattttggggtttgaggggataccttgtcacatagttttgttgtaagtacagttgacccttgaacaacatgaatttgaactgtgtgaatccacttatgtgcagattttcttctgcctctgccacccctgagatagcaagaccaatccctcctcctcgtcagcctactctttgtgaagatgaagaagaatggagactttcatgatgatccacttccacttaatgaataataaatacattatctcttccttaacattttcttaaacattttctgtggcttaattataagaatacatcagggacaggtaggtgacagtgaaaaaattatgtaatacatatgacataaaaaaatctgttaatcacctgttcatagtattggtgaggcttgtggtcaacagtaaggtattaatagtcagattttggagagtcagaagttatatgtggtgttttgattgcataggggttggcatccctaacccccatgttgttgaagagtcaactattgtgcgtgggattttggttttcctgtcttgtttctctgtatgtttttatgggaatttgaagagtatcagaatgtatgcagccactaccatcttctcagaacccttaccattagtttttatgtcacttctatggtctcctcccattccatctcttttcttccgccttcagaagtaaccattatcttcaacttcatgatgcccagagaaataactagaagcaataaaaatgctcatccacagaagaaaaaatatggatattaatataatggcattatctaatagagtttaagaatcactttcctaaaataaatctttaagcatataacaagagaaaatgttgcttatgtacagatatgtgcaagaatgtttttaaaacactatttataatagggaaaactgggaacaactctctgtcagcagagaaatgatggataaattatggcatattaattctgttacggtaaatactggtgaaaattagtaattataaccacacacaataagaataaatctcaggaatagagcttaaacagaaaaatacatatgattctatttataaaacctttaacaactatattgtttatggatataaacatatgctaaaactacataaaaaagctaagatttgtattcaacattatgttactaagattcatctgtttgtttgtatgtagctgtagaacataacttccccctgctgtatagtccattatattaatatctatattttattcttttgttgatggcagttttcttggttctaggtgtttagttaggcattacaaaacaacaataatagcaattacatagcatttactgtgtcccagttttctaagtgttttgcttatgttatctcacttaaacctgacaagaaccctgagacgtaggtattattttattcaattacgtgttaaaaagcatgtaattgaggcatggagaggttaataacttgcctaaggtgtcacagttactgagtagttgaagctgggattccaacctggcgcagctagtcctttaatctgtacttacacagtatattggtttgtactctggaaacaggaatgttacctttgtcttcagagatccttaaatataaaaaaattatggcttaaagacatagtgtattttactattttctttttcaaagttttcatatttagaacaaatttgtaatctttgcttcatttgaggtttttttttttttttagatggggtcttgctcttgttgcctaggctggagtgcaatggcacgatctcagctcactgcaacctccgcctcctgggttcaagtgattctcctgcctcagcctcccaagtagctgggattataggcgcccgccaccatgctggctaatttttgtgttttttagtagagatggggtttctccatgttttgtcaggctaatcttgaagtcttcacctcgtgatcctcccgccttggcctcccaaagtgctgggattacaggcatgagccaccgtgccctgcccatttgattttaatttgagagataaaatgatgttagaaatgtttttaaacaagcaagcaaggtaatctttagtacagtagctcatagtgtatacatctggaaattagcaccatctactggcaaagagaaacaataacttggtatgtcatagtattgtgtacactttcataggttttatttgttttgaaaagctgttcccgggggaaataaatattttataattttttagtatgtttatttttgtttcctatatatttttcttaaaattccaagtatcaattacttatatatggcacatttgtgtaaccgagactacatttagatgaggaaaaatacaacaaaaggtatcattttatagttgtcattctgtctgtatttttcaaagcatgtacaaaaaattttcaatttgttggagtgataagagcaagaacaaagctgtcatactggactaacatgaactgtatttagtttatcattgtgttttgtcttagttaagtgatactgtcttcgatagaggagtggaattgatagtagagtgaaaacagagttctcaatgactaagcctgggaagcttctctctgcctaactttttgtatatacctaaattctactctcactttttcttaaactggttgagatttcatttgtttgtggcctagggtcttgtttgtatcccgtttgagacgtttattctttcgttattttttctctccattaacttaacctatagttaaatgtatgagaagtcagttgttttctcattccacttcctctctcattttgtgatatgttttctttaggcactttacaagttaaagttaccttggatatgataattttagttaaaggtgaaattatgtttacagaagggttacaaggttattacctaataagtgttggttgagggatttattaaaagaattttaaaggctaatttgttatagagcaggaatggttgttgagtgtgccattggtctgatatgtttacttgtaagtctactgagcacaataaacaattgttcttttgccctgtggctacttaactctcaaatgaaaacagtttttttgtttaaaatgttaacttattgtaggtgtgctttagaaagatctgattaaatagaagagttgcaataattgcaaattttttaatgtcttatactataatgtcacatagttgaataccgaagtccaagattgctattgtaatagtataggtttttaactcacgttaaagttaggcttagtgtaaggaatgaaaatgggtcatttataacattcttttggttgtttttctgaatattttacttttgggtgctcattactgctaaggtgaaaacaaatccccctttcttaatgtaatctataatagatataaaaatacatttaaaaattaagtgtgtatacttttcccccattacctaaccaacttcttagaaattagttctatattcaaagagagaactatacagactttcaaattttctatgaatgtgtaaaaattttaaatcatactagttgtttttaaaaatcttatagaacatgtacaattttaaagccatacaaatggtcttcagaaatctttttactactctcagatagtttattcttttttctcaaactctttaattatcaactaatgctttgatttgctgtattttggattttgaatccagattgactgctaataaatgatttaattcagggctacttttcatcatgctgagttttaggttagagggtaacaagatgaatgatttctgtcatctaagaactattgtagttcattatgagcattatagcctttattttatattataaagaataatgtataaagagctatttttaggcataggaaccaattggtttagttttacagagccatcagaatgtagtctgagctgagatgttaaaataaaataagaatcccaaagtcaatgactatggtaatatttgagtggcaccttgaagagtaggaaggaattggtaagtggagatgaagaagaaagggtgctttaggctaaacagactattgtatctttttatttagtcgctgaagcagtattttggcaaacatttcatatttcatgaacattgaagaattctgactttataaatcgtgaattgcaataagattaatagcttcttttaaaagagatatgatattctttcatgccatgtcttttatttaccccgttagaaagaagatatgttctactttaagcacaaaattgtcagccagagtatttggagaatggagagaaaaaagcagtatgttttccaatagatcttactgctagtattcgaatagatgcttagaacaaatgaagtttaaaaaaataatttaccatagatgggatgaattatttttaatcacagtttaatttggttaaaacttaagcttagtgaactaaattaaagaacagcttcatattctttcagctgtatagaaatgtgtttttccttaatacaaatctgcctccttgtgagccgtcatgtacctttgtatagattgtagtttatgtcctgcacagtggggcacaggtgaatatgttatttgagattgaaatgtagcccttgcttttaccaaaggaccctttctctaattcattttcccagaggacaaagacactgtgtaggagttcctacccctggaaatgattatacatttgttttgttactggattcagcacttagcttctagaacaatataggcacaaattaagagctcactaaatatttcatatatctataaagtattcagaagtccacagtttacattcttctctgatcatgactttttggcagatgacatatgtttcatgtgatttaaaaaattgcctccctacccaagttgtgcttttattgaaatcaagttaaatgtttatatggaaaattccatttgttgtgttttgccaaattgttgttgctgttaggttagattttaatttctgttcttctgattccattaatatattaaaatgtttacatttcattttcaggtatattacatttttttgcccgcatgacctagtttcccagggctattcatatctacctgttcaactactggcttcgggaatgaaggaagtgaccagaacttggaaaatagtaggtggagtcacacatgctaatagctattacaaaaatggctggatagtcatgatagctattggatgggcccgaggtaatattgacaatatgtgttcataaatattctgttgttggtgtattattaataccattactgaacaattctctagttacattaatggatcacatactttaataacagagactttttggaaggtaaaaaccttgtttctgttggctggtaaagttaattcaaaactagtactagtcctaagccattattttgagcctgagtgtcttatgatagaaaatttttatgattggtttgattaagatccccagaaccagaaagatttatagttaattaaggtatagtgcctctgtaaataaaataagtttacataagaaattatgtggtacatatgaataaaaaatattgctctgtcttttctgtgtttttttcattcagaattactagaaataataaatatgattgactatgggttcatgatcattgaactttacatcacttgcctttttgttttgcatgtaggaattgaacaaatctctgtaacctctttttacagtatactgcacctgaaaccggtcgtatcaggaaaggaaatgataaagcagaggattttatttttcagttctgaaacaaacttctaaccatatctttgtgcccgaggccccagttttaacagttgacatgctggtgaaagggaagaattgcagttgttttagtaccctaaatgtacaaggcaacttttttcttctttccaagaattatattttgggaatcctcttggaatgtattatcaggtgatagaattatggctccctttaaatatgttttacaggaaaatttggccaaatattcttgttttattttcatatttttaggtgcaggtggtaccattataacgaattttgagaggttggtaaaaggagattggaaaccagaaggtgatgaatggctgaagatgtcatagtaagttggtataaattatactgagacctagatgtttatccttagatcttaccaaattcctttttaagaacattttagggactttaaatgtgggtggaatatagctgaaaatataaatagtaatgataatgggaagagaactagcaaattttgttcttttaaaaagtctgctttctcaaatgtagtttaaaatatatattttccttctctgtgggtttctctccttagaaaacaaaatcaaacaaaaacctctagattatagtagaattgtgggaaaagtatatatttataaagtgaaagctacgtaggaatagacttctctggatgaaaatgaatcggtgataggctcttggcattttcattaatgactatgacatcatccagatttcaggctatatatgtagttctgatagtaaaatgttaagtttatgggatcaaatcaatacattatcataaagtgctttgagttgctttaaaaaatgtcagttgagcttaattacagattaaaataagagaaagattagagaaataacccattgtgtgatacaaactgccttttgcatctatttaagataatctgttctctgaagacactgacttagtcttatttattacttttttaaagagacagattctgttgttcaggctttagtgcgatggtgtagtcatagctcactgcagcctagacctcttaggctcaagtaatcctcccacttcagcctcccaagtattaatagttgggactacaggtgtgtgctatcatgcctggctaatttttgtaattgtattttttttttttttttgagacagggttttattctgtcacccaggctagagtgcagtcactgcagtcttgatctcttgggctcaagtgatccttccacctcagcctcctgagtagttgtgactacaggcatctgccatcatgccctgctacttttaaaaatttttgtagagacagggtctcatctcagtatgttgccttggctggtcttgaattcctgggctcaagcgatccttgtactttggcctccaaaagtgctgggattacagatgtgaagcaccacacccagccagtatttttatttttgtagagatggggtcttgctgtgttgcccaggctggtcttaacttttgcctcaagtgatcttccttccttagcctcccaaggggcagggattacaggcatgagccactgtgcctggccgaactcagtctttattttgttttgagtcagagtttcgctgttgtcacccagaccagagtgcaatggtgtggtctcgggctcactgcaacctccgcctcccaggttcaagcagttctcctgcctcagcctcctaagtacctgggattttgggcgtgtgccaccatgcccagctaatttttgtatttttagttgagatgtggtttcaccatgttggccaggctggcctcaaactcctgacctcaggtgatccacccaccttggcctcccaaagtgctgggattacaggcttgagccactgtgcctggcccagactcagtcttaaataagtcacagatacgtttctcatgtacctaaaaatgaggtagagaagtatagttactgttcccataattcaagaaggaaaagacttagagaatggtggctgtaataagcaaggtgaggaaagacttcatgtaaaaataagctcattttctaatttaaattggattaaaaatagattataatggattgaaaatgaaggttgaggctgggcacggtggcgtatgcctgtaatcctagcactttgggaggccgaggcaggcgtcaggagttcgacacgagcctgggcaacatggtgaaaccccgtctctactaaaaatacaaaaactaactgggcgtgatggcatatacctataatcccagctactcaggaggctgaggcaggagaatcacttgaacctgggaggcagaagttgcaatgagctgagatcgcaccactgcactccagcctgggtgacagaggtgagactctgtctcaaaaaaaaaaaaaagaagaaggtggaaaggcagtacaagtgatgaagtacatttgtgtgaactaacaaatttcgggatatttaacttgaaaaatacccctttaagtttgaatgaagtagtttagaaatagaacaaaggaagctttgattaacgataagttataaataagatactcttgatattcaggggagatttttctcattttgagtatatgccttgaaacaccttccataaaacatttttttgggcttttataaccaaaatcaaattatgtttctactttgttcagaaaccttgcattgattcctccaaacggcctataagtccctccaaatgtgcctttcctcctttccagtttgctttgatttcatctcttgttattatttcccttgctcactctactccatgcttgagcaagtcaagtatggtctagtttagcactagcttttgtcactacctagaacgatttttcttagatggctaactcccttatttactttgctcaaagtattttctcaatgcttccttctcagtgaggactaacctgcttaaaattgcaacacctcgttctattttactttttttacaacatttatcaccttctaacatgttatgtaatttacttaatcattatgtttattctcccctccccttggctcctcctcccacccttcaacgaatataaaatgctagggacagatatttttgtctcttttgaatgctcttgtgtcccaagcacctagcacatagtagataatacatactagatgactgtatgaattatcaacaactgggtcaagtgagatagatcactggttcattatgatggtttgtgtttatgtatatagtcatgtgttgcttaacgatggggatatgttctcagaaatgtgtcatttcatcattatgtgaatgttatcaagtatacttacacaaacctagatggtatagtctactacacacctaggctatatggtatagcccatttctgttaggctacaaacctttacagcatgttactgtagtgactactataggcaattttaacgtagtagtaggtatttgtgtatctaaacatacctaaagagaaaagatgtggtaaaaatatggtctgaaagataaaaaatgatacacttgtatagggtacttagcaagaatgaaggtggcaggactggaagttgctctctgtgagccactgagcaaatggtaagtgaagacctaggacattagtgtgcactactgtagactttataaacactgtacactgaggcaacactaaatgtatagaaaaaattgttctttaataataaattaaccttagcttactgtaacttttttcttttttaaaaaatttccctttacttatttttaaaaatttttaagtattatgggtacataatagtacatatttatggggtacatgtgatattttgaaccaggcatgcagtgtgtagcgacatcaaggtaattgggatatccatcacttcaagcatttatcatttctttgtattaggaacattctaattctactcttttagttattttgaaatgtacaataaattattgttaactatattgtactactatgctaccaaatactagatcttattccttctaactgtaatatttttacttgataaactttaaatttttaaaaactttttgaagctttcgtagtaacacttagcttaaacacaaacattatacagttgtataaaaatattttctttgtattcttattctataagtgtttttctgtttttaagatttgttttttactttttaaactttttttgttaaaaatgaagacataaacacacacattagcctcggcctacccagggtcaggatcatcaatatcatcatcttccacctccacatcttgtcccacttgaaggtcttaggggcaataatgcacatggagctttcatctcctataataacagtgccttcttctggaatatttcctgaaggatctgactgaggctgttttacagttcacttaaaaaataaataaataaataatagaaagaggccagctgcagtggctcatgtctgtaatcctagtactatgggaggctgttgcaatctctatcttttaattggagggcttggtccaattaatttgtaacttggggtgataaaatatatgagtatatataaattgtattaaaataacataattattgatatggttgcatttaggtctatgattttattatttattgtttcctctagtccttttttttgccttctgttgaatccaagagagtatttgtaggaattccattttaatttacttgttggcttattagctatacctccttgaattattatttttactggttgtactagcaattatatcttcaatttttcatagactactgagaacattatactgcttcatattcatcatctcacatagtttcttattttgtgtgtgtgcagcaggagcagccacagtctacccatttaacaaaaatcctgaatacattacactataattagctatcgtccttgtgttatacattagatctttagacttgttcatcctacatgtgtgcttctttgtatccactgacctatatttcacatttcctcccccgaccctgcccactggtaattgctgttgtattctctgtccttgtatatttgactttttttccccgagatcccatgtgagatcatgcagtaattttctttctgtgtctgatttatttcattcagcataatgtcctctagattcatccatgttgtagcaaatggcaagatctccctttataaggctaaatagtattccattgcatatacaaggtgactatctcttatttgaagtggttgggaccagaagtgttgtggatttcagatatttttggattttggaatatttgtattatatacttacttggttgagcatcccaaattcaaaaacctgaagaccaaaatgttccaatgagcctttcttttgatcatgttggtactccaaaagtttagtattttagaagatttagaatttcagatttttggattagggatgctcaacctgtatatatcacagtttctttatccattcatctgttgatatggtttgggtgtttgtcccctccagttcatgttgaaatgtgattcccaatgttggaggtggggactggtgggaggtgattggatcatgggggtggatccctcatgaattatttattaccatcctcttgtgataagtgagttcttgttcactgagttcacacaagatctggttgtttgaaagtctggttcctttccctcctcgttctcttgttcccagtctcaccatgtgatgtcctccctttttgccttctgccatgattgtaagtttcctgaggctctcactagaagctgggcagattttggtgccactcttgtacctcctgcagaactgtgagccaattaagccacttttctttataaattaccaagcctcatgtatttcttttttaaaaatcattattattatactttaagttctagggtacatgtgtacaacgtgcaggtttgttacataggtatacatgtgccgtgttggtttgctgtacctatcaactcgtcatttacattaggtatttctcctaacactatctctctcccagccccccagcccccaacaagcccccgtgtttgatgttcccctctctgtgtccatgtgttctcattattcaacttccacttatgagtgagaacatgcggtgtttggttttctgttgttgtgatggtttgctgagaatgatgatttacagcttcatccgtgtccctgtaaaggacatgaactcatccttttttatggctgcataatattccatggtgtatatgtgccacattttatccaggttattattgatggacattttggttggttccaagtctttgctattatgaatagtgccgcagtaaacatacgtgtgcatgtgtctttacagcagcatgatttataatcctttgggtatatacccagtaatgggatgactgggtcaaatggtatttctagttctagatccttgaggaatcaccactgtcttccacaatggttgaactaatttacactcccaccaacagtgttcctatttctccacatcctctccagcatctgttgtttcttgactttttaatgatcgcccttctgactggcgtgagatggtatctcattgtggttttgatttgcatttctctcatgaccagtgataatgaacattttttcatatgtctgttggctgcattaatgtcttcttttgagaagggtctgttcatatcctttgcccactttttgatggagttgtttgatttttttcttgtaaatttgtttaagttctttgtagattctggatattagcactttgtcagatgagtagattgcaaaaattttctcccgttctgtaggttgcctgttcactctgatggtagttgcttttgctgtgcagaagctctttagtttaattagatcccatttgtcaattttggcttttgttgccattgcttttggtgttttagtcatgaagtctttgcccatgcctatgtcctgaatggcattgcctaggttttcttccagggattttatggttttaggtctaacatttcagtctttaatccatcttgaattaatttttgtataaggtgtaaggaagggatccggtttcagctttctacatatggctagtcagttttcccagcaccatttattaaatagggaatcctttctccattgcttgtttttctcaggtttgtcaaagatcagatggttgtagctgtgtagtgttatctctaaggtctctgttctgttccattggtctacatctctgttttggtaccagtaccatgctattttggttactgtagccttgtagtatagtttgaagtcaggtagcgtgatgcctccagctttgttctttttgcttagggttttcttggctctgcaggctcttttttgtttccatataaactttaaagtagttttttccaattctgtgaagaaagtcattggtagcttgatggggatgtcattgactctataaattaccttgggcagtatggccattttcacaatattgattcttcctacccatgagcaaggaatgttctttcatttgtttgtgtcctcttttattttgttgagcagtggtttgtagttctccttgaagaggtccttcacatcccttgtaagttggattcctaggtattttattctctttgtagtaattgtgaatgggagttcactcatgatttggctctcggtctgttcttggtgtacaggaatgcttgtgatttttgcacattgattttgtatcctgaaaatttgctgaagttgcttatcagtttaaggagattttaggctgagacgatggggttttctaaatatacaatcatgtcatctgaaaacagagacaatttgaattcctctcttcctatttgaatacgctttatttctttctctttcctttttgccctggccagaccttccaatactatgttgaataggagtggtgagagagggcatccttgtcttgtgccggttttcaaagggaatgcgtccagtttttgcccattcagtatgatactggctgtgggtttgtcataaatagctcttattattttgagatacgtttcagcaatacctagtttattgagagtttttagcatgaaaggctgttgaatttttttgaaggccttttctgcatctattgagataatcatgtggttttttcgttggtcctgtttggattacgtttattgatttgcgtatgttgaaccagccttgcatcccaaggatgaagccaacttgatcgtggtggataaactttttgatgtgctgctggatttggtttgccagtattttattgaggatttttccatccatgttcatcagggatattggcctaaaattctctttattcgttgttgccaggctttggtatcaggatgatgctggcctcataaaatgagttagggaggattccctctttttctgttgattagaatagtttcagaaggaatggtactagctcctctttatacctcctgtagaatttggctgtgaatccatctggtcctggactttttttggttggtaagctattaattattgcctcaatttcagagcctgttattggtctattcagagattcaacttcttcctggtttagtcttgggagggtgtatgtgtccaggaatttatccatttctgctagattttctagtttatttgagtagaggtgtttatagtattctctgatggtaatttgtatttctgtgggatcggtgttggtatcccctttatcattttttattgcgtctatttgattcttctctcttttcttctttattagtcttgctagccatctatctattttgttatcttttcaaaaaaccagctcctggattcattgattttttgaagggttttttgtgtctctatctccttcagttctgcattgatcttagttatttcttgccttctgctagcttttgaatgtgtttgctcttgcttctctaattcttttaattgtgatcttagggtgttgattttaggtctttcctgctttctcttgtgggcatttagtgctataaatttccctctacacaccactttaaatgtgccccagagattctggtacgttgtagctttgttctcattggtttcaaagaacatctttattattattattattattattattatactttaagttctagggtacatgcgcacaaagtgcaggtttgttacatatgtatacatgtgtcatgttggtgtgctgcacccattaactcgtcatttatattaggtatttctcttaatgctatcccttccccctccctctcaccccacgacaggccctggtctgtgaggttccccaccctgtgtccaagtgttctcattgttcaacttccacttatgagtgagaacatgtagtgtttggttttctgtccttgtgatagtttgctcaggatgatggtttctagcttcatccatggccctacaaaggacatgaactcatccttttttatggctgcatagtattccatggtgtatatgtgccacattttcttaatccagtctatcattgttggatatttgggttggttccaagtctttgctattgtgattagtgcagcaataaacatacgtgtgtatgtgtctttatagcagcatgatttataatcctttaggtatatacccagtaatgggatcgctgggttaaatggtatttctagttctagatccctgaggaatcgccacactgtcttccacaatggttgaactagtttacagtcccaccaacagtgtaaaagtgttcctatttctccacatcctctccagcacctgttgtttcctgactttttaatgatcaccattctaactggcatgagatggtatctcattgtgtttttgatttgcatttctctcatgaccagtagtgatgagcattttttcatatgtctgttggctgcaaaaaagtcttcttttgagaagtgtctgttcatatccttcacccacttttcgatggggttgtttgatttttttcttgtaaatttgtttaagttctttgtagattctggatattagcactttgtcagatgggtagattgcaaaaattttctcccattctgtaggttgcctgttcactctgatggtagtttcttttgctgtgcagaagctcttgagtttaattagatcccatttgtcaattttggcttttgttgccattgcttttggtgttttagtcatgaagtctttgcccatgcctttgtcctgaatggtattgcctaggttttcttccagggattttatggttttaggtctaacatttcagtctttaatccatcttgaattaatttttgtataaggtgtaaggaagggatgcagtttctgttttctacatgtggctagccagttttcccagcaccatttattaaatagggaatcctttccccatttcttgtttttctcagatttgtcaaagatcagatggttttatatgtgtggtgttatttctgaggcctctgttctgttccattggtctgtatctctgttttggtaccagtaccatgctattttggttactgtagccttgtagtatagtttgaagtcaggtagcgtgatgcctccagctttgttctttttgcttaggattgtcttggcagcgtgggctcttttttggttttgtatgaactttaaaacagtttttttgaattctgtggagaaagtcattggtaggttgatggggatgacactgaatctataaattaccttggacagtatggccattttcacaatattgattcttcctgtccatgagcatggaatgttcaaagaacatcttcatttctgccttcatttcgttatttacccagtagtcattcaggagcagattgttcagtttccatgtagttgtgcggttttgagtgagtttcttaatcctgagttccaatttgattgtactgtggtctgagagacagtttgttgtgatttctgtccttttgtatttgctgagaagtgttttgcttccagttatgtggtcaattttagaataagtgcgatgtggtgctgagaagaatgtatattctgttgatttggggtggagagttctgtagctatctattaggtctgctcagctctgggcctcatgtatttctttatagcaacacaaacagccatctcttgatggacacctaggtggttctccatcttggctatttgaatttggtttactgatatggtattgaggttttttacatcaattttcatgagagatattggcttgcagttttcttttttctttttttttttttttgcggtgtctttgtctgtattaggcatgagctgatgatggcctctgaaagtgtgttaggcatattccctctagctgtgtttccttggaagagtttaagaaatattggtattaattctgttttgaaagttggtagaattcagctgtgaagccatctagttctgggctttttattcccttgggagactttaagtttatattccagtctctttgtttgttattgacctgtgcaggctttgtacttcttcctgatttaatcttggttggttatttttttaaggaatttattcacttactctaggttatccagtttgttggcatataattgttcatagtagttgcttattattctttttatttctgtggtgtctgttgtaatgtctctacttttgtttctgattttatttaagtcttctatcttttttgctgagcgtagctaagcatttgtcaatttcgtttagattttcaaaaaaccaactcagtttgattgatttttttcccctatgttttttctatttgatttatttctgtattctttccttctttgtgctaattttgggtttactttgttctttttttatttccttgatgcataatgttagttatttatttgaaatatttctttttttaatgtagttatttattgctataaacttccctcttagacccacttttgctgcatcatgtaagtattggtatatcttatttccattgtcatttgtttcagaatatttttaaatttcctttttgatttcttctttgacccgttggttgcccaggagcatcctgtttaattttcacatatttttgaattttccaaaattcctcctgttgttgatttctagttttatactattgtggtcaaaatgacacttgatgtgactttaatattattaaatttgttaggacttgttttgcagcctaacatgtggtccatcctggagaatgttttatgtgcactagagaagaatgtgtattttgctgttgttggatggaatattctgtagatgtttattaagtccatttggtctaaagtatagttcacattcagtatttctttattaatgctttctctggttgatatgtgttgaaagtgaggtattgacgtaccctactattattgtattgctgtttcatcccttcctgtctattaatatttgttttatatatttagttgctccaatgttgggaacatatatatttataattattatgtcttcttgatgaattgacttttttatcattaaatactgacctttgtcttttctgaaagtttttgacttgacatctgttttatctgatatacgtatacccacctctgctcttttttggttaccatttgcatggaatatgtttttcattcatttactttcagcctgtgtgcatccttaaagctaaagtgagttccttgtaggcagcatgtagttggatctttttttttttttttgtcagttcaaccattatatatcttttttagggcatttaatccatttacattcatcctagaaaagggattttctcctgccattttgttaattgttttctgtttattttgtagatcctttgttcctttcttcctcttgttgtttacctagctttatttcatttttctctctaatttgcatatttactgtattttttgtgtggttaccattgggctaacattaagaatctttcagttaaaacagactattagactatttcaagctgataacaacttaactttactcacataaaagtactctagacattttccctatccttaatttatatttttgttgccttaatttacttttttaccttttgtgtgttccttaactttgaattatagatgttgtttttgaccattttggctttttatgtttatactagaagattgaaagatttatatagcaccattacagcactggggtattttgagtttgattttgaagttacttctagtggtgaattatatactttcacatactttcatgatagtaattattgtccctttgctttcagttgtggcactcttaagcatttcttgtaagactggtctagtggtgatgaattccctcagcttttgcttatctgggaaggtctttatgtaaccttaatttctgaagaatagctttgctgggtatagtatttttggctgcagttgttttctttcagctgtctaaatgtatcatcccattttctcttggcctgtaagatttctgttgagaagtcaactaatgatataatggagattcccttgtatgtgacatgtcagttttctctggatgtttttagaattctctccttgccttttacttttgacagtttggtgattatgcatcttggtaaagatgtctttgggttgaacctgtttggggagttttgagcttcctggatgtggatatcagtatctcaaccaagacttgggaaattttcagcaattttcatttattaaaaaaaatttttttagagacagtgtcttgctctgttgcccaagctggagtgcagtggcatggacatagctcactgtaatctcgaactcttggggtcaagtgatcttcccctcctcagcctctcaaaaatagctggtatttagagattgctgcaccatgcctgactaactaaaacacattttttttgttttttttttttttggtagagataggatctcactatgttgcccaggcttgtcctgaactcctggcctcaagcagccctctcattttggctttccagagtgctgggattacatgtggattattttattaaataagctttctgtcccttttactgtcccttctccttctgtagctttcataatgtgaaaatttgtttgccagatagtgtcctataagtcccataggctttctttactctttttcattctttttcctttttcctcctgactggttaatttcaaacacttgtttttaagtcacaattcttttttctacttttctaatctgctattgcagctctattttttttttaaattcattcattggattcttcagctccaagatttttgattggttctttttaaatgatttctgtctctgttgagcttctcattcagataactaatcgttttcctggttttgttgaattatctatctgtattctcttgtgtctcactgagtttccttaagatcattatttgaattcctttttaggcagtttataacttttcatttctttggggtcagttactggagaattactgtgtttcttttgtggtgtcacatttccttgctttttcctattttgtgtgtcctgtccagcatttatatctgtacatctcatggaacaatcacctcttccaaactttacatagtggttttcatagggaaaggctttcacctgtgtgtaccagttgggcaggttatggtgactcttgttctgagtgggcacactggtgtagtttctgtgcagcttctttaactataatcaatgtcattgatgaccttgggtgcctaagtggcttaagcttttaagagcttgtggcagcagtactggcagcatgagttgttaggatcctcagttgcaaggacttttggggtcctctagttcttgttttcccagcaacgggatggatcctagctgaggggatccttcttggtgtctgatctgacatggcccacaggcagtcacagcagtgctgggctgcagggtgcgtgcttggattggccgtggggccaatgtgctgagcttgaaacttctgtagcaccttgggctacacatttactctatgaggtcagagtagatgcagatcggccacaaagttagggtctgtgatgctgaggttcaccacagcagtttgttcccatggggcagggatgtagctgtgactctaatcctgggggcagggcacagaactggcatagctctggagaagaaggggtgctccagaggcctgagtcgcagggagtaagagtcccagagtcaagagtacacaccagaaactcagccctggggcatgaggcactatgcagtggggactctggaccctgggctggtagtatatggcagaggcccaagttttgtcaggccatgtgcagcaacaacagttacccagtaatggtggagcacagctgtgtcttgggccctggagggcaagcagtagcacaatgacgactctactctctgaggaagtgggatgcctcagcagcgtagacgctggggactagtccagttctgtggaagtagggtgttgcatccgttccacctggaagacagggtggttcagctcaaccaatgctctatttccctgggatgcgggaccctgcatgtttcaggtgccaagggggatcaactgcttggctagaccagtgcacaggttccctgggaattggagtgccacgtcagctccggtgctgctttggctcaggtgtcagaggtgtgactgctctgcttggccaaagtccttatttctcagaaggtgaagtgctgcattagcttagaccctgaggagtaggacacagaaacaactgggatgcaggggatggagtggctccatagcagcttgaccccaagggtagggcattgtagcaggtaggcttgaggatggcaggtcaccagacaggcatggtgcagtgataacaaaacctcagggatggaagggtacagtagctatttgcctacagagcaggatgcactcccagagaggctctgctttcaagatggtgtagcacagtagcaggttgggctacagaagatgagggaggtgtaggattcttccttggggtgaacacagccgtatggactctgaacaattccctcagctgggctcagtacctatgaggtctgcagaagtccacagtggtgaagactgtgggtgttcacggtggtggtgagggttgttggggttcttttgtttaccttttcttggaagagagaagtccctcctggtttcaagctgaccctgtcaggggaagtagtggtggagacaaggtcttttcttcccttctctacatggccatactctgtttttgtgctctatatatagagttgcttctactcctttgctgcattctggtactttcctttagttattttcatcaagatgtagttgttatttattgttttgtttgtttgttttggtgtggggggcagtgctaggaacttgtagttggccaccttgctaacatcactctattttcttgtttcttatgcttttgatgtcaatttttgatgtcaagaagaatccattgacaaatctaaggtcatgaagattttcccgtgttttcttttaagagttaacttaaaagaagctcacagatccatatgagttaattttttcctttttttttttttttttttttgagacaaggtctcactccgtcgcccaggctgagtgcagtggcgctgtcacagctcactgcagcctcgacctcccagcctcaagcaatccccccgtctcagcctcctgagtagctgggactacaggcatatattgccacacccaggtaatttttattttttattttttgtagagatggagtcttactgcgtcacccaggctagtctcaaactgctggatgcaagtgatactcctgcctagtctcccaaagtgctgggattataggtgtgaatcactgtgcctggcctgagttaatttttatatatcatatgaataggggctcaccttcattcttttgtatgtggatgtatagttgtcctagcaccatttattgaattcttttcccactgaatagacttggtaccctactagaaaatcaactgagcatagatgtatgggtttatttctagactgtctgttctattccattgtctatatgtttatcattgtgctagtgccataccattttgattactgtagcattttagttaagtccccaaattaggcagtgtgtgtcctttaacttggttcttttttttttttttccaagattgttttggccattcaggatccctagtaatttcacgtgaatttgaggcttccgtaaaaatcctaggtaattttttccatttctgcaaaacaaaaaaaagtaatcaagtgaaaaacaaaaatagtgatggaattttgatagacataacattgaccccgtagatggctttgggaattattgctgtcttataacaatattaagtgttcctttttctttttttagacagagtgtcactctgtccccaggctggagtgcagtggcgtgatttcagctcactgcaacctctgcctcctgggttcaagtgattctcctgcctcagcctcccaagtagctgggattacaggcaggtgccaccacgccagtctaatttttgtatttttagtagagaaagcgtttcaccatgttggccaggctggtctcgaactcctgacctcaagtgatctgcccaccttggcctcctaaaatgttgggattatgggcatgagccaccatgcctggccggttttaagtcttccaatgtatgaacatgggatagctttctatttaattacgtctttttaaactttttttttgtttgagacagagtcttgctctgtcacctaggttggagtgcagtggtgcgatcttggcttactgcaccctctgccttccgggttcaagtgattctcctgcctcagcctcccgagtagctgggattacaggtgcacaccaccatgcccagctagtttctgtatttttagtagagacggggtttcaccatgttggccaggctggtctcgaactcctgacctcaggtaatccacccgccttggcctccgaaagtgttgggcttacaggtgtgagccaccactcctggccttaaacttttttcagtaatgttttatagtttttagtgtgcaagtcttccacttccttcattaaatttattcctaggtgttttttttttttttttttgaaacagggtcttgctctgttgcccaggccagagtgcagtgaagtgatcttggctctcttcaatctccctgtcgtcctcccaggctctagtgatcctcccatctcagcctcccaggtagctgggaccacaggcatatgccactgtgcccagctaatttttgtgttttttgtagagaccaggtttcaccaggttgcccaggctggtcttgaactcgtgaggtcaagcgatccaccctcttagcctcccaaagtgctggaattacaagcgtgagccaccacgcccggcccctaggtattctttaaatgctagtacgtggaattgtttcttaattgcctttcatattgcttattgctgccagttcatttaatgaaaaaatctagtcctgccaaaaacgaagtcaagttgtcccctgtccccacaagtaactcttttagagtgttttccttcttttccttctccacctccaagttttaagaagtaaaatatacgtattgtggaaaatttggggaaatgttaacataaaagaaacttctaatctattgtttagtgacaatttctgttaatgtgtcagtatatttctatatttttctgcataaatatatttttacagtaaataaatgcagtaagactgaacaatggtttctaaagttctaatggtgtttaacctctggaacctgaaatgttaccgatatgggaacatgttctttgcatatctgcaaattaaaaatcttgagatgaagaggtcctcctggatttctggtgggacggaatgcagtcacatgtatccttataagaggaaaacagagggagatttgaccacacatctgagagattagaatgctatagccacaagccaagttagccaccagaagctgaaaaagacaaggaatggattctctcctactgacgctgattttgactgatactgattttaaatttctctgtttttaaaccactgagcttgttataatttattacactagccacaggaaagtaatagagattttggtacaggatatggtgtgctgctgtaacagatacctgggattagataattggtggaggctagaggaattttgaagtgcacagtggaattatggatgttaaaggcatttctggtgaggggtccgaaggaagtgaggagcatattagagcctataaatatatagtctttgataatacatatattgttataagcaaaatgtacatgtaggaatattgttaaaggtgctggtgaagacttcgaaggaaataaggaacatgatattgggaactggagaaaggttatccttgttatattgtggtggaaacttagctgcacaattgtttgccacagttgtgtggaaagcataacttgtgatcagtgaatgtggatgtttttgctgaggaaatttccaagcaaagtgttccaggtacagcctggtttcttcctgatgcttataataaagtgcaagaggaaagagttaaattgagggaataaatgctactaaccaaacaaataaaacccctcaaaaccaggactcaatcatttgggaaattctcagcctattgagattgcaaagttgataaaactgagattcactctggagagaagtgagggtgtgactggtcaacttttcctagtgttgaagggattggatgtttgactcctggatccattcaattgttatagcagaagccagggatagagaggaggttatacaagaaagatctgtggaagactctctttgcctagtgacatggattgctgtgcatacacaggagacccactggggatttggaaatattaaatcagaagaaacactgccagcttggactgaaaggagaaagacaggattaaatgaaagaaggctgtcagacttttaaaattctgcatgccagaatcaggctgataaaactgctcagctgcaaacatatgcttgaaaaagaaaggaaaaggaagaatgacttcatggtaggagctacaggcctagaggcctgtggccaggcccataggctggattcaggtgcagaggtcagaaccaccaatgtagaggttgaagctgtggactcacctcaagccacagaagattattcccaggctttgaatcctaatggaatttgcccttctggatttcaaaatggcttgggactgttgaacctttttcctcctcttttctcccttttggaatggcaatatctttaactgttattcaatgcttatttcaccattgcattttggaagcagataacttgtttgctagtttcagaggaaactaatatagtaagcataagaattttctaaatgcattctaatcttttaaacaaatccatactccaatttaaaatggacttcttcctaaatttaagcccttctccaatgccttgccccagtgcattttctatgaaatccttgttccttagactcaacccttaagagaatacaatccaaaatggtagatgtgtatgccaaggtgatgcgcataatgagccactgtggtgcagaaaacaaacagtgagaaagaaagagtagcagaataaccttaaaacagatataattccatgtttttatcttatccttttaaatttttaattttgtgtacattttataatacagttacacatataatttccaaattaattgataaccataatttgggaatgttgtaaaactttttttttaaccaataggaatgtacaatcaaaaaggtttagagaccaccgttctaaaacatgactgttggcggtgcatttggtggtcccgcggatctgttccttgcttcaacagtgtttggatggaacagatctggggactaaagaaaaaaacaaagaagaagaaaacaataaaataaaacatgactgttacccaatcatattgttaagcgagatccagaacctgaaaaagacaaggaatggattctttcttagagtttctggaagtagtgtggccctactgacactttgattttaactgagtgatactgattttagatttttctattttaagccactgaatttgttgtaatttattgccatagccacaggaaagtaatacaagtttggtctgttgtccaaacctcatcctgctttgaactcagtccttagcttgcaataattaaataaataaaataataaaatggcttataggaacctttagatttgtcctgttttgcagtgtggcattcttagagtttatcatttatcttttttacttgtaagatagagagttagacaataatttgttactgagatatactttaaatatgtggcaaatatataacatgaagtgatgcttcttatttggtaaattagcatcttattttagactttacaatttaagcattaatatattagctaaaaataatatgctgtcctggagttagctaaatgatgggctgcagatggcttttattgttttatgagaaccagttgtgtacatctctcctcttccatagagcaccctgacattggccatgatgtgagtatttacatcatggaaatgggcaaatgctaaaaatccgggctttcttttcctgcattccaccctgtgagctttttagcactgtaaggtttttaaagactaattccaaatcatgctatacaatgtggaactttgaaatcctttatgaaaaaattgttatatacccaaatatgtttcagaaatattgtgtatagaaatgtactctttttgttggagagtcagaatatgtatggttattctaaaatctatagtttatgatgtgaagaaaggtatttaactttgtataactcagcattttctttttttttatttttgctaagtttaattcctttatttgacaaaagacatcataaataaataccaaaaccatgggttgggataaaatatttataatggctaaaaccagcaaagaattcgtatgtaaaatataatttatatataaaatcataaattaacaagaaaaatataaacaatagaagaatggatgaaggctgtgaacaatttacaaaagataatcctgaataacttgaaatttataggagtaaaaaatgagacatgttttcatagattttctattctttcagttgaatatgaggagtatataggaagacaataaatgagtattgtcaacctgccatttttaacttagaacgtgttattttgcatcaataatctgaatatttttgcaaagaataggatcgtagcactgtctacgtatccaagtatgaaggcatacttgggatgaatatatactcaagctgcttttactttccatctagtcctaagaaaagatatttattgactgttttagcaatgtaatttcttttttttatttttttattttttatttttattttttattttactttaagttttagggtacatgtgcagaacgtgcaggtttgttacatatgtatacatgtgccatgttggtgtgctacacccattaactcgtcatttaacattaggtatatctcctaatgctatccctccccatttcccccaccccatgacaggccctggtgtgtgatgttccccttcctgtgtccatgtgttctcattgttcaattcccacctatgagtgagaacatgtggtgtttggttttttggtccttgcgatagtttgctgagaatgatggtttccagcttcatccatgtccctacaaaggacatgaactgatcattttttatggctgcatagtattccatggtgtatatgtgccacattttcttaatccagtctatcattgttggatatttgggttggttccaagtctttgctattgtgaataatgccgcaataaacatatgtgtgcatgtgtctttatagcagcatgatttataatcctttgagtatatacccagtaatgggatcgctgggtcaaatggtatttctagttctagatccctgaggaatcgccacactgtcttcacaatggttgaactagtttacagtcccaccaacagtgtaaaagtgttcctatttctccacatcctctccagcacctgttgtttcctgactttttaatgatcaccattctaactggtgtgagatggtatctcattgtggttatgatttgcatttctctgatggccagtgatgatgagcattttttcatctgtctgttggctgcataaatgtcttcttttgagaagtgtcagttcgtatccttcgctcacttgttgatggggttgtttgtttttttcttgtaaatttgtttgagttctttgtagattctggatattagccctttgacagataagtagattgcaaacattttctcccattctgtaggttgcctgttcactctgatggtagtttcttttgctgtgcagaagctcttgagtttaattagatcccatttgtcaattttgacttttgttgccattgcttttggtgttttagacatgaagtccttgcccatgcctatgtcctgaatggtattgcctagattttcttctaggatttttatggttttaggtctaacatttcagtctttaatccatcttgaattaatttttgtataattacaaaaattaatttcagttttctacatatggctagccagttttcccagcaccatttattaggtagggaatcctttccccatttcttgtttttgtcaggtttgtcaaagatgaaatagttgtagatgtgtggtattatttctgagggctctgttctgttccattggtctatatctctgttttggtaccagtaccatgctgttttggttactgtagccttgtagtatagtttgaagtcaggtagcatgatgcctccagctttgttcttttggcttaggattgacttggcaatgcgggctcttttttgtttacatatgaactttaaagtagttttttccaattctgtggagaaagtcattggtagcttgatggggatggcattgaatctataaattaacttgggcagtatggccattttcacgatattgattcttcctactcatgagcatggaatgttcttccatttgtatcctcttttatttcattgagcagtggtttgtagttctccttgaagaggtccttcacatcccttataagtgggattcctaggtattttattctctttgaagcaattgtgaatgggagttcactcatgatttggctctctatttgtctgttattggtgtataagaatgctcgtgatttttgcacattgattttgtatcctgagactttgctgaagttgcttatcagcttaaggagattttgggctgagacgatggcgttttctaaatatacaatcatgtcatctgcaaacaaggacaatttgacttcctcttttcctaactgaatactctttatttctttctcctgcctgattgccctggccagaacttccaacactatgttgaataggagtggtgagagagggcatccctgtcttgtgccagttttcacagggaatgcttccagtttttgcccattcagtatgatattggctgtgggtttgtcataaatagctcttattattttgagatgcgtcccatcagtacctaatttattgaaagttattagcatgaagggctgttgaattttgtcaaaggctttttctgcatctattgagataatcgtggtttttgtcattggttctgtttatatgctggattatgcttattgatttgcgtttgtggaaccagccttgcatcccagggacgaagcccacttgatcatggtggataagctttttgatgtgctgctggattcggtttgccagtattttattgagaatttttgcatcgatgttcatcaggggtattggtctaaaattctcttttttggttgtgtctctgccaggctttggtatcaggatgatgctggcctcataaaatgagttagagaggattccctctttttctattgattgctatagtttcagaaggaatggtaccagctcctccttgtacctctggtagaatttggctgtgaatccgtctggtcctggactttttttggttggtaagctattaattattgcctcaatttcagagcctgttattggtctattcagagattcaatttcttcctggtttagtcttgggagagtgtatgtgtcgaggaatttatccatttcttctagattttctagtttatttgtgtagaggtgtttatagtattctctgatggtagtttgtatttctgtgggatcggtggtgatatcccctttatcattttttattgcgtctatttgagtcttctctcttttcttctttattagtcttgctagcggtctatcaattttgctgatcttttcaaaaaaacagctcctggattcattgattttttgaagggttttttgtgtctctatctccttcagttctgctttgatcttagttatttcttgccttctgctagcttttgaatgtgtttgctcttgcttctctagttcttttaattgtgatgttagggtgtcaattttagatctttcctgctttctcttgtgggcacctagtgctataaatttcgctctacacactgccttacatgtgtcccagagattctggtatgttgtgtcgttgttctcgttggtttcaaagaacatctttatttctgccttcattttgttatgcacccagtagtcattcaggagcaggttgttcagtttccatgtatttgagcagttttgagtgagtttcttaatcctgtaactcagcactttcaacactttttaaagtgttttaacaaaactcatttttgcattacatctattaataacccattaagttaatgttttgcagtgcactctttgagaaagttagagatatgtcatatttattacttgctgatttaaaatgtgttttattttcagccctgccaaggtaaccctgctggggtcagttatcttcacattccagcacacccagcatctggcaatatcaaagcataatcttatgttcctttataccatctttattgtggccacaaaggtaagaattcaaagtacctataattattacaaatcctgtataactattcccctttgatacaattttgcatgctgggcaagtaagaggaacatttatttattattattatctaagaggaataatttggggagctttactcagcacatccatgactttctgaaacttagcttttctgtgatttctcatttgctttatgctagggctatcaggacacagtggcagatagcctagtagtatattggagaagacagagtagtggaaatagccaaggctgatcagagactgcgaagatgatactgtctcatttgtaaaatgaggcacttgagatagatattctctgaatttcctttaagctctaaaatttcaaatattttatattaggacatatttgtagtcattcttttctattactattgcctggttggaagctttattccttcctgaagataggttagagacaggcagtcttgggttcaaatcccagttttgctgcctagtccctgaataggcaagccacttaatgtctctgaatcctgattttctcatcttcattgtatgattgttgagaggattggagaggatgcatgtctttctgtcactgtatctcatgtatcttacgaattttgtttgcagctgtatcatgaggctaattctgactgttcataccatgattaagtattgttccctattcgcaagtagacaattgattttgtaataagattattatttaagtctagaaaattttatggccacctctgttttagactagatatttttggctaaaaacttatctacaggatttttaaaaggaaaacaggatagattatataaatatgtgtcttagaatgaagtcactgtgtgaatcatttatttttgtttcagtagtctctgaattggagatgatctgtggctgtaattcaggtaacaaatattggaggcaaaatctcttcacatgtagtctcttccagtcctcaaatgttgagccgtgtatatttttttctaacagctttattgagatatattttccatactgtgttagtctgttctcatgctgctaataaagacatacctgatactgggtaatttataaagaaaaagaagtttaagggactcacatttccacatggctggggaggcttcacaatcatggtggaaggtggaggaggagcaaaggcacatcttacatggtggcaggcaagagagcttgtgcaggggaactcccatttataaaaccatcagatttcgtgagacttactatcccaagaacagcacaggaaagaccctcatgattcagttaccttcatctggccccgcccttgtacaattcaaggtgagatttgagagtggagatatgagtgatgtatggtttgagccaaaccatatcacatatcatacaatgcacttaaactgtataattgaatagttttttagtatattcatggatttgtgcaattatcactacaaatcagtattagaacatttttatcactccaaaaagaaacatcgtattctttagaagtcatttcacattttccccaatacttccagctataggccattttatttatccattcatcagttgatggacattttgattgtgtcactttttggctaatatggataatgagctgtgaacattcatgtaaaaatttttgtgtggacatgtgattcatttctcttgagtatatcatctgtgaatggaatttttaggccatatgttaattctgtttatccttttgaggaactgatgcattgttttccaaagtggctttatctttttatattcccaccagcaatgtgtgagatttccaatttcaccacaccattactagcgcatattattgtcttttttattatagccaccctagtgggtgtgaagtggcatctcactgtggttttgatgtacatctgagtatcttttttgtgcttgttaggtatttgtatatcttctttgggaaaatatctagtcagatcatttgcccattttcaatttatattttgttttagtgttgagttgtaaaattcttttcatattttggatactagaatcttaccagacttaatgatttgcagatattttcttccattctgtaagttttttttttcactgatagtgcccttagaagcacaaactggtaaaattttgttgaaggccgggcacagtggctcacacctataatcccagcactttgggaagctgaggtgggcagatcacctgaggtcaggagtttgagaccagactagccaacatggtgaaaccccatctctactaaaaatataaaaattagttgtgcgcgcctgtaatcccagctactcaggaggctgaggcagtagaatcacttgaaccagggaggcagaggctgcagtgagatgagattgtgccactgcactcaagcctgggcaacagagaaagactctgtctcaaaaaacaaaaaacaaaaaacacacattttttttatgagtccaatttacctattttctcttttattatgtattctttgtgtgtcatagctaagaaaccgttgccaaatctaaggtcatgaagatttacctctatattttcttcaagagttttatagttttagctcttgtatttagtttttatgatctgttttgagttaaattttgtgtatggtatgacgaacagtccaagttttctcatgtggatatatagttgtctgagcactatttattgtaaaaaccgttcttttcctttgtgaattgcctttacaatcttgtcaaaaatcagttgactgtaaatttgagggtttatttctagattctcaattttattccatccatatgtgtgcctgtccttatgctattaccattacgtcttaattgttgtagcattgtagttagttttgaaatcaagacgtgtgactctggtaggatccaagatggctgattagaagcagctgtggtccatggcactcatggagagaagtgaaaaggggcaagtgaattcagcaccttcaactgaaatagccaagttcttgcattgggactgtctaggcagacagcttaacccatggagaaggaagaaaagcagtggggtgggggaccatggcccacctgggagcagcatggggccaaaggaacccccattgccagccaagggaagcagtgagtgattatgcaaccttgcccagggaaccacgcttttctcatggacctttgcgacccgtagatcaggaaatcccatcgtgagcccatgccaccagggtcttgggtccaatacacacagctgtgtggagttttggcagagcagctgctcagtcatacacagagacccaggagtttatatactctggccctggagtccttagcaagtgaggaaatccatccgtacatattcctaggaagagggctgaatccagggaaccaagcagcattgtgctgcaggccccacttccatggcatctcataatttaagacccactggcttgggttccagcctgccaacagcaataggctggaatatgtctgagacaggtcttgagttcctggggggaggggcggctggcatctatgcagtttggtagactcagccgttccagcctgccagctttggagaatacaaacagtccagatgaggaagggtcccccacaatgcagcacagctgccttggcagatcatggccagactgcttctttaagcaggaccctgattcattcctcctcactgggcaggaccttcctgtggggcctttagccacttcagaagggttctattgggacgtagctctcagggggaggagtggccgccatttttgtggtttggtagactcagctgctgtagtctgctggctttggagaatacaaatgttacagatgagaaagagtttccccacaatgcagcacagctgctttgctagatcattaccagactgtttttttaagccgggccatgatccattcctcttcactggagaggacctccctacggggacttcatccattccagccagggttctccatctctccctgggatggagctcccagagggaggggcagtcaccatctctgtgactcagttgactcatccattctaggctgccggctttggaatgcccaaatggttcagacaaggaaggtctcccccagtgcagcacacctctaccaaaaagcagccagactgcttttttaagcgggtccctgatcctgttcctcctgactgggtgagacctcccaacagggatctgtaaccacctcctacaggtgtgttcggtctggcagcaggtcagaacccacctggggcagagcttccagaggaaggagctggctgccatctttgctgtttcatagccatcactgatgatacctccaggtttgggaaaaaccaaggtaacaagggtctggagtggaccctcagcaaaccgcagcaaccctgtggtagactggcctgactgttaaaaacaaacagaaaacaacaacaacataaacaaaaaaggccccacaaaaaccccattcagaagtcagcaacttcaaagatcaaaggtagataagcccacaaagatgagaaagaatgcaaaaatggtgaaaactcaaaaagccagagtgcctcttctccccaaaatgattgcaacatctctgcagcaagggcatggaactaggctgaggctgagatgcctgacttgacaaaagtaggcttcagaaggtgagtaataatgagcttcactgagctaaaggggcatgttctaacccaatggaaagaagctaagaatcatgataaaacgataaaggagctgatagctagaatagccagtttagagaggaacataattgacctgatggaactggaaaacacaacatgagaacttcacaatgcaatcacgagtatcaacagcagaatacatgaagcagaggaaagcagctcagagcttgaagactatctttctgaaataagacaggcagacaaaaatagagaaaaaataatgaaaaagaatgaacaaaatctctgagaaataggggattatgtaaagagacagaacctatgattggagtacttgaaagagacgaggagaatggaaccaagttggaaaacatacttcaggatatcatccaggagaacttcccccacctaacaagacaagccaacattcaagttcaggaaatccagggaacccagttagatactccatgagaagttcaaccccaagacacataatcatcagattctccaaggtcgaaatgaaagaaaaaatgttaagggcagccagagagaaaaaccaggtcaccatcaaagggaaacccagcagactaacagtggacctctcagtggaaaccctacgagccagaagagattgggggccaatattcaatattcttaaagaaaagaatttccaacccagaatttcatatccagccaaactaagcttcataattgaaggagaaataagatccttttcagacaagcaaatgccgagggaattcatgaccaccaggcctgctttgcaagagctcctgaaggaagcactaaatatggaaaggaaaaaccattaccagccattacaaaaacacactgaagcacagaccagtgacactatgaagcaaccatataaacaagtctgcaaaataaccagctagcatcatgatgataggatcaaatttacataacaacaatactaaccttaaatataaatgggctagaggccccaatttaaagacacagaatggcaggctggataaagagccaagacccatcagtattctgtcttcaagaaacccatattccatgcaaagacacacataggctcaaaataaagggatggaggaaaatttaccaagcaaatggaaaacagagaaaagcagggttgcaatcctagtttcagacaaaacagactttaaaactaatgaaggtaaaaaaagacaaagaagtgcattgcataatggtaaaggattctaaatatatatgaacccaatacaggagcacccagattcataaagcaagtccttagagatctacaaagggacctagacttccacacaataatagtgggagactttaacaccctactgacaatattagatcattgagacagaaaattaacagagatattcaggacctgacctcagctctggatcaagcagagctgatagatatctacggaactctccactcaaaagcaacagaatgtacattcttctcattgccacacagcacttaatataaaactgaccacataattggaagtaaaacactcctcagcaaatgtaaaagaactgaaataataacagtctctcagaccacagatcaaattagaactcaagactaataaatgcactcaaaaccagacaacttcatggaaattgaacaacctgctcctgaacgactcttgggtaattaatgaaattaaggcagaaatcaagaagttgtttgaaactaatgagaacaaagagacagcataccagaaactctgggatgcagctaaggcagtgttaagagggaaatttatagcactaaatgcccacataaaaacctagaaagatctcaagttaacaacctatcacctcaactgaaagaactagagaaccaagaggaaaccccaaagctagcagaggacaagaaataatcaagatcagagttggactgaaggagatggagacacaaaaagcccttcaaaaaaatcaacaaatccatgagctggtttttggaaaacgtttataaatagactactagctagactaataaagaaaaacagagaagaatcaaataaacacaatcagaaatgataacactgaccccacagaaatacaaacaaccatctatatagagaatactgtactatatactataagcagagaatactagaaacacctctatgcaaataaactagaaaatctagaagaaatggataagttcctggacacatacacccttgcaagactgaaccaggaagaagttgaatctccagatagaccagtaattagttcttaaattgaggcagtaatacatagcctaccaaccaaaaaaagcccaggaccagatggattcacagctgaattataccagaggtacaaagaattgctggtaccattctactgaatctagtccaaaatattgaaaaggagagactcctccctaacacacactagggcctgtcggggaggtggagggagggagagcatcagaaaaatagctaatggatgctgggcttaatacctgtgtgatgggatgatctgtgcagcagtccatcatgacacacatttacctgtgtaacaaacctgcacatcctgtacatgtaccccgatgttaaataaaagttgaagaatgaagaaaaatagataataaaaaagaagtgtgactcctctgagtttgttgttctttttcagaattgtttgactattctggatcactaccattgccatatgaactttaggaacaacttcacagtttctgcaaagaagccagctcttattttgatagggattgctttaaatctgtaaattgacttgagaataattgccatcttaacaataaggtttccaattcattaacacaagagttcttttgatttagttgggccatctttgttttcaatatacaagtcttacactttttttgttaaatttatacctaagtattttattcttctttgattttatactaaatacaattgttttaaaatttcacttccaggctgtttattacaaatatgtagaaatacaattgatatttgtatattgattttgtatcctgcaaccttgctgaactcatttattagttctaatagatgttttaaaaggcagattcctggctgagcatggtggatcatgcctgtaatcctagcactttgggaggccaaggttggcagatctctagaggtcaggagttcaagaccagtctggccaacatggtgaaatcctatctactaaaaatacaaaaacagaggtttcagtgagccgagatcgcgccattgcactctagcctgggcaacagagccagactctgtctcaaaaaacaaataaataaataataaaatagaaggtagattccttaggattttctatatgcaggattatggcatctgcagatagagataattttactctttacttttcaatctgcatgtctttaattttcttgcccagttgtcctggctagaaccttcagtatagtgttgatagaaatggagagaatgagcattcttgtctttttcttgatcttagggagaaagcatttggtatttcactattaagtataatgttggctgtgggtttttcctagatgacttttagcagagtaggaagttttcttctactcctagtttgctgaatgggtgggagctgtattatttttgagtttctaactttaatctttaaagaaaatgaatgtgtattatgggtttggtaagaataaatagcactggtatcttacattttcttgagttacagcatcaatttttgttcatagtctaatttgtggaataaaaatgataatttttcttacaattgttgctggatgtaaagttctgtattttaacacccaaacttaaacaccatactgcaatgtaataataataaagatatttaaaaataggaaaacgtacaatgttgaacatctcttataatatttctcaacattttcctaattataaagtatatccaccagtttctaaatagaatattcatttttaactaattcatttgcctaaatcccatttagattttactgatactgataatatatttgataatcataatgatttttttatcttttaaattttatttcaatagtttttgggggacaggtgtttttttggttacatggataagttctttagtgctaatttctgagtttggtacacctgtcacctgagcggtgtatactgtacccaatgtgtagtcttttgtccttcatctctctcccacccttccccccaagtcctcaaagttcattgtatcattcttatgcccttgcatcctcacagcttagctcccacttatagagaacatatgatatttggcttttcatttctgagttacttcacttagaataatggtcttcaactccatccaggttgctgcaaatgccattattttattattttgttcctttttatggctgattagtattccatggtgtatacataccacattttctttatctacttgttggttgatgggcatttaggctggttccatatttttgcaattgctaattgtgctataaacatgagtttgcaagtgtctttttcatataatgacttcttttactttgtggagatacccagttgtgggattactggatcaaatggtagttctacttttagttctttgaagaatctccatactgttttccatagtgattgtactagtttatattcccaccagcagtgtaaaagtgttcccttttcaacacatctacaccaatattttaaaaatatttaaaaataaaaattatttgaaaaaacactgagaagtgtgggttatctattggctgctcagtaaaaggagtaattgtgaaatagagctgttgtgaaataaagcataaggaacggtaaagaatgactaaaactgaaaagaggctgttgggtttcgaaattaagagatacttggtgaccttagtaaaagcaatttcagtggactggtaagggatagaaaaatgattgtaatcaattgaggtgaataaaaaagtgaagatgaagagtataaactattttaaagggatttggagggagtataaacaggaataaaacttgggagagcagtttggcaatatctgacaaggttgaagatccacgtatcttgtgacttgttaactctatttttaggtataaccaacagcagtgtttcccaaggtatggtacggggcacaactttatcagaaccactttaaaaaaattctttagcagatgctattcaaatcggcggcagggccagtggttgtgctgagactcgccactgcccaggccgctgggcctgagtgttgccttcgctgccatggacgccagtgggcactgacagacctatggagagttggggtgtgcctcccaggccttatctggccaccaaactggaatgcccttcaggcgggcatgtattattcgtcctactttaccagtgtggacactgaggctcacagacgttaaatccttctaaagacacatctacagcaagtggcagagctagaattcagatcttcctggtatggcgatcttacatggattctgctacttatggaatgaaattaccacatcttttcgagcaggaatgcctctaagaaaacacagacaacactttaaaaaatatggcagttgtttcacagcaggagaagcagtggattggctttatgacctattaagaaataataacagttttggtcctaaagttacaagacaacagactatccaactgttgaggaaatttcttaagaatcatgtaattgaagatatcaaaggcaggtggggatcagaaaatgttgatggtactaaccagctcttcagatttcctgcaacttagccatttaaaactctgccacgaagacatccagaattgagaaaaaacaacatagagaacttttccaaagataaagatagtatttttaaatgatgaaacttatctcatagaactcctaaaaagcatggattacatttatctcaggaaaattccgagaaaataaagcatgaaataatcaatgaagatcaagaaaatgcagttgataatagaaaactaagccaggaagatgttgaagaaatttggagatatgttattctgatctacctgcaaaccattttaggtgtgccatccctagaagaagtcataaatccaaaacaagtaattccccaatatataatgtacaacatggccaatacaagtaaacatggagtagttacactacaaaacaaatcagatgacctccctcactgggtattatctgccatgaagtgcctagcaaattggccaagaagtgatgatacgaataatccaacttatgttggatttgaacaagatatattcagcacaatcacagattattttctagatctccttgaacctctccttacttttgaatattatgaattatttgtgaacattttggttgtttgtggctatgtcatagtttcagatagatccagtgggatacatagaatccaagatgatccacagtcttaaaaattccttcacaatttgaattccttcaaatcaatggagtgccttcttctcagtctgcttcatagagaaaaaagaagaataagattctactgagagactacggataagcaatccaggatttcaagaaagatgtgctaagaaaatgcagctagttaatttaagaaacagaggagtgagtgctaatgacataatgggaggaagctgtcataatttaatagggttaagtggtatgcatgatctgtcctctaatagcaaaccaagttgctgttctttggaaggaattgtagatgtgtcagggaattcaagtaaagaggcatccagtgtaaagaggcatcaatcttttccaaacatagaaggacaaaatactaaactgtttttagagtctaagcccaaacaggaattcctgttgaatcttcattcagaggaaaatattcaaaagccattccgtgctggttttaagagaaccactactttgactgctcaagaccaagaggagttgtgtaatgggaaatgcaagtcaaaacagctttgtaggtctcagagtttgcttttaagaagtagtacaagaaggaatagttgtatcaacacaccagtggctgaaatgatcatgaaaccaaatgttggacaaagcagcacaagtgtgcaaacagctatgcaaagtgaactcggagagtctagtgctgcaatcaataaaagactctgcaaaagttcaatagaattttcagaaaattctttacttccagcttcttctgtgttgactggtacacgaagtttgctgcaacctcatttagagagggttgccatcgatgcgctacaattgtgtcgtttgttacttccgccaccaaattgtagaaagcttcaacttttaatgcgtatgatttcccaaatgagtcaaaatgttgatatgtccaaacttcatgatgcaatgggcatgaaatcaccgatgatacataccttttctcgatgtgtgctatgctgtgctgaaaaagtggatcttgataagcttctggctggaagattagtttctttcttactggatcatcatcaggaaattcttcaagtaccaacttatttacagactgcagtggaaaaacatcttgaatacttaaaaaagggacatattgaaaatcctggagatggactatttgttcctttgccaacttattcatactgtaagcagattagtgctcaggactttgaaaagcaaaaagtttctacctctcaagctgcagttacagaacttatagaaaatgttattaaaaacaagagtttacctctaaaggagaaaagaaaaaaactaaaacagtttcagaaggaataccccttgatatatcagaaaagatttccaaccacggagattgaagcagcactttttggtgacaaacctacaatcaagcaaccaatgctgattttaagaaaaccaaagttttgtagtctaagatactaactgaattaaaaattatgtaatacttgtggaactttgataaatgaagccatatctgagaatgtagctaatcaaaaggaagtctgttattaataaggtatttctaaataagcacattatgtaaggaagtaccaaaatagttgtttatcaatgtgagactcctaggagactaactagatctcaactgagaacacgtaacaataggtgataccaaatactttttgtttttaacacagctatccagtaaggctatcatgatatgtgctaaaattttatttgcttgaattttcaaaattgagctatgttcatcaagattaaactataattctgtttttaaaagaaaatttatctgcatatgtgcaagttctgagatattagctaatgaattagttgtttggggttacttctttgtttctaagtataagaatgtgaagaatatttgaaaactcagtgagataattctcagctgccaaatgttgcactcttttgtatattctttttccacttttgatctatttatatatatgtatgtgtttttaaaatatgtgtatattttatcagatttggttttgccttaaatattatccccaactgcttcagtcattcatttgtttaatatatatatgttttgaattctaatttgcataatctattagaagatggggacgtaaaagaagtataaggcaatcatatattcatttaaaagatacttatttagcaactgctatgtgcctttcattgttccagatatgcggagacagtgataaataaaacatataatctcttctgtaaggtatttatttttaatcaagggagatacacctatcagatgcttaaaataacaacattacctactgcaatcagggcatatagaatcattcagcctaagactgacttctatgatgatggaacaggtctctaagctagtggttttcaaattggtgcacattagactcacccgaggagttttaaaacagcctatatgcccagggcctaacttatactaattaaatctgaattttagggatgttgtctagggattagtatttcttttaatctaggtgattccagtattcagccaactgtgagaatcaatgtcctaaatgctttttataaacatttttataagtgtcaagatagtggcacattgactttattttttcattagaagaaaatgcttgccgagtataaatgcctctcatcttaaaacaaggttcttcaggtttctgcttgatcgacttggtacaaacttgaagcaagtcgccttctattttttactccaaggttgtttaatatctattccttaagtgtaaagaaatatataatgcctgggttgcaataaaatcttaatgtttaatgactattctcatttctcaatataatttcataatatttctctataaagtgatagtgttccatttaacattactgatttttattaaaaatctggacagaaaattataaatatgactttatcctagaaactggctataaattttttttttaaatttattattattatactttaagttttagggtacatgtgcacaatgtgcaggttagttacatatgtatacatgtgccatgctggtgcgctgcacccactaactcattatctagcattaggtatatctcccaatgctatccctcccccctccccccaccccacaacagtccccagagtgtgatgttccccttcctgtgtccatgtgttctcattgttcagttcccacctatgagtgagaatatgcggtgtttggttttttgtccttgcgatagtttactgagaatgatgatttccaatttcatccatgtccctacaaaggacatgaactcatcattttttatggctgcatagtattccatggtgtatatgtgccacattttcttaatccagtctatcattgttggacatttgggttggttccaagtctttgctattgtgaataatgccgcaataaacatacatgtgcatgtgtctttatagcagcatgatttatagtcctttgggtatatacccagtaatgggatggctgggtcaaatggtatttctaattctagatccctgaggaatggccacactgacttccacaatggttgaactagtttacagtcccaccaacagtgtaaaagtgttcctatttctccacatcctctccagcacctgttgtttcctgactttttaatgattgccattctaagtggtgtgagatggtatctcattgtggttttgatttgcatttctctgatggccagtgatggtgagcattttttcatgtgttttttggctgcataaatgtcttcttttgagaagtgtctgttcatgtcctttgcccactttttgatggggttgtttgtttttttcttgtaaatttgtttgagttcattgtagattctggatattagccctttgtcagatgagtaggttgtgaaaattttctcccattttgtaggttgcctgttcactgtgatggtagtttcttttgctgtgcagaagctctttagtttaattagctctcatttgtcaattttggctttggttgccattgcttttggtgttttagacatgaagtccttgcccatgcctatgtcctgaatggtaatgcctaggttttcttctagggtttttatgcttttaggtctaacgtttagcaccaatcccacagaaatacaaactaccatcagagaatactacaaacacctctatgcaaataaactagaaaatctagaagaaatggataaattcctcgacacatacactctcccaagactaaaccaggaagaagttgaatctctgaatagacaataacaggagctgaaattgtggcaataatcaatagcttaccaaccaaaaagagtccaggaccagacagattcacagccgaattctaccagaggtacaaggagcaactggtaccattccttctgaaactattccaatcaatagaaaaagagggaatcctcccttactcattttatgaggccagcatcatcctgatacgaaagctgggcagagacacaaccaaaaaagagaattttagaccaatatccttgatgaacattgatgcaaaaatcctcagtaaaatactggcaaaccgaatccagcagcacatcaaaaagcttatccaccatgatcaagtgggcttcatccctgggatgcaaggctggttcaatatacgcaaatcaataaatgtaatccagcatataaacagaaccaatgacaaaaaccacatgattatctcaatagatgcagaaaaggcctttgacaaaattcaacaacccttcatgctaaaaactctcaataaattaggtattgatgggacgtatttcaaaataataagagctatctatgacaaacccacagccaatatcatactgaatgggcaaaaactggaagcattccctttgaaaactggcacaagacagggatgccctctctcaccactcctattcaacatagtgttggaagttctggctagggcaattaagcaggagaaggaaataaagggtattcagttaggaaaagaggaagtcaaattgtccctgtttgcagacgacatgattgtatatctagaaaaccccattgtctcagcccgaaatctccttaagctgataagcaacttcagcaaagtctcaggatacaaaatcaatgtacaaaaatcacaagcattcttatacaccaacaacacacaaacagagagccaaatcatgagtgaactgccattcacaattgcttcaaagagaatgaaatacctaggaatccaacttacaagggatgtgaaggacctcttcaaggagaactgcaaaccactgctcaaggaaataaaagaggatacaaacaaatggaagaacattccatgctcatgggtaagaagaatcaatatcgtgaaaatggccatactgcccaaggtaatttacagattcaatgccatccccatcaagctaccaatgactttcttcacagaattcgaaaaaactactttaaagttcatatggaaccaaaaaagagcccgcatcgccaagtcatcctaagccaaaagaacaaagctggaggcatcacactacctgacttcaaactatactacaaggctacagtaaccaaaacagcatgatactgttaccaaaacagagatatagatcaatggaacagaacagacccctcagaaataacgccgcatatgtacaactgtctgatctttgacaaacctgagaaaaacaagcaatgggggaaggattccctatttaataaatggttctgggacaactggctagccatatgtagaaagctgaaactggatcccttccttacaccttatacaaaaatcaattcaagatggattaaagaaactggctataaaattattggaccaaattgaattctttctaaggcatttgtatgctgaaactttttttgtttatagatttgtaaaatgtggattattttgcaaattgagattaaaattatttggggtttagttacaatttaaaaaatgctttagcaaagtagcatttaatatttattgacgaaatcattagaaatgagctcctttaaaaatttttaaaagtcaactttttagaagtataatttatgcatattaaactatattcatggataataaagtacattcagtctaggagtacattttgatgagttttgacaaatttgtatacctgtgtaactactaccacagtcaatgtatgaaacatttctatcactttggagcatttccttgtaccttactctagtaaatcccagccactacccatagccccagtataccatttatccactttatatcactacagattagtgttttctgtagtttcatatggagtcatatagtatgtactcattttgtttttgagatttatccatgtaattacatattcctgagtagtattaggtaccacaatttgtttttccagttatctgttgatgggttttggtgtatttccagcttttgattatttgaataaggttgttataaataaagctgctatgaatatgtgtacatatatgtctgtacacagacacatattttcttttttttcttttttattttttttgagacggagtcttgctctgtcacccaggctggagtgcagtggtgtgatcttggctcactgcaacctccgccgcatgggttcaagtgattctcctgcctcagcttctcgagtagatgggaatataggtgtatgccaccacgcctggctaatttttcatatttttagtagagacggggtttcaccatattagccagaattgtctcaatctcctgacctcatgatccgcctgcctcggcctcccagtgctggaattacaggcgtgagccactgtgcccagccagacatgtattttcgtttcacttaataactaggaggagaattgctaggtcatctgaaaagcatatgtttaactttttaagaaactgccacactatttttcaaaatggttgtatcattttacattcccactagcaatgtatgagagttctgattgtcctagatccttgttaattatttggtattatcagtcattttaattttagcgttttgtaggtatgaagtgatatcgcattatagttttcttttgcatttctgtgatggctagagatttgagcgtcttttcgtgtgtttactggccactcacatgtgatcttttgaatagtgtctgtttaaatattttgtccattaaaaattgtattattattgagttgtaacagttctctgtatattcaggatgtcaatccttggtgagatatatgtattgcaaataattttctcccagtttatgctcttcctttttctttgtttagtgttgtctttagaagagctgaagttttaaattttgatgaagtttactttactagattttcctttcatggcccttctttttgtgtcctattaagaaactattttattcctcaaggttttgaagagttttcacctgtttcttctaaaagttttataatttttgcttttttttctgtttttttttattattatactttaagttctgggatacatgtgcacaatatacaggtttgttacatatgtatacatgtgccatgttggtgtgctgcacccattaactagtcatttacattaggtatatctcttagtgctatccctcccccctccccccaccccacgacaggccccggtgtgtggtgttccccaccctgtgtccaattgttctcattgttcaattcccacctatgagtgagaacatgcggtgtttagttttctgtccttgcgatcgtttgctcagaatgatggtttccagcttcatctatgtccctacaaaggacatgaactcatcctttttacttttagagtctgtgaaccatttcaaattaagttttatgagtcctacaaggtaagggtcaggttttttttttttcctccatatgagtaggaagttgttacaacactgtttgttgaaaagacagttctttccctcattgaatgatcttgccacctttgttgaaaatcagttggcttgacctatgtgggtctatttctagactatattctgttctattgatttatatgtctatttctagccaatactaaactgtcttaattaccataactttatagtaagtcttaaaatcaagtagtacagtttctccaactttattttctcaatatttcttaggatagtctacatcttttatatttctaaataagttttatgataaagttgtcacttcctatggaaaaaacgccttctggaattgtttttgagattgcatctatagattaatttgggaagaaatcagatcttaaaaagatttagtctgttgatctctgaacatggtatgtttctccagttatttaggcctttaaatttttggagtactattttgtggtcttcattgttttatatgtatcttgttaaatttaaatttatcctgaagtagttcatatttttggatgcctttagaaatagtagtttttcaaatttcaatttggaattttacattgcttctatgtacattgcttgtaagaataatcttacacattgttcttgtatcctgtgaccttgctaaattgcctgttggttctggtagcttttgtgtagattctttagcattgtctatatacatggttttgtctatgataaagatagttttactttttccttttcaacccggatgctgtttttttccttgccttattatattggctagaatgtcctgtacaatgttgaagagaaatggtgagagtagacatctttgttttgtttgtgaccttagtgggaaaacattcagccttttaacttaaataagatattagctattaagcatcttatagatatcctttatgaggttaaggaagttctcttttatttctagtttgctgaaagtgtttatcatgaatgggtgtgggattttgtcaaatgctttcttctgtatcatttaaaataatcataggggttttctcttatattctgttaatatagtggattacattgattgattattaaaatgttacataaatctttcattcctgtgataaaccccatttagtcatgatgcggtatcctttttgcatattactgaatccattttttaaaatattttcaaggatttttttccagtgtgctaatggatattggtttgtagttttctctgtaatttttttctcctttttgtattaacataaaattgggctcattaaataaatggaaaataatttctctaatctctgagtttatgtaggtttgatattatttattggtaaatgtttgatagattcactaatgaagtcatttgggcctagaattttctttaaaggaaggtttttgataacaatttcttacatagatatagggctatgcagattttctattttacttgtgtctgttttactaagttgtatttattacggaatttgccatttcacttaagttttttattgttggcatgaaattgttgataatagttttttgttatccctttaatgtctgtagaatttgtggtaatgtctccactttcattcctgatattggtgatctgtgttttctttttctgtcttttaaaatcactctacctagaggtttgtcagtttcatggatttgtttcaaagacccagcttttggtttcattggtttttctgttttagatttcattaatttcaggtcttttttatatccttccttctgtttactttggggtttacttggttcttcctttactataaagaaaatattgataaatttgactccataaattgttttttaaagttgcatggcaaaagccactgtggacaaagtcaaaatatagctatcaaatagctgtgataaaatacttacaacatatatcagagggctggtatgcctgatatataacaacctcttaaaaattaagggataaaggaccaaaacctgatggaaaagttaaaggaaagttatcaacagacaattcacacagaaaagatcaggaaatgttcctcaaacatattaaaaaatgtggaactcatacttgagaaacattaattaaaataacactgagataccatttctcattcatcaaaactggcacaaaattttaaatttgtattttattttagttttgagacagggtctcgctctgtcactcaggctggagtgcagtggcatgatcacggctcactgcagccttgacttcccaggctcaagtgatcttcccacctcagcctcctgagtagttgggactacaggtgtgtgccaccatgcctggctaatttttgtattttttgtacaattttggtttcactatgttgcccaggctggtctcaaacttggactcaagcaaccttcccgcaaacgaaaaatttacaagtctggctacacattctgttgatgaggctgtggagaatcaggcactcctgcaaatgttctttttcagtgttttctggatttcttctgtgtttgtgttttttcaatatatttttagctattcttgtatattgatatgaactttaatagtttgtctagctctgtaaaaaaccatgttgatatttttattgcaattgtgtttattgtttattgcaatttataagctaatttagggaggcagttataggaagaaaagcatggaatgagacaggagtgaggacagagccataaagttctctaatatttagagaagggaaatctagaatgggaaatggaaaaggggtggttgatgagagttttaaggaggaggagatagttttaaagagcgtagatgtgctgaatactgatgagaagtgtcttcaggtaatgtattgtttaatacatgaatgagggacactgttcttaggcccttttggggatccaaataatcatatatacattgaataaggtgtaatgtatacattttattcattgatgtattgaataagatgtattattgaacacatgaatgagggacactgttcttaggtgcttttggggatatgaatgattatataaacattgaataagacccaaatcctattcttaagacattattgtctaaaaaggagcaggagatatgctaacttgacttttaaactttatgaggagaggtactaagtttgcagtattcatcactgcatccttagcattgagtctagtgtatatagttgatttttaatatatatttgttgactgactaataaatgatcaaaatgctctttcacaggtttatttaattattccacacttaaagatatacattgaataaggtataatgtatacattttattcattgatgcattgaatattattccacacttaaagatatataccagaaatgaacagttcattcacctaggtttttttttacatttgtaaaaatgtaaaccctatgattttaatttatttgaatcattcatgttaataattagcgaagtctgagggaataacataatctatggagaaagcatagagtgatcagaaaacctacttgaatatgccatgtgccgttagggattcattttagggccaggtgactttcattggaagatactgataagggcctattggaatagacacgagttacactgaaaaggattatttgaatttgggcaggtggagacaggaagaagtatgttctggatgaagagagagattaattgtgcaaatttttcttttatagatatatttcagtatgctttgaattattgctatgaagtagatgttatatttattcattcagtgtattctcagtgctaggcactatagagaatatcaaagtaggtataagtgccatattgtgtgtcacattttactggacattttgaaatggtgtaacttgagatataaagaatgtggcagagctttaaacaaatttctttacctgaattaatttatattttgggatatgttaaaaatgccaaaatatttttagggcttctattttcttttgtttcatctcctttttaagtaagagactatgaagccaaatactatttaatttaggtaatatactttttcttttaatagtttgctaaataaggagacagttttatattttatttgtaaaagaataaggatttattctatttgtcacaagtacatttgtcaccttgttaaatcaaggtctgataagaggctgaattcacaaaattttgtccttgaacttcatgtgtctatctcagctgtaatttctgatgccagcaatacttctcaactgagtgatgagtcttttgggagtggagattctattaaaacacttgagtttgaaaaatacttattatagttcatgttctcagaaaatattttaaaccctgacactcttctcttttggattttgtaaaaaagacgttgctgttttcctgacagtagaccattgtttttgattggaattctattatcttttatttgcagttccttaagtcaagctatgaccaaggtaattatgctagtgtatctcattgtaactatttattctaaggaataatttaatataaaaaagtccttagatcttatccaataatggcataaacttggaggttaatgttatatttggactcctcgttttacattctctccaggtgtgtacactcatttatgcatttacctttcgcttgtatgataaatgacttccagatctatatctattatttaaatgttcctgggaaatctctattactgccctttctcttctttactgtttggtaattactgatttacttgcctgtctctggctagtctgtaagctccttgagggcagggattacattcaacatcttctggaagacagttaatgcacaagcagaatattttaatcatattgttagttttagacttagtgctgtattgtacttcagtttgcccttctacagtgtaacccttttggggtcttactttaagcctgaagtacatccctgggcagtttcaccttgtctgaccttgaattccaacttatcttcccagtaccaggcagctggctgctaaagtatctgctcagctctttggcctctcagctattgctgtctgctaggcttttggattctcatccttcttatgtatgcagagtttagggattggtaaattcccccagggcaaattgcacgaggattttagggctcacttccatgcgacatcctcctctttgggctgtattgacctcaggtccttacagctttggccttctcacattccaacctatggctccttatcccccctggacttctgctttctattcccctgtgctgtgaatttaggtacatatcttcacaagaaaaagcaagggtaaatgtggaactcactttattcagctttttttctcttgaatagtagccccatcaggttctgcctatttcagttgtttcccagtgtcttttagcagttactttatgtacttctgtcttttgttgattttggtgagagactgagtcctgatataagctatttaatcatgactggcctgaagtccatgggcatgtatttaaaaaaattttttttttaaaaattgagttcaaattcacataaaattagctgttttaaaatacacatttcagtgacgtttagtactctcacaatgttgtgtgtggatgtgtttttaatttatataaatgatagtacactatggctcttgttttgtgtctcattttcacctaacagtatgttctaagaatttttcactttttcttttctattctaaatattgcatagcatgcatttaacttatctattccttttgtgatgaatatatacttttcttccacctccccacactgtattgcaactagtaagaatttattcttgataccattttccccaagcaggtaggttatgtaggggtcttctttgaaaatttgatccccagaatttctagtttaagtcattatctgtgttctggaggaactgactcttggggaaattcctggattctttggagctgttctagacttgaaagttctcctcccagatttattttggcattagcctaatttcttgagtatatctaaacatctgtgaacactgtgcattttgccacataaaggaataggagcactctctaccccttgaggtcttggttcctttatataaaaatatatgtggaaaaaattgggggacattctacaatctgttgagggtagcattctgcaagtcactaaaagtctgtgactttagatgatgatagtcagtgtatttagtaatcgaactcagaatctggatattgcaaacttctttaccacttattagctttgtgattttgggcaagttatttaacctctcagagccttggttccacatctcaatgatgagggtaataatagaatagttgttgggttaaagttaaagagaacgacaatgtaaagcacttatcttcgttctgacacatgttaaatgcatagtgatgttgatattttatcttacttcctttgaatactaaatgcatttttgtgaaagtggttattctactcatttggcaccccaaaatatggtaccttgtattatttttaatgagttgtgttattttccattaagtagaatctcatggagaacagagattttaccagaatctagcttagattgcttcccctgcagattacattaataatgcattttgattttttttccttttgtttctctctcttgagaaacagaaatcatttgtatttaaattcaaaattaaacttttttcccccagataaccatgatgactacacagacttctactatgacatttgctccttttgaggatacattgagttggatgctatttggctggcagcagccgttttcatcatgtgagaagaaaagtgaagcaaagtcaccttccaatggcgttgggtcattggcctcaaagccggtagatgttgcctcagataatgttaaaaagaaacatactaagaagaatgaataaatttacgtgatgagctctacaaggccaaaaattttttttcttatctacctgttatattgtgctaatttttctatgtatgtgatgtgaaatgaagactatatatatggaatggaggtgacagaaagaaagaaattctttgtttgagggagacttcccctttctggattgtatttgtagagtgttacgagtgtatcatgtgattatgctttaccggtataagagattctgttgtgattatttgaatagttttatattaataaaagaagacaaaattttttaaatgttagaaaaagcagatctgtcattgcaaagtaacaaaaattttaagcttttaaaaatgtagatttttcatatttttaaaatttgaatctatttgagctttagttcagcagaattaaatttttacttgacattatcattaaaattgctaggtatggagaacaattcctattttattttgaacactgagaagagtaaacttttcctaaaacactttatattataaatgaaaataaattgctagtttatattttagatataaacatcatattttttattaatacctacatcaaatggaaaatatctgaaattttttttccatagcaggtattttctactagaagtagttttactacttttcatttagaacagagtatgagtcttaatctgaagtctttttcatgcccttgttttaaaaaaactactttttttggcctcaaaaaaatcaagggtgtaatttttaataaattgttaatcctatgttttgtaattttcattttaggagcttgacttatttttttctctctcataaaaacacatttgttttaattgtaggagaaattttctcagcattttgcatgttctttctaatctttgttggtctgaatatattggtagtaattactgtaattattcaacaaaaagcatatccgttcaaaaatttttccactatgtcttttttctagtggctactgttttagttttctagttgaatatctctgacaagctttcgtatggttttgttatattttcatctacatgtaatgtgttattaattttattaaatgaaaactaatcaccttc

SEQ ID NO: 1257 - DNA, 76219 bp, Homo sapiens
gaacagtgcctaaatctttattttcataacctacattttttttcaaattagacagttttacactgaatgacacaaaaggaaacttaaattaccaatagtttacatgtaagcttgattccagtcttaatgaagcagaacaaaaacgaaaccctcgaggagcgaccacatgacccccgcgctgtgagctgctggcggccagcgccctcgcctcgattgtctgcagccctgtagtgggccgcgaggcacgcaagccgcaactacagctcgccagcggggcacacagacaggcatgcaccaccactacccgtcgcccggatacactgaactggttttgaagcctgaactgcagagatcctaatatagcaacgcaggacgtttacggccacccgccagtgacagccggtgatgtgatgacaggagggcctgggtgaaaatgtcaagacactcactctcagagaacgacgactccacttgaaattcatgtctggtgaaacgggaccaggtttttattcttctatttcaaaatgataagcatcatcacacgattttacaagttaaaatgccatttgtcactgctgcatctctgattctataacctgagatactgctgggggtaaaggagggtgttaacttaaaaaaaaaaaaagtatgaaagccactctcatcgctgtatgtgacacagcacagttggcatggaccgccacagcttcctattatgataactctcattttcttctgagcagaaactcttgaagtagtatcaggttttttcagacattatatagcaatctgtatttcacctttaattaaaaaggatgctataaaaatcacctccgagcaacgtttcagttcttgatgcagaagactgctgctggctaggcagtaactacagtgtattgaccggagggcagcagagccctccagtggcgactggctaatgcacgcgctgccctcctcatgcagctgttgagctcccacttcggtcgacaaagtgaaggactaagctggctctaaccacacacacacactgcgctgcaatgctcacaccttgggggaaaggacttctcattattaaaaaccaaggactcactggcggacgggcaggccttgtgttttgggaatggctgatggcgccctggcccttccgtagcgaagatgcagctcgtaggcccaggcctcgaggttgcctcccagctttctgagtattgagagtttgggtttcacagatcaattatttctgattttttttttttttttggtcagtgaactgacaactacaaaaaaaaatccccatgttctttaaaatgcatttgaaaaacactagccctgtggctatttctctgtatttgaataatggcaactgctttaaaggaaatggtcaaataggcatgttttcctctggcagggtcaatcatgcttagctgcaggtgatttaaattagattactagtcaccttcacttacgatcctgccagtttttgctctctatatactttaaaactctttcacattagatatgattagtatgcatttacatacattttaaaagagtatgaaaacatctggaggcttttaataagactttccaattcccttttgcagcaaagaggcagaatcagttcaacacaccgatgtaagagaaaaaagaaaatctcaacaaatcaaaataatattcaaaccacaacatttagtttatctacatcccgctcaacagcaacatttataatatatcaataatctgtatcagaattttctctgtagggtacctttttcatatgttctgattatttacaactgtacaagcgaagcacactccaagtgcacgtatttaatacagtattgactatttgcatttacaggattttccaacattctgaaaaaagatcaactgttgaagatctttaaggtatattacaaaaactactactagctcttgtactacagtatgcttactcagtaaaactagcgacaggagatccacgcagtaactgagtaactctgacccactcacgccaacccagggccgggctccatggactctaagctgtcttatacaaaagttaaggcaaagtcattttcaagtttaaataaaattcaagtctttaaatattggatggaaataattttttcttaaaaaaaaccctcagtcttgttaaataacattttgtggaataaagtgtatggttacatttagcaggaaatattcttattttaatgtttgctgcttagaataaagaaaaatttgaggcattttaaaacaaaataatttatatttaactttattataaacttgctaactttagtgcatccttgttcttcagaagtgcagcacttctggaagtgaatcaatgaggccctcgtcttggaggtaaaagagcaggaactttatcctccaccagccaaagagggggaaaaaccacaaacaccattctctcacgattacataactcttaaatccatgtgctgatgcagaggtacagggagatgtccacacggagctgaagatgtggactctctccaaccagagtgctggggaacacggacagaaatgtgcacagagcagggccggggccatcagctcacaggggtcaaaacaacatcatggtacaacttctggtaacatgtcagtgggcaacaaagtgtatgttttcatgtaggttctattcacaatgtgctttgaatttatattacataatagccacttgaaactggagtgagaagctggttacttgcttgcagtgcatcagaaccaaggtttctggggtggcccctgcaggttcactccgcccaggagatcaaaaaggatgcgctctctacattcttaaatgccacagtcccctaccaacggcttaggtggaagcacagctcccacatcagcactgatgccctggcgcggccagcactgcctctacgaggccacacctgcctctgccaaggccactggccctcattcatctgcggggacgttctagagatatgcacttacagaccagttacttaaaaaaaaaaaaaaaaagcagagttcccttaatttagaaaaactcactatatatagcttgcattcagagccacatggaggcttaataaaaaataccaatttgttaggataaatgctttttctatcttggaaaaaaaaatcagacttatgcatcacctccagttaagcaccaacctaaaataaggtttgtattaattaaatcctgaaaaatcgattttttttcaagagggggagaatccaactcacagaagaaaaccaacttgaggatcccacaggcctcagacactgcaagctcctaaccagcggctcgccctcgcactgagtgggagagtgtctcgtttgtggttaacacagcgctctgcgacccctcccagacgtacggttttcactgaggagacttggggggagtgctctgctctcggctgagacgcttccccatggccgagggcgagggccggccccccgccggccgcctctggtctctgggggctccaggtgtggacttgagggctgggggctcccggtatctctctgcgggctctgccagcttcttttcctccttcccacaaccaacagtgtttggcttttgttctttttggggttgcaatggggaagaaggaggctctttactcgttctctgacaaatctctgcgtagctgggctttcgcaattcctggaaacagacaatcctgggttacctgtgtgaaatggtgtctctagggacaagacaggaaatcaagttcacttaagataaaagagttttcaactgtaactaagtttccatcttcactagtgtttttaacttttaaaaagttcataaaatctaatgatttagtttcccctgcagcagaacactccctctgtgctactgtagtaatggataaaattagaaaaggcatgacgaagaagagtgctgactcaacaccatccctacccagccctatgcctgcttgggcaatgcggaagcctaggaagagtccggatgctgcccacactggctccgccagctcaggacaacagaagggtgtcccaggtgcccacggtgggcaatggaccctcacacggtactcaaccctgaaaggcaaactccaaaaacagtctttaaataaaaatgttttgcacatttcaaactacaaaggactggaaatatctaagaatgatgaagacagctaaaatcttcaagaaatgtgtaatagggttttcaggtaagtggaagcataaagactaaataacagaaaagtaaaatatttcccttaataacttttttttttttttttttgagacacagtctcactctgtcgcacaggctggagtgcagcagtgcaatctcagctcactgcaacctctgccttccgggttcaagtgattctcctgcctcagcctcctgagtagctgggactacaggtgcccaccaccaaacccagctaattttttgtattttcagtagagacagggtttcaccatgttgttcaggactgtctggatctcctgaccgcatgatctgcctacctcggcctcccaaagtgctgggattacaggcgtgagccacagcacctggcctcttttattattattattatttattattaaaattattaattttaacctataaaaaatccttttttagactcagcccaggggacagtaagggattaaactcccaaattcaaggaaaaggctcccccaagatcaaactacagaggccacaactcagagtaagagaggccacagttcacccagtagggaaaacagcagaaaggaagtcgctggggttcaggcctgctgggcccacaggggttggaggctggtggggccaccatcttgctcttcctgtctcttcatcagacacacgatgcgcgcgcacgcacgcaaacatacacacacgcgcgaaatgctgaaatgatcctaaagtctatggagaaacaggagctggggtcttgttactactcaagaaacctctattgaccaacactgaaataaaaggactacatggtggtctgagaaagaactagagtagttagtggaaaattattagcaaatattaaaggtattttgtacagaaaacacaacacagacagacgcaaataaaaacccaccaaattagatgtgattaaaaaacgagcaggtgcaggagtgcgcagcgtctgttcacaccagagcctcgcggctgtcgtgcaggaaggcaggcacgaggtacgtaccgtggcggctccgttcacctgcaccgatttacacgcggtcgcagtgagggcggaaggaagtctgtccacactgtgggtttccctctgtttctccgccaccttgggatcactgtaaaaatgccacccgatatttgaatctcatgcaacatcacaggccattcaagtcagtcaacaccaaggcgctggaagaacaccaatactcactcgggtaaatgagctggggagggggatcgctcgtacgttgctgatacagcacaagaagccggcaccgagggctctctggagaccactacaggaagggtgttcacgcttgcgtctgcactgagggtctgaaacagggtcaagagtgttcatcagagtcctgccggcactaagcggagctggtaccagtgcccgttcaccccacccgtgaacagccttgggagagcagcacaaggacataggggaagagggtcttctccagcaaaaatgtcacagagcccaggactatcctctgccccacagatcgcccacccttctctttctcggcaaatgccccactgttcttacatcacaggcccttatctcctctcccgcaatgatgatctacaagcttatttcttaactgaacaggcatcaaacacatctcacccacctggcactttgggcccagcacggcacggcacaacaccacatgcatatctgctgagtgtcgaatcctaacacagtccaacacaactcattcacaccgctgagaaaaaacaatcggcgcctccacacccatataaatgtgagctcccagccctccctgaattcacaaccccaggaagcaggtgtgcgaatgcccccatctcaacaggtgaggaaactgaggcccaatacctctaagttaatttgcccaaggccaggaagcaaaggacggagtgaaacttactccctccttactccagccagcgacccctgtgcaggggctatttcatgtgtgcttgatcttatacatatggcatgtgatgatacacttgtcatgcaacttaaaaaaggcaggagggcaggtgctctttacacttctgcccttagatgaaggctgacgacagacctagagcccttccagctggagaaccagaatccgctgcaattcctgcgctcgaccagcaggaatccagcttggtggaaacaagagggcaaaggactccttttgtaaaagctcattttaaattcagggtaggggccgggcacggtggctcacgcctataatccccgcattttgggaggctgaggtggacgaatcacctgaggtcaggggtttgaggccagcctggccaacatggtgaaaccccatctctactaataatacaaaaattagccgggtgtggtggtgcatgcctgtagtcccagctactcggtaggccgaggcaggagaatcactggaacccaggaggcggaggttgcagggagccaaggtcgtgccactgcattccagcctgggtgacagagcaagactctatcttaaataaacaaattaactaattaattcaggatatgtgcagtcccaatgcaaatgaaatgcagatccacaactgcaggtcatgaagcaagtcagagtgaccatcacgagctccatgtcaacaggggaagggctgaaccccatcatttctggagcctccaccccactttgaaacccaagggccacgctgttgactcaagaagctcccaagaagcagcaatggagcccactacacctgggtggtggcataaggctcagggtcaggcttttcaaagaagcaattctttcttcaagagaaaccttacacaagactcaaactgggcacagcaggagctgctgtttctgaagcagggttggagacctgcctcttctcctccactcaataccaacgggagtaggctacagttggaaaactagaattcatgatctttaaactgcatttcttctcaaggcactaataccttagaaatgacggtgtggaaatttaaggctaatgtgacaatcctggaatgtactcaatctccaaacaggagcatgaccatctaccaatatgaaaaggactagacacgtcacctggctttcattgtaaagatactgcatcaaaatccaccttaaattctgccctaggaagtgaggaatggttctatctactgcggggccttccctaaagcccagggtggaagagacactgactctgcagacctgggtggggtagcaagcagcacggtcatgtggcgtggaacagacacgtggtaactctggggcacagctggggaaagggcccctggcacaggggacaccggcaacctggagtgctcagcaggttcttcctgggctcttcctatgcacagtaggtaactgggcagaaaacttcctctgtacttcccagagccttcaacgccaggtgtggcagccggccaagtcccacttccacctcctaagcacattagaggccagagtgctgggctgagtgtcctctgtcatctgcagctcgggacgactcctgggatgatattcactgcagtggaggcggcacctcgtggggcagcccagacctcaccagaagctaccgacactacagtgaggttctcccaggcttcttgctccttgtctcatgtagattactacacattttaatcatttccaatacaattcagatgtttccatttcattctgttgttttataaaataaaggcaggtctgaactacaacaatgacaatgcaatctaagtttctgggtgagagaaagggtgtgtacggcacatcatggcacacgtttctacctctgacttcatcagacagcaatgttaaggagaaggcccagccctgggttcaaggctggccttactccaaatctgtgtgacctctgcaatcacgtggcctccaagcctctcttgagtattaaaaacaaacatgtataaagagctcagcaaagcgcctgacacggaacccgtacctagacactgttggcaactattagacatgcaatatatcccttaccctttctttggatggtcctattatcaagctagatagcctgttttcaaacaagtcctctgtcttcaaattgccggcagctccaggtaatggagggaagctggacagccccagctcgaagcttggcgacggaggctttggtggcgttggagactgtgtctggctgctctgcaacagaatgacaccccagggtcacggtatggagagagaaggccaagcagcttctcgtttccacacctgtctggaaaatatctgtagaaacaagcagatcattcaacccagacaagggcttcctcactcaattgaaggttctcccaagcaacttcaaccatctagagcagagctgtaaaactgaaatctcaaggatgctgctgcccaagagatgtgtcacaaaggacacagtgaggctaaggtgacatccaaagagctatccacccatggctgccagcactcacgaacagcaggggcagctgaaggcaagggagacactctggagtgactccagcccaccagatggaaagcagggcagcctgagtctagacattaaactttctcactttcagacaagtgttgtgttactacagcatagtttttaatgtgagtcacaagataattgtaaaaaacaaaatatgacactctctccacaacctgtgtaagaaattttacacacgtgcatcaaaaaagtggtttaacaaaagggaagggggctcgaattctctgaaaataaacttaatgaaagtttatatttttaaataattaaaaacacaggatttgacaacaaattctaatcagattctttgacttccaagaaagcaaactcagtataataagaagtgagtgtactttgtaagcccaaatctcagaagaaaggcagtaataccttttattggaaaatgatctatcaacccgctttaacaagctggcagtcattttgcgagtacgcagttcctcggctgaaggacacatggcacagaaaggggaaatgagtttgcatttagtttagaaatgaatttatattaactaaagaatacaactatttttagctgaaacaatgagctactctgaccaggaagcaaagatctcatgggatccacctaactggaaagtgccaatgtttctccaaagtttatacacaggaaggtgaatccctgcatcagtagattctagagaaaatatgtcagaagtgaaagcaggtcaaaggatgaaaatgaattcaggctgacacaaaccccagtccagtctgtgttgggcattccgcttgcttctctgctccacgcgacaggtgcctaattttagcttagcttttcccagttaggtgtccttggcagtaagcttgttacctactgagcagctggctgttgtatgctctctgtaacctagtattgtgaatatgatgctcaaaatgatcctgcaaagctctaagttacacatggccactatgatggcaaagcggttttaaacatctgcacgtttctgaggtgaacacagcttttcagaagataagcattattagagagacagccttccccaaaaatgtatttaaatctcaacttgtagaagcaaaagaggcaggcaacaactgcccagatgtgggagttacaaaatgacatcacccacagatgggacttgacttggaaggcagtgttaaaatcctctaggatctgagcacctctgggtgaggtctgagtactgctcaggtcccatgggcgtggttaggcccgaggctcacacacttttacagaaaaagcgtctggacctttctgaggtcctgagagcacgtacataagacgatgggcgtatgctctgtaatcaatacaacactgggccacaagccgaagcttcaaagcaggtcacagtcatgaacacatgcatcaggaatgcaaggcaaaacagaacggaagagaaatggctgtgggaaaacatcacggcaggcacaacagtgccctgtgtttagatgcttgacttgttagtccaaatggtcacaggaattcactaattccaattgcaattaactggtaaaaactgccttaccaactagttaaacaaaaactagactaagccgacctcatgaaaggcacaatttctgagttctaaacagagattgtatcttttgtgatgagaaagcacctgtgtgatggcttgaggggctggaccaggatttgtccaggtctcctccagcattccttgtatggaattccacatctgcaagcccatggaggcatccctcccatcttcgtgggtactgctaactgccaccttgctgtcccactactggttcgtgggtactgctaactgccaccgtgccatccctcccatcttcgtgggtactgctaacactgccaccgtaccgtcccaccactggttcatgggtactgctaactgccaccgtgccatccctcccatctttgtgggtactgctaactgccaccgtgccatcccaccactggctgtggagaagtccatgccatcctccactaaagaccagcacaaacattttccacaggagaaactctgattaatcaacccaagcaaaaatcaccatgtctcatgtacttaccgccacaaaaacctatcacttatgtttgggtctgtcctgccagtaagttatagcagaaggagataatgctttctacacagtgggagagtattcgaaagttttgaaggaaaaacaccgacaaacaaattgctccgtggaagatgcttactctgctcattgaaatgaatggctccagtcatttcagactctccggtacagctgccacacagaagagctcacgtgcacacccgtgtgtaggctgcagtgcatgcgacagcaagttcctggccatgcctgtgccacagcacaacacgcctgtgcactgtggagtcctgtgcagcacatcgctatttccaaaacctctacagttgcttcctcctaggccagccagggtgtcagttattacttagtggatttcacgttacaagtcttttgaaatgctcattcttgtgccttaaccttaatccatttaattaaatctcaggtttggtataaattagatttaaatgtcttgtgaagaggtatatgctttatgtactcactgtaaacttctcctcccttttcttccggtagccaaaggaattcttcctagaggagtggaaagtgaaagactgttatttttttcccacttggagaatttattattgagcacgtttgcactcacataatcaaagtacacatcaattcagtctttatcactttgaaacctttcaaagatgactttcaattctaaaatcccaacttcaggaagcgtaagcagaacaacacaaagttgacagcaagggactaacgtggaagtccaggcaagtgataaagaacagaagaaaacactgactgaaaccaactccctggtgcctccttgggatgtctgttaagacatgagtactgaacatccactgggtggaaatgacaagacacataaaatctgagactgagctccatcaatgagttgtttaaaatggtggtgagaattttcccggcgcagatttgctttacatcagatttaaaagaccccaaataccgcgtcccatcccttcctctgccctctcagcttcctccactactgcctcaatggctgaccccttcccacgaaaaccacacaaggacctctgtgccccaaagacttcctgccctcgcctcccagcctcaggaaccacattctggacctccccatgcaggcagcaaggccacgccacacacgcagttgataaccacaggacagacactgattaagtggtgacttcacgtggagacctaggactctaggatggccaagacattcccatttccctggacaggttatgtggtctaacaagtcacatgacacacattcatctcaatggataatttaatggaatgcaaagactcccccaagggccttgtattacataacctggaaaggagttaagaaatagtcttgactaattccttcatttacagaaaaccaaaaactagtcttgcctaagatggcctaacagtggaaaactctgtggaaccttgggccaaaccctctagggcaaggacggcacaaacctttaggattctggagcaaatccctattatctcctacagaaaactttctggaaatagctcctggctttctactggtgccttgcggagactgcaggccagactatgggacatggatgagtactgagccacaggtggggcatgagtcctgacaacccaacctcctgtaggaacagggggcttggtgctccttgtcctggatccatgcctgtggcctcacagggagagagggtcctgggcctgcattatggacagccaccccagtacacacctggctcagcaccactccctaatagggggtgctcccaaaacccagggagctgaactcctactccgctgcgccaggattcagaagtagtggaaaggtggggctacaatgacccatgagcagagctagggatgcaaccagatgagagtcttcagtgggacaggactcaactggccctggggacctgggaggggtgtgagacggatggtgtcagcacctgcttgcccagaggcattgccctgagcgctggacagagggacagcagccacatgggcagaggacatcccgcagggctcggcacagggcatccctccgccaagggcagcctgctcgtcactaccggctgggacgcaggggcacccatcccttggaacacagcggtgtccaggacacagacctgcctgccatggggtcctatcccagtcaccatcagtgggcccagccaacactcccccacaccctcactgggctccacgtaacccgtgtcagacccagaagcccacctgcagccgtagaacactgtcagctgtcagtgcccatcatgcagagagcaggttggctgagccaaggctcagtgacagggccatggtgggttacagctcacaaggggtagcaagggacccagggtggtcccagcaccatagaggaaacatcactgtgacacccgcgactctgaatgcagtggtgtgaaggcctgagaccctgaagaggtgtgcttcccccagctgatcctaacagtagctccaccaaggcagccacctggcgcctggggctcctcatgccattcaacccagctgggccgtgccctgccatggccgccatgcaagggtagggacatgtgtctggactctggtaaggggttctccaggacatcttagcactttggtccaatagagaaagttaatggaaacaaaacaaaccctcccaaaaaggggaggtggaggcatggctgctgtggatcaggttctcagggcaagcaaggcctggcacacctccctgcaaaacagcacaagctctttctcaagacagagggaaggaggaggttacgaaggtcagctctggcttcagaacccatcgcagaaacaggctgcaggagttgcatgcgctttccctgcccaccacttcctaaaccactccctaaaccactggtgcgtgcttcctaaaccactccctgcccaccgtgcccatgctggtgtgcgcttcctaaaccactccctgccgcagtgctcaggtctcaggtgggaggacagttgtcctcccttggtggggagagagagggtctccattggtgcaagatctgcatctgtcaggcaaaagcataaacttgttacagttgcatttggaagttcaagtattgttgaagggtatcctgggtagaccacattcgtcagcaagctttggactctcagcttcaaagccacctgtatacattttgtgaggtagctggaattcaacaagccccactttcatttgccaggaaactccttgtgacgctcgtatgaacaaggcacactgaagagcacaggaggctgaggccggggggccttgtccatctagtctgcctccttccacaccgtgcccacaattgatgcccctcagagggagccacatggccttgatgagtagggctctgtcccaagtctgagccccagctctgcaaccctcctccctccaagcgtctgggtcttaagaaccccaaactgagacccagggctagcaactgctccctgaagtcactgactctccatgacacggtgggccccttttggctttgcatctccaaggcctgttgagccaacctgatgccatgtttcctgtgagacacaggccagtgccagctctcccagaccatggtgccttccaatgccactgcacaatccctgcaggaactcctatgtgctcattgaatcattatgggcaggaatgagatgcttctgatgcctcttcatgttgaattctcactgcacagagggtgtgcactgtggcaggcaggaagaggagcttgcacgtcagggatggtgctgtacacattgtatatagaacaccctgaaaaagctcaggtatttgagtcacttgtttgtcacttatgagaggaaaatcctgacggtccttaccaaggcaaggactgagaagatcaactggccttatcaacaatgggcaggtgcggtggctcatgcctgtaatcccaccactatggaaggctgaggcaggaggatggctctaggccaggagttcaagaccagcctgggcaacacagcgagatcctgtctctacaaaatatttaaaaactagccaggcatggtggtgtgcatttgaagtcctagcttctcagcatgctgaggcaataggattgcttgaacccagaagttcaaggctgtagtgagccatgatcatgccaacgtaccccagcctgggcaacggagtgagaccctgtcttaaaaacaaacaaacaaacaaacaaacaaacaaaaacctactacaggattgatgccaaaaaaatgttaaacaaaaccaaaaatggtgggcaggaagcacagctaagacccgtcctggctagtctcaaccctccaatgagatgagactgcaatgctgatctgcctggttacccgctccaggctccacctgcagtgcctggtgcacacccagctggagggcgccaggccagcagccatggggcagagcctggacaccgcccttgcagaggggcctggtgagccaggggtgctgccaagaggagactgcaggcacatgggatggagtctatggctattgagctccagtgtttctacaaataatgatctaaaacaactacagttctcactgaaccatttcatattccaaaaaagatgaagccatttaagtcttagcaattatataaaacccttatgtttatagccttcagttagattttctgtgacatatttaaagacaattacaaaacatatctaaattaaataatttttaaaatattagtttatgatgttacacagtaactgctcaacaactcaccttcccctccctaaaccaggagaggattcgagactgcctggctccacacgcccaggcccagcctctctcttggcatatgctgaagggttttgaatccgtgttctagtttgacctgcttgccttgtttgtggactccggacaccattaattaatcgatctgcagtgaagttaaatattgaaggactttctaataacccaggtcccctctctgcactaggaatcgcatgccgcagatgagatttactaggattcctgtaaataaaaatggttttatgtgttgagttataaaatgatcaaggcattacataacatgcatactgacatggaatagctaagctgaaatctgctctctgtttaataaagtataaaaataggatttggaatggttaactcctaacatataggataatgcaaatctattaacaatgtgccacaattctgcttagctgtttttcagtccaggcccaaattaaaatcaggcacacctgatgtgtacaagttgccccaaagcctcctctcagagaatctgaggcgggcacccatgccagattgtagtgcttagtctttacagaatgcagctgtgtgcttcaggtggctctgtctgcgaggagcaggactagtgatcaaagctctctcatcccaactccggaagggcagtagcgtaaagaccaaaactgctaagaccgccccggaacttgcctgcttcgaggaggatactgtctgagagaagtcagaggagacgccgcaggcttgaacgctggagacgtaaacccatttataaatccagtatttggaaatggagttacctagattcatttgaaaacagacaagtaaataaaccataaaacagacttcaatttcattaataccaacaaatctgtggaaactgagggcatttcttgatgttgtcagagtcatgacccatgctgagacatgtattttacaattttatcaccaatgggtgctgtttagaagtaggctggagcttttgtgcatcctttcagccaatccttacaacaatccagcgaggagaactgacacatgcggaagcaggcactgagaggaaagacgtggtcaagagcgcatgggctccaacaagtgttgtaacctttagcatgtcagtctgatacgacctccatcactggcaggaagtcaacagttcttgattcctgatggctttaatacaactcatcaacattctcaatcttaggagcacctgcacacccactgctgctcactcggcttcatccaaccacagcctgacagggcctttacctttaccccgacacaagtcctgctctgcagatcagggtattttcagatcatcattattccccaagtcacaaggtaagtatggcatgcaaatatactaacataagattcagaagaaattagaaagggtcacagaacccctaaaagatcttaagtagttaaaaatattgagcatagaattttaagtatcggccaactatttttaaaatctagacacatacaaaaataagataaaacttattgttaaaacagttcctttaaaaacaaacaaacaaacaaaactcaagaccattcattctaattctctggcttctggacccatggtttccaatacgttctgcatcactgatatctcgctccttatgctcctgacacagggcacttagttcctgagggccttccagtccacaccctcaatgtcactaaagtgacagagatacgcatagagccctccttgtttggaggaagagagaaaggaaaggaaaaaagcaagtaattctccttaattagagctaactggaagatataacagaaaaagaatattatagcttaggactaaaataaaatcatacaaaagggaagttagaatcttcaatttgctacttgagaaactcttcactctgtaagaatcggactttttaaaatacatcacacatggccgggcgcagtggctcatgcctataaccccagcactttgggaggccaagggggggcggatcaaaaggtcaggagatcaagaccatcctggctaacatggtgaaaccccgtctctactaaaaatacaaaaaaattatccgggcgtagtggcgggcgcctgtagtcccagctactcaagaggctgaggcaggagaatggcgtgaacccgggaggcggagcttgcagtgagccaagatccggccactgcactccagcctgggcgacagagagagactctgtctcaaagaaaaagaaaatacatcacacttgaagagccatgaatgcagacctggatctgaggctgtaaatcatgggcagagcaatgaggactaatcatttccagcaagtcattttacagacagagccctgatattccagtaattttgctcaagataaaaaataaaattggtcatatataaaaaataaagttgattattaatgcgttcctattattacttgttggggattaataggcacaatctcttcagctgcagaacaaaggacgcacatgttttagcacaagtaaaaggctgcgatggagagccccagtatcacagactcagagcaggaccagctgtctggcacacaccgcaacctgaacatacaacataagtcaaggccataagctgacccagaaccccaaggatccccgagagggtcaaccatgattaaagaaacggaagaagcaactgctgcaggaagaactgaaaggactagcatggcaagccacgtgcagcgatgattcttcaacacccagagcctacggactcaagtctctctgaggttctctcatgatatgcttttgggaaaacgaagtattcagctatgggtacacttttatagaatgtgctacttcaaaaagccagaaacttttcttaccatcaggacttactcaaaagagacagaagtaactttaccaaaggttcttacactgcggtggttccagactcagggggaattggggtcctctgaaaatctctccctgtccccacctgcccttcacacggccttaggagctattttctaaatggagtatggtttcatttctccgcttagaaacctcagacaccttcccacaagcactaggccaaagcccacatgcctcaggacagctaagcacctgcgcagttaggcctggaaactgccagctcgttccccaactccctgccacccggtgtacgcttcagctcagacacccatgaatctacgaccatcttctgttcatgaaacttctctttgattccttctgaaaaactcatacttaacctgaaaagctcaacctagatgacaacacaatccctgataagacctgtcagtgttctggcattctgtacacgtgtctccttggcatgtttgacttttccagcctgagttgtttcatggacccgtatctttactttccgtgtatacaggcacttgttttctcaagttctctctgctctgcacctaccctccttttctgcctgtcagcggtgacatccctgcacatcagggtgcctggctcccagccatccgaccctgaggaccactcagtctttcccttagtccacagcgaaaccctggacatgaactcttctcaaagttactaactcaatttctgctttctgaccataaccttctatgtatgctacccttcaatctctccaattccaactaacctgcattgctacctcatgcaaacctctaggccatgaacccatcttcacttctcaactagacttcagcttcaaggacatgctcatccgtgtattgctgactctcgtgcatccaatgccaccaaactcatgctaattcccacccagaatgcacttgatctttcaagcatctatagcagcacacaaagagacaatgtctagatccagtacagacttatgaattccaaccataggccttaacaaaggccaaaatccataaaaattaatcctgtcgaccaactctaatgctggtgagaagtgagtaaaataaggctggtaaaacagcaggccttctccttggccttgctgtcagaagcctattaaacacctcttcctcctcagttaatcccccttgcattgtactctgtgtaggggacgccaggtacactacagcacttatcgccctctgcgtcttgctaagagctgcatgacaagaggggagacgggctgtgcaaggattgtgctcacagcaatccaaagttctttatgcataagctctgttctcagctacatttaaaatcccccacataacttgaaggtctgttttagtatgtcagactgcacacatatctggcttcctattagatgaggattttaatccttcaaattatctagcatagtgtctacaacataaattcctagtaaagaaatgacgtaccaagggtgggtcaagatagctgtgcgttgctgaccacgtctggggagtgatcaggctgtacagggggaactgctgctgggggctgtacatgggagggaagtagaacgacgtcgcgtagcgctgctgggcatacaggctcacgtccaggggtctaaatccattctttggcaaaaatgtgtttatagctattgcctttgcttttatccgtgcctgtttgaaaatatgtaagtttctattagaatacttaagaacatcaatttgcaaataaacaaagtataaccaatggtcttgcttaccttaattggttttccttgaaaagttttgacttcttctcgaaggtatttgtaagcctaagggcaaaattaagtacaaaattccattcgattaaccttatgaataagaggcaccaatagttcactcaatagctcaaatagggaaatatataattaaattatggtgaacagaacctagaataatgattcttgacactccctgggtcacagatcccttaaaataacctcataagagctatggaacgtgtaccccaaattctcacaaacaagatttgtacacaattttgtaagtattaacagatgccatagaagtctcccaaagaccactggctaagaaccttgacctggtggaaaatgatgaatactgagttcctagtattcatcccaatttcagattaggagaatgcagttcaggaaataccagacaggaaggaaaaggattaggatcataacatccaaaagtcattcttgatatatctccttgttcttctccatgttaattctacattaaacccctataaaactgtgaaggccctgcacctgattcaatatcatccgaccacattcgccacacgggctggcagagctcacactccactccacaaaaatggttactctatcttccgttccccttttccccctccatccaattaaaacccatctttcaggtttctgtgttttcttttctgaaccccacatactgtttataccatttaacactttataatatgtgcgttagtttcctcacaaataagatgcttcccttaaaagcaggaaaactactaactcctcacgcctccttacagagcttacttctcaataccattaaaagcatcttccaaaatacaatgaagtctgctgggagatgaagattaggttcaaatttccccccaaacactttgcaaatagtaaaacttctctgcccagatagaagaacaaaactgattttcctaggttgcttagcttgttgtccttagaaagtaaaatcacatgctttttatattgctataaaaattgtccatacaaatacactcaaatatttaagtttctacaacttgatttcctctgcagattatattcaaacttaccatcacaagtaatctcaatgcccaagtttagtcccaacatgcactaatagtaaaaactggtaaactatgcaattcatagggtgatggtggaaagaacttacctgttgtgcatcagcttctgtttcaaatgtaataaaccaattatcattatatgcaaattcacagtttataaattttggtaaattatctcctttaaatagtgcttctacttcctacaggaaatagagatgttagaaattaattctcaacaatgtcagtttttgtcctcaccaaaaatttttttaacaaatgcattctcttaaggaactatccttaaacaaacgtaccatgatgcctagtaaatctctcttccaaaaaggatgagggttcagcagggcttccagaatcagaatcacaatgccatagagaaaagcagtcacacaacttacagcttcccctactctcaagataccattaagctagattaatgtgaaaactatcatatcatgttctgggctgataactgcacaactttttttttttttttttttttaaaggcaatttaagaaaaaaaatttgcttggacttttgcttctggccatgatggactagatttactctcccagatgactcaattaaaaaaccaaagacaaaatacatgaagaacagtttcaggccctgaaccccagcgtgaacacgagtgtgatccctgagagggacatgaacaggggagttggccttcagtgcctgggccgcagagccggcagggtaagcctgcagatggccttccccacatcttcagcctgggaaacaaccgcctgagggatgagagggaacaagcccagggaaggctcaccaagagaggaatggtttgttttcccaccggccacagtggaaaactctcctaaacacacaggatagcagggacagtgctcagaagggcactgcttccgcagtggggaaaatgagccctagagaaaaggctgctctgattccacctagaaagttggttccaggtaacttcactgcatttcaaaacaaagctcaagaatatttattagaatacaaaaatattcagtaaagtaaaatttaaaactccgagcatctcctcaaaaatcacaaagcatgcaaagaaatagaaaatatgacctataatgcaaaagattagacctagaaatgacagatacgatagacttaatacacataacacatttactgcatatatattccatatcccataaaaggtaaagactgagcatattaaatatatatggaagattgtttttattttttatttttttttatttatttatttttgagacggagtctcgctctttcgcccaggccagagttcagtggcgctatctcggctcactgcaagctctgcctcccgggttcacgccattctcctgcctcagcctcccaagtagctgggactacaggcacccgccaccgcgcccggctaattttttgtatttttagtagagatggggtttcactgtgttagccaggatggtctcgatctcctgacctcgtgatccgcccgcctcagcctcccaaagtgctgggattacaggcatgagccactgcgcccggccagattttttttaaaagaccaaaatcaaactttactggagatgaaaaatacaatgtctgaaattaaaactacactaaataagattaacagctgactagacactttctgaagaaaaggacaaaaggcagaggaaaacatttaacaaaataatggctcgataaatttcaggtacgagaagtttgaaaactacaccaaagcatattgcaatcaacttgcttaaaaccagtagtaaaatcttcacagcagccagagaaagacttattacatacagaaggatggtgataaaaaccacagaaaacgtataccagaagagagagtatctttaaaacacagaaagggaggaaaaaaccccctcaatccagaaatctatatgcagcaaaaatacctttcataaataaaggtgaaataagattttcccaaacatactaaagctgaaaaaaattcatcatcggcagacctgtacaagacatgctaaaggaatgtccaggcagaaggaaagtccagattgacataaaggaatgagaaggactgtaaatggcaaatactgaataaatataaaacatgtttttcttatttttaatctctttttaaaagtgacttgtttaaagcaaacgtaacaacgatgtattgtgaggcttatgactgtgtagaattagaatgtgtgacaacagcacaggctagaagtggagaatgggagagcatggctgtaaatgggagagcatggctgtaaggtaaagaggcatggtgctctgtgaattacacggactctagtaaagttagagggtcagctaaaaaccctaaagaaagggggtccaatattttggcttccctgggacacaatggaagtagaagaattgtcttgggccacacataaaatacactaacactaacgatagctgatgagctttaaaaaaaaaaaaaaaaaaaaaaaaaaaaaaaaaaacctcaaaatgtttgaagaaagtttacgcatttgtgttgagctgcatacaaagccgtcctgggcggcatgccgcccacgggctgaagaagcatgccctaaagcaccactaaaaaacagaaacacagagttatacctaatatgccaaaaaaggagataaaaatacacatttaatcccaaacaaaaggaggggaaagggaaagaaaataaagaagagacaaaacagaaaacaaacagcaagatgataaatttaaatttaatcacatcattacatcattaacctcttaaatgtagatgggctacactcccaattaaaagacagaaattgggcccggtgcggtggctcacgcctgtaatcccagcactttgggaggccgaggaggacggatcacgaggtcaaaagatcaagaccatcctggccaacattgtgaaactctgtctctactaaaagtacaaaattagcttggcatggtggcgcatgcctgtagtcctagctactcgggaggctgaggaaggagaaccacttgaacccgggaggcagaggttgcagtgagctgagatcacaccactgcactccagcctggcaacagagcaagatgccacctcaaaaaaaaaaaaaaaaaagacagaaattttcagattggataagaaaagcaagacccaattacacactgctcacaagaaatccactttaaatatgaaaacacaaatgggttggttaaaagaggatagaaaagacataccatactaatgtcaatcaaggaacgtgagagtggctatattcattccaaattccagaggaaaaacagcaacaaggaaaaacagggccattccataaaaaattactagccaggtacacctcaaaaagtacaaaaggaatttgacaaccaaatgaactacaaaaacggtttccagggattctaatgccctatgttgttgtcccatcactggtaaatgcttactggttaaaagataaaacacatcaacgcaaagtcatacttgactaacggtaaattaggattatgacttttaaagtcaaacaataatactttaaggccactagactatcagtctactagtggcaagaatggttgactcctctgcctctgggaaaatcctatttttaagaaaatcagaatcagtatttaaaatgtactaatcactgacaagtacctagtgacatttaaagaataattttctggaaactcctagcctacatttctaagacccagtagaagggctctataataattatacagagtccttgggaacttatgttcttacgtggattgttttaggctacttattttccttcctttttttccccaacttttaatttatcaaagagtttcctttaaaccttctctcttaagactttcattgctcaagttttacaaaagacataaggtcagcagttttgaataatataaatactccaaaatcaatgtctactgctaaatgcagaaaattctccttggttaaagttttacaaacatttcaagtcttaaaaattaggatctatgttttaaatattactttgagttaatacagatgtccaaattaatcataagaaatatgctggtcctcggccgggcgcggtggctcacacctgtaatcccagcactttgggaggccgtaatcccagctactcgggaggctgaggcaggagaagcactcgaacctgggaggtggaggttgcagtgagccgagatcgtgccactgcatgccagcctgggtgacagagcaagactccgtctcaaaaaaaaaaaaaaagcaagcaagaaatatgctggtccttcatattcagacccttaataaaaataggaggaaaaaactataatcctaagttgtttttctccacatactacaatatagaactagtaaagacaggctaagtggaacagaaggtaaaacttgctagaataagaccatacttctatgagagtaatagaatttcttacgctaggcagagagctttgttggaatcctgccctttctcacatgctagggttgttttccttaagaaactctcacacacactaacccactcggactgaaaagcctgaaccgcaacgtccatctcctctgcagagaaggtgtgtggaaagaggtagcatgaacgacgaggctgaaatcatgtgagagatgagaccaacaacaaacccaggcttcctgtgttctgcgagtccccaaagcaggcagattccgttttctgaggtaggataaactaagttgccagcaccttctacaaagactttacctcatgatctcaaggtgtgaccatcagtgtgtttactacacaaagcaactcagtttaggcatctggacaaacagtagattttatagcaacacataacagtaaatggcttttcattacttttaagctatcagatactgtggttccctaaaattactgcccaagtcgggtggattatgaggtcaggagttccagaccagcctggccaagatggtgaaaccccgtctctactaaacatagaaaaattagctgggcgcagcgacaggcgcctgtaatcccagctactcgggaggctgaggcaggagaattgcttgagcctgggagatggagtttgcagtgagccgaggttgcgccactgcactccagcctgggcaacagagcaagactccatctcaaaaaaaaaaaaaaaattactccccaagttaccagttctctaagagtggccgtgctggcttggaccaggctgcactggtggctcagggagttattcacgatgcccctttgtcatagaaatacttgttttgaaaagttttttttatcacaaaagtgctctttttcattatttatgggtttactaatcttatttttaaataaatatttaaatgtgttatttttaatttctaaatatagaaatgcataaaccttcactatcttattataaggagtcctgagatcaaaaggtttggttatcattccctcctactctgtaactcactgtgtgtaaatcctgggaaaacagtgttaatgtaagtactcagtctaaaaaacacacagcccaaaaaaacacaaaagtaaaataaaatcaaaaccaacaaagacctttgggaaaatgtccaagtaaccttcagaggagaaattacttacttccacgggggtagattcagatatttcacgcaatattactatgcagcgattttgatttggccttactttttctcccttttcatccacttggactaaaggtaaagctacaaagagaagaaaaatcaatggtgaaacaaaaatattaaaatatgatatgccagtggaatgtgttacattatattactatattactaaataagctaaagaaacctgcaaatgggcaaagtaaaccaatctcacgttagatttttcaaagctcaggaatatggacatttaaaatcctgcaggagccataatgtatgtaacactatgaaacaaaggttctaaacagctcaagcactaagagcagatgaaaatacagggttaacggctttctcctttccaccagtacctaaagtgagataatcttgtttcataacttgtttctgtgtgcccttccctggctccctgatgatcatccctcacctaacggtcgtgcactgtttacattaggatgctcatgtgactgcagtaataggcctaatttagatttcgccagtttttacataaattgggttttggcatcacatctaagaaattacgcaatgcgcagattcgagtcacagcaagtaatgatcacaattagggctcagaggtgcccactgtcacaaagacacaaatcaccagcatcaggatgaaagtggcaacatcattacaggttctatcaacaggaaaaagataacaacggaatattatgaaaaagttcacactaatacattacatgaaacagaaacattccttaaaagacataaaccaccaaagctcaccctacaagaaaggtaactggtgcatgactgtaacttagtttttatatcttaatctgacaaaagatcatcaaagactcatatgctgaaaactgcaaaacactgccaaaagaacattttaaagacctacataaagacatattctgtgcttgtgggttgtaaaacttaacactggtagaatgcgtgaattcttctcgagtgaatttatacaatcaatgcaatcccaataaaaacaccaacaggactttttgaaaaattgtaatgatgattctaaaattcatataaaaatgcaaaacatttacaagggccacagcaaagctggaggttctgaacctactttaagactcactataacgttacagtgattaagacactgtagtgttagcatccaatcagacaagtaatcaagggaataaaacacacgttccagagaccaacacccacgtgcacgggcagtcaatacgacaaggccccagacacgtggggtgctgcaacagatgcacacaggatccataccccacaccatgtacaaacatcagcacaaaatagatgacagactcgaatgttcaaatgtaaaacataaaactaataaaaggaaaactatcataaccttggaccaagcaaagatttcttaggtacaacaccaaaagcaagatctgtaacacgaaaaaaatttacaaattggactatataaaaaatgtctacttctgcttctcaaaagacactggtagaacaaaaaaaaaaacagctgtacacttagagagcatatttgtaaatcacgtgtaatacatatttaagtgtacacacatacatcattgacaatgtgaccgtggagcaaaggagcatcttttcaacaagtgctgctaaaccactcgacatccacatgcagaaaattaatctaggtgcagacctggcaccaccattcataaaaattaaccccaaatggatcatggacctaagtgtaaaatgcaaaaccttaagtcctagaaaacataggagaaaatctagaaggccttgggtctgacaataacttcttagataccacactaaaggcatgatccatgaaaaaatttcattaagatttaaaacttctgcttcgtgaaaggcaacgtcaacaggatgagaagccattgactgatggaaaatagttgcaaaagacacatctgataaaggactgttaacatcaaaatgcacaaaaaactttaaaaatcaacaataagaaaatgaacaagattaaaaaatgggcagaagacctggacagacacttcacaaaagatttacagagggcgaatctacatatggaaaaacgcttcacatcatatgtcatagggaatgcaaattaagacatcaatgagatgtcactgcatacctgtcagcacagcaaaaatcacaaacaatgacaccaccaaatgctgccgaggatgtggagcaagaggaactcccattcactgccgatgggaatgcaaagtggtacatccactttgggagacactttggtggcttcttacaaaacaaataatattcttagcatatgatctggcaattgtgctccttggtatttatccaaaggagctaaaaaattatgtccacacaaaatctgcatacagatgtttatagcaactttactcataactgccaaaacttggaagtaatcaagatgcacttcagtgggtagatggataagcaaactgtgggacatccagacaatgaactattattccacactaaaaagaaatgatctatcaagccacgaaaagacatggaggaaccttcaacatatattgctaagtgaaagaagccaatctgaagaggctacatcctataggatccaactctaggacattctgcaaaaggcaaaactacagaggcagtaaaaagatcagtggcttccagtgactgggggaggcagggatgcacgggtggaactcagaggacgtttaggtcagtaaaattaccctgtatgatactgtaatggtagataatgtccctatatggttgtctgaacccatagaatatacaataccaagtgaacccttatgtaaactgtggactccaggtgacaatgatgtgtcagtgttggtttcatcaattataacaaatgttcctctgctgcggaatgttcatatgggaagaggccatgcatgtgtacaggggatataatgggagatctctgtactttgcttacaattttgctgtgaatctaaaactgttataaaaaataaagtctacttctaaagaaaggactcaattgttaataaaactaataaagtatgtgtgggacatctaaatagacactactgcaaagaagaaaaaggaaggcaaataagctcatttaaaaaatgctcaacttcattaatcattagagaaacagatgttaaagcctcaacaagatatcactatatagttattagaaaacataaaattaacatgattgcatacgaagtgtcagaaggatatggggcaactggagctctcatccctgctggtggtggccaaccgtaaaatggtccaaccactttggaaaacaggcaggtggtttcacagttgctcacacacctaaccacacaatccagacattccacttgtggctatttacccaagagagagggaagcacatggtcacacggagacttttacacaagtgtccacagcaatttgtagtggtcaaaacccggcaataacctaaatgtctataactgctaggtgcataaaccaactgggaatacccatttgagagaatacttcccagcaaaaagaagcaatcacctactaatccagtaaacaacaatagttatgccagaccaaaagaaagtgatattgcataatcgactccatttacatcaaatttgtaaacactgcaagctaatccgtagtgacaggaagcaaatcagtggttgcctggggagggggtagaggacgcttggcgggggtgggctgtgatggctgtttggtatcgtgattgtggtagtttcatgggtgtataaatatgttaaaacttacgaaatgtacacttagaatgcataatttatggtatgtaaattctacctccatacaggcaggggtgacaccctctgcacttcatgcctcgcccaactcacctgcccccatgacgtgacactgaatgatgagcttcaatcccgttcatgctttcacaccatctccgtgctcctctgaacccacaaaaattcctgtgcttcagctttacacacccccaagctttatatacatggtatcaccttgcacaaatttggaaatacgcttttataaacattataattttaaaatttattcttgttggaatatgtaggcctagctcactgtaacagctctggtactcactgtgtgtatataacacaacgtatttattctggtgacaaatattttagcatgtctttttaattagcagttcagttacatgaagggtgaaaacagcccttgactcagacatactgggacacgcacattgtgtttactgtgacattaaaaataatctggaaatgtaacttatgcaacttaacacaagagctgcactattcaaaggaaaatcattcagacaatcttgagtttaatttgtaaaaagataaaattaaatattcatcaaatatctgctgtgtgtctgagtctctgctaggtaatttgggcacaagatctaaacataagatgaggccaggcatggtggctcacacctgtaatctcaggactttgggagactgaagtgggcagatcacttcaggtcagaagtttgagaccagccctgccaatgtggtaaaacctcgtctctactaaaagtacaaaaaattagctgggcgtggtggtgcacgcttgtaatgcccagctacttgggaggctgaggtaggagaattgcttcaacacaggaggcagagttgcgatgagctgagatgacaccactgcactccagccttggcgacagagtgagattccatctcaaaaataaataaattcattcgtccattcaacttaatttaaaaaaaaagtaagatgagaactttgctcctgcggacctatttatgacattttcatcctcttaagagctacaatgaatgcaataacttgctaactatattcttgtcacataggttcttacaaaggcatgtacatttctgtccaaaaatcgagtgaaaaaagacaaaatgagaaactaaagagctcagtgcaaatggataaaagttaagtcataaaaaaggcgggaggagatgggacgaaataggtgacaagcctgccctggatcgcctatgggcaggtgggctctgttaagcaagcacacagagcaatttaatatcctcatggttggtggaaacgaccccttgccagtaacaatcaactgagaaatcatcccagtggggcagcagcgtttgcaaggtctgtccgaaaaggaataactaaacctgaaactcctaatcataaccaaaaagacttcagagtacaaacagggacaagaatgctgctggcctttcaaagatggggcccaattcagctggcacagacaacagcttctgttctgcatgatgacaccagggagcacggcgccatcctgggagacagcagtgccgctctcagaactcacagtcaatggtaattatgtttgtcagttttttcactgtctccaataatttaataacccatgctatttgtctaaaaacagaaaaacataaaacttttattttatattttatttgtgaaaagaaaatccaactaagttctcatgtaagatgctcacttttttatactactgtaaagtcaaattcatacaagaaaaaaaaaaaacctgcacagactgtcgtcagtacagataagccagggacaacgtgaaaacccttctatgtgagtataggcagtggacttaattgagacttgaagtcaggcttagcaatgtccaatcactcaaaactatgtaggggcaccatccacacttaatgcttaaacactgtttgatgttgccaaacttcaaagaaacaacttcactcacaacataatttttttttttttttatgagatggagtctatctctgtcgccaggctggagtgcaatggcacaatctcagctaactgcaacctccgcctcctgggttcaagtgatttccctgcctcagcctctcaagtacctgggattacaagcacacaccaccacgcccagctaattttttgtattttagtggagacagggtttcaccatgttggccaagacagtctcaatctcctgacctcatgatccgcccaactcgacctccaaaagtgctgggattacacgcgtaagccaccacacctggcccacaacataattttaagaaaaattgcaataattatttcatccgaacataaacaggaagttgcaatttgaaagaaaaacctctagtggtaaaactgtaactaaagtgtattttactttaactataaatgttatttttattttgtttttcatgaatgaaacagctatctttaaaatccccattaacaagattcttttctacttcatatgtcccaaaacttgtttgaggtttcataacgggttcaactggcattcccagggactatcaggcgctactccagaattattggacctgggcagaaaggaacggaaggccagaaaagaatctgattcgccatcaaggaccttaacgtttgatggctatagatttaaaggttcatgctgataagacaaatactctaaggacaagtattattaatttaaattgtcatttacttacatcttagcacttccacaatcaagtccacatcagtgctgagcttcttgatgtggtcgaggttagccaccgttgtgattggcacatactggtcactatccatctgtgatataagatacatgtcactagcaaggttctccctgttgaaagaaaacaatctcttttaatcagtatttctttaaaaggaagtttcacctactgtaattccagtttcacaagaggcgtgagtgtggcatggtattgctttggagttaaatctcagcccaggacccatctgttatttgctgtctctccagcctcaggtacatttttgcaaaatctcggccttggagaggcagggagtgcaaaagtaaaagtatactgtactttctacaatcaaaatttatgagaagatggttatttttaaataagatgtaattatttatagctgtcatttttgtcctaagaagtagcttaagagtttattaaaaatgcatacaattttgttaggccgggcacggtggctcacgcctggaatcccagcactttggggggccaaggtaggcagatcatctgggttcaggagtttaagaccagcctgaccaacatggtgaaaccccatctctactaaaaatacaaaaattagccaggcatggtggcgggcacctgtaatcccagctactcgggaggctcaggcaggagaatcgcttgaacccgagaggtggaggttacagtgagccaagatcacaccactgcactctagcctgggcgacaagagtgaaactctgactcaaaaaaaaagaaagaaaaacaatttaaagtaaagaaatccagctcaatgaacaagaaaggaaaacataaaaaggccaggataaggtcatacccaaaattcctcctgtagactctggaacactcaccagagggcctatatccagccctggcttcctagcagccagaattaaaaagaaggaaacagtaactttacccacaaaatccaaaggtgagccacaaatcatcagcagtttgggccatgatgagctattttctggtgttttggccaaagatcaatgtttcctgtgaattctcaaggcatcatgtaatgtagtgaacaaggccctaagaaacatttcaaaactgagcacagtgctgggttcctggggcctctgctcagtgtccctcggtgaaggcccatgactgccgatcaaacggaggccatgcaggaggaggccctgctccaccctcatctcggccatcttccaggtgtagctgattctggccccatggggctacacatggatgtgagtggcagagagctcacacttgtgctccactagggcgttccactggtgcccctgcaccttttgcgtctaccatgtcatggtgcggtattctcagactccaatcgtggaacagcatgggcatggggaggaggccagcagagcccctcacacctccacctcatacaccccacaggcttcaaggagcccctagcagacacctgtgtggaatcctcagggctccagagaaaacacctggaaaatcatcatcgacagaaaaccttatacacggcccatcggttgttgtcatactcagagaaattacatcaaacccaatcccatcctcctttatgtccagttctgccattggaactttaaaggttttactaagaaaagggtattattcaggggaaagaaaaatgattaaaaatgagtgttatataaataaaacaacttgctatctcagtgtctggtgtgctttcagaaacaacgtggcacacttgttctccaacttcagtgtgaggaagtctgactcggcagcacagggcgggcggggcactttagacgcattccagacagtgaccaccgagaccactggggaccacagacatgaaggttacgttccatgctcaaatgtcaaaagactgtcattactcaatattccacgtcttcatatacatatatatggatatgagtagatactccttcataaaatatcacatttgtatatactttaactatttgcacaatactagaaatatcaggtactagaaaaaccaccaccagccttacctagataagcagaattccaatgtttttttaagtacttctcgggggtcttcctggctgtctggttgagactcatttcctcctacataaaagtaataatcaacttaggaaaaccggcttaaaatttaggaagcagataattcagtacagcagttctaatgctttcaacttacgttctgacacaactacgtaagtgtatcctaagtaagaaaaatgctactttacctatcaaaaaagtaaatcatgcaaaaaaacctatccctttatcccccaaaacaaaaacagcacagtttagaaaaataatctaagtctcattagcagagttcagcaggggctttttctaccagaaatgacaagtgtaagcttagttaatgccttgtctcactgcaaaaagaattttcaagtaacctacacaaacacaaaccctaaacaataataaaatacagaggaaaaaattaaaacaacaacaacaaagataaccagcaaaaaaccaaggctggagatcaaacaggctctaggactagacagtttctacaacagaggcttcaatttgccttccaacttccagagtcgaaggaacaagtgagaattgtcatgttacagaattcctgtaagagaatgataaataaaccagatcttcaagaggaaacaaaagctggttctaaatcctggaagaaatttctaagaagatgccagagggcatggtgtgtgtggtcacaggcagcacagggctgtgaatttggagctctagaagacactgcataaactgctggactccggacactgcataaagaggtattttaataatgttgcgatgacaggcactgaaatgctaagaactaagtttttcctgccttcctatataaattagcatggtacaatcatataagagccatgctaacacaagagacacttgtatcttaaaagtcaaagttaaagaccatgaaaaggcaaagacaaagtggggcgttcaggacaaatgagagggatagagagtttgtatggtgttatacaatgagcttagtaaaaatccacccccatcagcaaaaagaaaccaaaactgctaaagtaaccataacacaaaaccaaatcatgggactcaatgagactgaaaatggaaaattgaaaacacaacctgatgccactgtccatctagactaaggtgtctccgggtcactcatctaaattcacactccactccccatgtttaataggtatttactaaatatttccaagtgccaggcactactgcaggctctgtgaattcagcctgaataacgcaaagcctgtgctctcgtgaagccaacactctggtgggagaggcagataacagacagttaaccagtaactatacacatcatgtcagagagaaacggacactgaggaaacaacccaggatgaggggcagcaaggcctggtgccatccagacaggaagtgccatatgatctgatagaggaggggtggggcacacaggaaggtgggaagtgtgttctaaatggggagcctcaagcacaggggtcccaaggtggggcctctcaaggggtagagtccagcagtaggaggccagcacagctgagaagaggggtgacagacacagtaagaaatgaggtcacagaggccggtgtgtgtgagtgagatcaaggaggacgttaaagtaacctaaacgtaatagaaaatcaattcaaggctgacattttgaaaatatctctctggttccatggtgtagacagactgtgcaggcaccagccggaagataatgcaatcactgaggacagggcactagggaggactctccaagcgataggtggtgccgaagccacaagggaaggaagaaaagcagcccaggactgaacccgggacactcccaccttcagcaggaggcaagcgcatgagggccaagggacacaggctcacagccagcaaggtgggaagaccactaggatactgtgaagttaggagccaagagaatcatccactataacatgacacagtagagccaggtaagttaagaagttgaaactaactactagatctggctgcaccagggtcattaaagagctcgacaaatgctgcttaggacaactgtctacctggactggactcaagagggaatggaagcaaggagacctggactgcactcaagagggaatggaagcaaggagatgggacagcaagcagacagctgaagtgttctacagtggaagatgggctgcccggggtggcttcacctaagatgagagataataccaccttagaaagatggggagtgacccaaccatgcaagaaacacccggcactgcagacagaggacactgaggagcaaagacaatgacaagtgagacgggctctcagggagactggaggttgggcacatggtgttggtaagacacaggccatctgcctccaggtagatggagtcacaggggctaggttaactttccctttaaaaccaccaagaaaccaaataagacagatgaaatgacagttttccagatgtgggacatagagcaacaaaggacatagattcctatgtgacatgaaacttttttcttttttttttttgagacggagccttgctctgtcacccagactggagtgcagtagcgcgatcttgcaaccttggctcactgcaacctccacctcccgggttcaagtgattctcctacctcagcctcctgagtagcggggattacaggcgcacaccaccaggcccagctaattttttttggtatttttagtagagacagggtttcaccatgttggtcaggctggtctcgaactcctgccctcgtgatctgcccacctcagcctcccaaagtgctgggattccaggcgtgagccaccgtgcccagcttgacatgagacattaaagtaacccccacaagtccagcccactgccctgagggaagtcccaggctgtgcccagggagtgggaagtcaggtgggaacccagtgtatggctgtgtggaagagaaaaagagaatgcaggagatagggaggctgattgcataggccagacagcaggaggagctccagagaaccacagggcccaggacccatcacgttgtcagccaggttctttgcaaagcacggatgtgatgaaactacccaaggctcgtggaagaaccacctgaggggatcagaagtataacaatatatgtcattcacgtgcagagcctgaaatggttaaccctccccaccagaaactcttgtgattcccggagccctgcctcggtgataggaacaggccccacacagcaccgtcccactcacacctaacatcttaaaaacaagatatgaaaggatcacactgtttccaagaaacctggctgcatcccagaacaaatatcaaatatttaaagaaatacaaaaatactaagccctgaatacagtaaaactcaatctaaccaaaaattaccatgcatgcaaagaaagaagcaggaagatatgacccatgacaatgagaagtatcaaccaacagaagccaatccagaactgacacagatgttaaaattaactgaaaaggatgttaaaagttatcataactgtattccatatgttcacgaagtcaggtaaggacataaaagttattaaaaaaaaaaaagaaaaaacttatagagatgaaaactccaatgtctgatattaaaaatacttgatgagattaacaacagggtaaacattacagcagactcgggaacctgaagacacagtaacagaagcttcccaaaatcaaacagaaaaatgagaagcacaaccagctgagaggatcagcaagctgcggacaacatcgagcagctgagctcaagtgtaacagcagaccctggtatagtcagccctcaacacagagaaaatctacacacaggagtagagagcaccagaaaccgccatgacatggacaaacacgtatgctgttttgcttgttacagtttcaatctcttttaaaaataactgacttttaaataaaaataaaaacatatattgtcagtttatagcataagtaactgcaaaaggcatgatgaccaaagcatccgggccacgagagaaacggcggcagactgccctgatgctgtgctctatgtgaagcagcacgcagccacctcaaggtagactgtgttagccggaggaagtggagcaaaacgcaaagaaatcattaaaacagcgaaacaaagaagaaggctgctccaaaggaaaacagaaaaaaagggaaagaggaacgaagaacacatgggacaaaaagaaacagaacacgtctagcactcaatcttggtttctgatatcactgtccaatgaaggacccagcgctccttggagaaatggctgattctaaggctgaagcaaggagaaacaaaacaaaacaaaataaccacaaaaaaaccctatgttgatggggcatgtcaaagggagccgaccagaactcctgatggccaaagctagaagaacaatttgagcaacaaaataaagcagtactggattataaccaaaagtataaaacaaacattctggaatccacactgctataaagagttgaataagtaaataaataaaggagaagagacaaatctcccatacataagaattttaaataatttacgaagattcgtgtcctcatggagggggaccataaatccccaactccttaagtgtgggctgtacgcagcgacttccttccaaacagtacaacatggaaatggggagggaaagggtaacttcatagtgagaaacccagtaaacagccaggtgatcaagatcaacaccaacagtggtaagtcacgttgacaatgtgcacccttgatatatgtgataaaagtggtgttttaccttctcaaacccattaccactatagtatcataatgaggaaaacatcaaattctaatagaagagaatgttgttacaaaatacttgactagtactcttcagaactattatatcaaaactaccacaaacaaggaaagcctgggaaactgttacagccaagaggagcctaaggagacgtaacaatgaaatataatgtggttctcagctgagatcccgcaacagaaaaaggacgttaggttacgatgtatcactactggttcagtgattgggacaaatgtaccatattaatgcaagatgtcggtaataggaaaaactgggtgccaggtatatgggaattctgtgtgttcaatcatctcaatttttctaagtctaaaactattctaaaacaaatagcaagatgagagacctaaacctaaccaaagcaattaccacactaaatgttaacgttctaaatagaagacaaaaaagcaaaacccaaatgttatgttatctacaacaaatgcactttattaaatacacaaatagcttaaagtaaaaaggatataagatataccatattaaggctagtcaaaagaaacctggagtgattacattaatgtgagacaaagtaaattgagagcaaagactattactaaagataaagagaggggtcaatgaatcaagaggccacaaaaaagtcttcaaaatacgtgaagcaaaaactgataaaactaaaaggataaacagacaaatgcaaaaattaacagaacctttctttcaatagttgacagaacaagtagacagaaatcagaaagagtacattaatcttgaacactaccactcaacttgacctcattaacactgacaaaatattccccatagcaacagcaaaacacatattcttctcaaggacaaatggaatatttaacaagacagcccatatttgaagccataaaataagacttaatatatttaaagaaattcaagtcatacaaagtatgttctttgaccacaatgaaattaaactagaaattaataaaagaaagatccctggaaaacccccaaatatttgtaaactaaatcaaatatctctaaattatctatgagtcaaagaaaaaaaatcaaaaaagaaatacagtatttggaagtaactgaaaatgaaaacaatgcatctaaatttgagagattctgcttaagcactacttatggggaaaatagtaaaactaaatgactatatcagaaaataagaaaggcctcatattaatgagctctgcttccaccttaggacacagaagaaagggtaaattaaacccaaagaaatcgtaagagagtatattacaaacatcagaagaaagaatgaaataggaaagagtaaaacaaatgagaaaaatcgataaaatgaaaacactaactttttttttttttttttttttgagatggagtttcgctctgtcccccatgctggagtgcaatggtgcgatcctggctcactgcaacctacgtttcctgggttcaagcagttctcctgcctcagcctcccgaggagctgggaccacaggcgcccgccaccacaggcggctaatttttgtatttttagtagagatggcgtttcactatgttgaccaggctggtcttgaactcttgacctcacgtgatctgcccgcctcggcctctcaaagtgctgggattacaggtgtgaaccaccatgcccaacagaaaacaccttttgataaggtcaataaaactaacaaacctctacccagactgattgggattataaagaagacacaaattaccaataacagagatgagtgatgtaacatgactacagatttcacaggtgataacagagtattatgaacaactctgtgctgtaaatcccacaactcagatgaaatagaccaaatctttgtaactatataaaccaaagctccctcaagaagaaataaatgagtagcactatgaaaaaataaactgtagttgaaagctttcccacaaataaaactcctgcccaggtgggacgcagtggctcatgcttgtaatctcagcatctagagaggctgaggtgagcggatcgcttgagctcaggagtttggagaccagcctgggtaacatggtgaaactccatctctacagaaaatacaaaaataagccaggcgtggtggtgtgctactgtagtcccagctacttgggaggctaaggcgggagaatcgcctgagaccgggaggttgggactgagtgagccatgatgatgctactgcactcaagcctgggtggcagagcaagactctgtgagcaactaaactaagtaagtttagtaagtaagaaaggaaagaagaaaaaaggaaaactcctgcccacatgacttgtttcacttcctcatatgagggtgaaataatacgtaacctcttccaaaaacttaaatagaaagaaaaacactgaaatgaaaactagaaaccaagatcccaggtgtaaaaattctaagcaaagttttggtaaatggaatccagtagtatatccaaagtatactgtatcatgatctacagaggtttagaccacaaatgttggtatcacatttgaaaaacaattaatacaattcatccgaacacactaaaaaacaacaaatatatgcccatctccatagatgacaaattacaatattcattcctcataaaaatctctcagcaaaccaggaaaagaagagtgcctcatcaacatataaagggcacagacctaaaaccaccactaacgttatacttcatggtgaaatactgagtgcctcttgtaagaccagagacaacccaaacgtttgttcattctttccacttctgttcacctttgtactggagggcctatctagtacaacggggcaggataaagaaataaaaggcatcaagattggagagaaagtaaaacagtcttcattctaaaataatccaatcatctatgtagaaaatccaatgtaatctacaaaaaagtgtctaaaactaataagtgagcataacaaaatttctgggtttggactcaatacataaaaatgaatgctttgatatactagtaacaaacaactgcaaatacaaattttaaaaatcacttacaatagcaccaaaaaatataaaatacttataaactggataaaagatgtaaaagaccagtacactgaaaaccaaaaaatacttctgagagaaattaaagatctaaacaagtaagagatacatcttgttcatggatattgttcagatgtcaatgttctccaactgatctatagattcagtgaaccccccaacaaaaatctcagcactttgtagatattaacaacctcattctaatttgcatggaaatacacaggaactggaatttaaaaagtaactatgaaaaacagagttggaaggctatcactacctaatttcaagaattattaacagtacaggcatacctcagagatatcatgggttcagttccagagtgctgcaatcaagcaaatattgcaataaagcaagtcacacaaagttctgttttcccagtgaatataaaaattatgagtacactaaactgttgtatatttaatgtgagatagcagtatgtccttaaaaaaaaaactacaataccttcatttaaacatactctattgctggctgggcatgctggctcaggcctgcaatcccagcactttgggaggccgaggcaagtggaacacctggggtcaggagttcaagaccagcctggctaacatggcaaaaccctgtctctaataaaaatacaaaaattagctgggcatggtggcacatgcctgtagtcccagctacttgggaggctgaggcacaagaatcacttgaaccctggaggcagaggctgcaatgagctgtgatcatgccactgcactccagcctaagtgacggagtgagattatgtctggaaaaaaataaataaaaagaatctattgttggaaaatgttaacgatcatctgagccttcagcaaataataatcttttttgctggtcctgccttgatgatgagggctgactgttcaggatggtggctgctgaaaacttgggtggctgcggcaatttcttaagacaacagcgaagtatatcacgtggacggactcttgctttcaccaaagatttctctgcagcgtgtgatgctgtttgatatcattttgtcaacagtgggacttctttcaaaattagtcaatcctctcaaaccctgctgctgctttatcagctaggtttatggaatattctaaatcctttgttgtcatttcaacaatattcacagcgtcttcaccaggaatacattctaactcaagaaaccattttctttgctcatccataagaagcaagttttacacattcaagttgtacatgagattgcagcaattcagtcatattttcaggctgtacttctgattccagttctcttcctatttctactacctctgcagtgactttctccactggtcatgaacccctcaatgtcctccgtgagggctggaatcaacgcctctggttaatgttgacattttggccttccctcacgaatcacaaatgttcttaacagcatctagaatggtgaatcctttccagaatccatcagaggaaccatgatctatacagctagagccttatgaaatgtattttttaaataagaaaatttgaaaacacaatgactccttgatccataggctaccgaatggatgttgtgttagcagccatgaaatcaacattcatctccttgtacacctgtcagagctcttgggtaactaggtacattttcaatgagaaattaaaatctgaaaaatatctttgtttttttttttcctgagcagtaggtctaaacagtaagcttaaaatattcagtaaaccatgatgtaaacagatgtcctgtcatccaggctttgttgttccacttaaagaacacagggagagcaaatttagcatcattcttatgggccctaggattttcagaatgggaaatgagcactggcttcaagttaacgtcaccagctccattagccccaacaagagagttggtttctaatgttgaaaccaggattaacttcttctctttagctatgaaagtcctagataacatttccttctaatataaggctattttgtctcgattgaaaatctgtcatttactgtagccatcttcatcaattatcttacccagatcttctggataacttgctgtttcaccttgcatttttatgttatggagactgcttcttttctttaacttcatgaaataacctctgtgagcttcaaacttttcttctgcagcttcctcacctctcagccttcacagaacttaagagagttaaggtcttgctctggattagactttggcttaagggaataattgttgtgactggtttttctatccagatcaaagtttctccatctcagcaagaaggctgttttgctttcttatcatttctgggttcactggaggggcacttaatttccttcaataacttttcctttgcatttacagcttggttaactgtttggctccagagaccgagttttcagcctatctcagcctttgacattccttgcttactaagcttaatcacttctagtttttgattaaaagtgagataagtaaaactcttcctttcactggaaccctcagaagagggaatgtagggctattaattggcctaatttcaatactgtcatgtctcagggaataggaaggcccaagcaaagagagagagagacaagggaagagccagttagtggagcagtcagaacacacacgtcatttatatattaagtttgccaccttaaatggtgtggctcctggcaccccaaaacaatggcagtagtacaaaacaccaaagatcatcgatcaccactagcattaataataatgaaaaggcttaaaatattgtgagaattatgaaaatgtgacacagagacatgaaatgaatacatgctattggaaaaatggtgccaattacttgcttgatgcagggttgccacaaaacttcaatttataaagaaggtggtagctgcaaagcacaatgaagagtagcacaatgaagcaagctctgctgacaatccaagcagtgcactactggagtcaaagcgggctagcgcatcaatgaacagaacagacagtccaaaaataaatccagacctacgtggacaaacgacttctgagaaaggtgcaaaggcaacgcagcagagagaagtctttcaacaaacagtgctgcaatagctgcagattcctatgcacaaaatgaaaataactttgatccatatttcataccttatacaaaaactaacctaaaatggacctagaaatgtaaaatctaaagcaattaaacttataggaggaatataaaccaaaaggaagagccataaaagaaaaaaatgataaacttgattacacaagaaattttaaactgcttttcaaaaatactcttgggagaacaaagtacattgcgtatctggacttatatccaaaacatataaataactatcaaaagtgagtaataaaacaacccaataagaaaatgcacaaacaggcacaacaccaaataagatatatgcattacaaaaaaatgctgcaacttcaggttctgcatgtgagaagcctgcaagttatcactctggtctgacaagtaaaaaatctaaaaagaacaattaacaactcttcttagatcctacgtaaagtcacaaggcaaacaactgctgccaaattggacagacagacagataaatagagaagcgatcacaacatatggagcagaaacctttgcaggaaccaaggcgaggacagaaaacactgtcctggaactgattaactgctggaggctcagggtggccaagtctgagagttaaaaactgcagggagtctcagtcattggcgggtgaggggttcctgcacttttgtgacttatactttctggagctcgatcaggtcctcacagggaatactagagaaaaatccctttgtgcttccggcacgagtaggagaaaagtaaccgttttgaaaaataccagagcactctgttcttcttaacaaggtctgccctcaggaaagacagtttaaccacagtccaacttgctggggtttaatcagagcagaacatacctagaggaagggaaacacctagctcctgcctcctctggtcatgctgccccacctaagaggggaggaaagaagagaagctcctgtgagcttcacagtccagggcccgggctcactacagacttgagactcccaggcctcttatggaaggcgtcccctgcccacacctcaccccacagcactgaaggcatagtcaccacagtgccttccacccagcacgtcacagctggctctcaagaaagttacaaggcatacacaaaggccaaaaacacaatgtcaagagcagagcaagcattagaaccaggcatgacagagatgtcagaattatgagacagggaatttaaaagaactaggataagatgctaagggctcaaatggataaaggagacagcaggtaagaacaggtgggcaatgcaagcagagagatggaaatcccaaggagggggaaaaaaactgtgagagatgaaaactactgtaacagaaatgcagactgcctttgatgggctattaggagactggacatggatgaggatctatcaacagaaacctctgctggcactcagaaaacaataccccaaaatgaaggcctcagaaacaaaagttttttgggtcttgttttatgtccttgagagcttgaactgtgaccaagtgggagcactctttggtctccaccattgggggaggtacgattttcggatcaggtcgggtggccggtctgaagacaggaacccaagactttttgttctgcatacgtcaagcgctcgggagtttgtcttaataagaggtcccacgtgtaaggggcttttgtcatctcaactcctgctgcctggttagtctgtgtcaacaagagtctttgctgattgagctcattcctgacagtaaatgttttgtgggaggtatctttggaattgcttcttctatgtcctctccaggatctatcctggactttatacaccactgaaaattctaaatgtcaatggccaaaagatggatcctttaaattagaattgtaaatttaaaaaaggattttagaaatctcatcctaaacaactgataaaaacatcaagagcaaaaagggtgcttggcatcactaaccactaggaaatgcaagccaatttctagaaagacccaacaatgctatggttagccttaaaaattctctttaaaattaaagagcaaaaatctgacctgaaacaaaattaaaaattttttaagcttaaactcctactttggatccccctgttggttaacaatgagggctcctctatattcttgtaggcccacagttaaaattccaggctttccctgcggtggcctattagacacacagcccaatgcaacagaagagagggccgagaaagaaatccttgcatacatggccaattgttttttttaacaggcgtgccacgatcgttctatagagaaagggcagtcttttcaataaatagtgcaaggacaactggatatccacatgcaaaaacaaagttggatccatactttataccatatacaaaaattaactcaaaatgatcaaagatctaaatgtaagacccgaaatgataaaactcagacgaaaacacagacaaaaccttcattataataaattcaacaatgttatcttagatatgacaccaaaggcataggcagcccaacaaaaaataaacaaactgaacattatgaacattttaaattttgtacatcaaaagacactttgaataaaataaaaaggcaacccatataatggaagaaaataattgtgattgatgtatctgatcagggattaatacacagaatatattgagaactcctaaagacattaacaaaaacctgattcaaaaataggcaaaggatttgaatagacatttatccaaagaagacaaatggccaataagaacaaaaagggtgcttggcatcactaaccattagggaaatgcaagccaaaactacaaagatatacccactagaatgactactatcaaaaaaatcagaaaataggctgggcgcagtggctcatgcctgtaatcacagcactttggcaggccgaggcagacagatcacctgaggtcaggagttcgaacccagcctggacaacatggttgaaccctgtctctacaaaaaatacaaaagttagctgggtgtggtggctcacgcctgtaatcccagcactttgggaggctgagatgggcagaggtcaggagtttgagaccagactggccaacatggtgaaaccccgtatctactaaaaatacaaaatttagctgggcgtggtggctcacacctgtaatctaggctacttgggaggctgaggcaggagaattgcttgaacccgggaggtggacgttgtagtgagctgagattgctccagtgcactccagcctgggcaacagaattattccatttcaaaaaaaaaaaaaaatcagaaaataacaagtattggcaaggatttaataaaactggaacccttgtacactgatggtgggaatgtaaaatactatggcctgtatggaaaactgtatggtgattccaccaaaaaaagttaaacataagaattaccatatgatccagaaattctacttctggaaggcagttcagcagctttctacagaactaaacatactctgaccttatgatccagcaatcacactcctgggtatttacccaaaggagttaaaaacttccttccgtacaaaaacctgcacatgaatgctaacagcatctttatttgtaattgccaaaacctggaaacaaccaagatgtccttcagtaggtgaatgactaagtaatttgtagtatgtccagacaatggaatgttattcagtgctaaaaagaaatgagttatcaagccttgaagacatggaggaagcttaaatgtacgttactaaatgaaagaaacctatctaagaaggctacatcctgcaggattccaaccctatgacattctggaaaaggtaaaactatggagacagtgaaaaaaccaatggatgctaggggttggggggagggaggggtgagtaggcagaacacagatgacttttagggcagggaaactactctctctgatgctacaatggagggtacatgtcattatacatttctccaaacccacagaacgtacaacaccaagagtgagccctcatgtaaactgtagactccaggtaataatgatgtgccaatataggatcatcaattatacaaaggcaccctctggtgagggagtgtgaatagtgaagaaggccatgcatgtgtgggggtgggggggaggggagtatatgggagatctctataccttccactaaaactcgctgtgaacctgaaagtgctctaaaaaaaacagtcttttttttaaaaaggatgtttgatagcattagtccttagggaaacataaattaaagccacagtaagattctactgtctcccttttacagcagctaaaattaaagactgaccctgaggtcataagggtcataaggatgtggtgctttaatccaccactggttgagaatagaaaatggtaccaccactttggaaaactgccttaccatttcttaaaaggataaacatgcctaccagatgatccagctactccattcctaggtattttacccaagagaaatgaaaacatatgtttatatgaaatcttgctgacaaatgttcacttttatgaacactttttattggcaaagccacattttgaaaacaatcccaaaatccatgaataggggaatagaaaaacaaactgtgatctatccatatcatgaatacttctcagcaataaaaataaatgattaattcatgttacaacatgaatcagtctcaaaaatagtaacctaagtcagacaaaaacagtacacactgtcaaattctatcacacgtctgttgtccagcaacttgtggggctgatgcacatctcttgggcccaggagttccatctttttttttaaagagaaaaaaaatctacgaaacgcaaactgacatatagtgatagaaaacagaccactgggccgggcatgaaggcttacacctgtaatcccagcactttgggaggccgaggtgggcgggtcatgaggtcgggagatcaagaccatcctggctaacacggtgaaaccccgtctctactaaaaatacaaacaattagccgggtgtggtggtgggcacctgtagtcccagctactggggaggctgaggcaggagaatggcgtgaacccgggaggcggaggttgcagtgagccgagatcacgccactgcattccagcctgggtgacacagcaagactccatctcaaaaagaaaaaaacagaccaccggttccacggagaaaggagagggcacaggaagctcttcctggtgtttgggatgttcgtgatcttgattgtgctgaggattttacaggtacagaacaacttatcaaactgggtggacaaagcaaagaggaatgaaagaggcaacacattaataatgtattatttcctcaattgtctgtaagctacagaaaatctggggtatacctgaagtatatgatgtttattgtacatcggttatgcctcactaatgctttataggagtgagagagggagtaggtggaggcagatgaaggaggaagacaaagcagaaggtattctttttcttctttttgaaaatagttttaaataccccttttaaaaagaatcaccttttgaaattaaactttccagaatatactttaacatgttgttatttcacttttgataatgttccctatcttctatcttcagatagattttaacatgttatttcacttttggtaacgttatctatctcctgtcttcaggcagattttcacaagttatttcactgttgataacattacccatcttccatcctcaagacagatcttcacatctgtctacctcctatctatcttccatcttctgtataaattctgaccccagttcaagattaggtcatttcaatttagtctgaaacttaaattgtttattttgaaccattttacttcctaccattaggattctcactccctcaatgtataatgcctttttatcttttgtaaaaatctgttttaatgatgagcattcctttcctttgccatcttaaattcaatggactctaacatgactccagtttatcccaatgttctgccattcccaagtcactaaccagttactggtgaattaacaagggggatgtaatcaaattacattgctgaatactggccttcctcagatttagaaaactgctcatgtagacgggaaattcactttatgcaaattcaagatggcaaatttatatttacaagaaacaagcatggcttaatttttgtacctttataaatacttgattcattttaccaaacaattatttaaagcaataagctccactgaagttaaaaaaaaaaaaaaaaaaaaaaaaacaaccgtcacagaacatctacacattttccctcttaagtgacagtttctgactttgacagtcttaagccaatgaagtcattctgcatggctgtgccttacagcatcgaggtctggcctctccagccctgcccagtgcattccctggtcactgggataacgaaaagcccatggcaagtggggtgggggaggggacagggactggttaagaacaattgtggtaataaaaatgaaaacatgagaggccgaggcgggcagatcacaaggtcaggagatcgagaccatcctggctaacatggtgaaaccccatctttactaaaaatacaaaaaattagccgggcgtggtggcagacgcctgtagtcccagctactcaggaggctgaggtaggagaatggcatgaactcagtaggcggagcttgcagtgagccgatgtctcaccactgcactccaggctgggtgacagtgagactccgtctcaaaaaaaaaaaatgaaaacatgaaaaagttcctgcatttccagtaacgtgtggtacactccataactgggcctgaacatctcctttcccacctactctcttcctttccgttttttagccactactacatactaaggtacttacaaccctacatgagaacaacagagattctatccagatggtcttacatttgctttcctccaagccattctttcacactcctgcaaaatttaccttccccaaacaacttattttcttcatgtcactcatttcctcatcaacaggaaagaagttcaaatgtgaatggcttctaagacttgcaaatggggcctcaattgcccctacctacaataccacagcattccctctctatccccctccctttacccaaactgtcttactctcaaatccaacattaacgttccacctctgcacttttactgacacttcgcactactaaataggtttcatttttttttttttttgagatggagtctcgctctgtcgcccaggctggagtgcagtggcacgatctcggctcactgcaagctccgcctccaggttcacgccattctcctgcctcagcctcccaaatagctgggactacaggcgcccgccaccacgcccagctgattttttttgtattttttttttagtagagacggggttttaccgtgttagccaggatggtcttgatctcctgacctcgtgatctgcccgcctcggcctcccgaagtgctgggatgacaggcgtgagcccccgcgcccggcccaggtttcatcttttgagaccttacattcctccatggcacctccctaaccagggcctctcatcttctctgcatccacataagggtgagtttaaagtagaattaaaagcaggcaaagaaagacccattgtgtagagaatgttaatactctaaataaaaaaaataaataaagcagcccatattccctgggaaaatgcacccataagatatgtttacctgtctcgctattttcaggcagagagtcatattctgagggacccagagcgagagcgttcatgtctgctgggtccgactcctgcgggtctggcaatgcggcattctcatggccctggtcaccatcaccattggcatccgatcctacaattaggagtttaccccaaaaaggcagggttagaagcataactttctcttaaaacaaagcttacacttgcagtgactcaacttctttagactgtaaaagacctctgggctctcaagcactgccacataccatgacacagttatgaatgaacaacatcttaaagacagattaaaatggcaacaaaagcacaggcctgaaagcagggggctgcacaccacggccatgctcaacttaccctgcgggccacggtctgcgtggtggccagccacctcctcccatgcagcactcacaccgtcagcagcactgcttgcttccagatgtaacacaggagccccccacacttctgcattagggttcagctctgaaaccttagttgctggtacctaggaagaaatgtaagatagacatttgtatccaaatgtcaaccaaatacaattttactcattaatgcagagttaagagacatcagatataggctccaaaggctcagcctatgtatttatacacacctttggaatgaaatcaggttcaaaattaaaaaaaaaaaaaaagcagtcagaattccattaaattccccccaagttttaagttcctcctcccaagaccaaggcttgcagagatggggaaggacacgcctgccaccaaaagattcagtgtttcacaaactatacctgaggaatagctggtgacttcctagactcctaataaaatcacaattcagggttttacaaacttgaatacaaggcagatgaataaaattctaattagaaagcttaaacaagtcagcagggcgcggcggctcacacctgtaatcccagcactttgggaggccaaggcgggcggatcacctgaggccaggagttcatgaccagcttggccaacatggagaaaccttgtctctactaaaaatacaaaattagccgggcgtggtggcgcatgcctgtaatcccagctactcgagaggctgaggcaggagaatcacttgaacccaggaggcgggggttgcagtaagctgagatcgcaccactgcacccaacctgggggacagagcagaactccatctctaaaacaaaagaaagaaagaaagcttcaaaaagtcacataaacaaaaggtgtagaagatgaaaattgctcctaagaatgaaggtgttctaacaggtctgtcagggatactacaggataagaaagctcaggcatcctttgaggaagaagataaaatatctcatatttttcacagaactacctgttcccattcccaatagagcttcagtatcaccttgaaagaaaatccacaggtgaccatgaagctgctagtccagtgttctggacaacggactctcagatcactggggctgaggccaaagctgccatggacagctgtggaacatgggctaaacctcacctggaagacagcacaacaacatgatgcctggcacataccaagctcatcggccatcatgacagtcacgcatgctcagttagtcccacagggcagtcctctactcaaaaccctcccgcatcagcttggctcatttggagtaaaagacgaagttcccactgcagccacagcgccctcctgtgctcactgctccctggccttgtccatttccaggcacactgacctccttgctgtctctgggcacactggcacttttgctcttcccgtccgtctgtccagaacatcctgcccagagactggggactggtggtccttcctgacacagcgaataaacccacaaaagtcccccaccatgtggatactccctactcccctgatttttctgatacaagcctttcttatgcttacacaagcactccccaaagcctaaagaaaagtcaaatgtccaaacacacaatccttcaacaaacttacacatgatttgccttttcaaatgtgccacccaccttcacaccacagtgcaggaagtcaaagcttctggaggaagggacaggtccctggtccccggtgccccttggaatcaggctgcaagctgggagcagttacactgcactaccccagcatgcagcatagacacaccagtttctgcggcccagaacacaggagaagggctggaaaggaccaccatgagccgtcaaataaacgatgggtgcattaacaatttttaaaagacagaataaatccacattggctcaggtgatggggctggtagtaaaaaacatgaaactatttctgaaactgagagaaggcagctgatgtggtttgttcgttcctgctcccccagtcactggagcaccaatgagcaccatgcccataaaaccaggtgtttaaatgagtatctatctggaattctttttagtttttgttttaagtactggtgatagggcaaattattgggttccttcaagaatattataatcaagaagcaccaattcttcaattttccttcttgcattgcatctaaacttcatttttggcctctgcttctgcatagtgttacttgccctcttctctctcatccacccatctgtccaacaagtgcctctgacatgttcaccagcatgcttgtgccaggcacggcactgagctggcaggtgtgatggtgaaggaagcagacaggagctcatggagctacatgagggggcaggagacagccacaggtcacccacaacactgcctctggcagcgtttacgccgctccacctgatctgttgtctttgtaaattcatttctctattctctttcccactctaatacttccatacatcacctttcctaattagacccagtctgttttcaccaccaccacacaatccagttttccagcctcggttccattccatccacttagctggctcccctcagctcatgcacatactacacgtgctttaaattcccaacactaactaacagtaaccttctctattattagtaccttttgcagttgactgtcctatagtaccaaaatacattttgtggtttattaatacagaccaacagcactttgaaagcagtgacagcatggctgttggggctcccgtggccctcgtgttcctcctattccagggtggcagtcaccatgggcattttcctcactgtagtactgctgatagccagcacagtcctgaattcagtagggaggtgctcaagatatatgaggaatgaatcaatgtttaataaataacataaatttatattttccactatttgacaacttctgcaaggttttatgccacaaatgactaggactctacccttaaccaatgactacctcttagtgaagaagtccaaatcaagtgtatgcagttaggaaatgttcaatcaatgctgtgactgaagagatgtcaccaggaatgaaagaatgaagatgtcttttaaggcttaatgacattcaaggatctaccacgtgctgagcacattctacgcacttccttgtactgaatcagaacaagtcttggaggtcgttattcactggactcatttcacaaatgaaaaaaccaaggcagagaaaggtagagtaacttccccataaaaacgatggtaattagaaagttagattctaagcaattgcgttcagcaaaattcaacactcatcaagagttcattaacttataatttatgagaaatagtttgtattaaacaaagatctgaatctcctactatttctataaaatatggttattctcttgcagtaatatggaactctaaatggttatcaagaactccagcgtcggccgggtgtggtggcttatgcctgcgatcccagcatgttgggaggccaagatgggcagatcacttgtggtcaggagttcaagtccagcctggccaacatggtgaaaccccgtctctactgaaaatacaaaagttagctgggtgtggtggcacacacctgtaatcccagctacttgggaggctgaggcaggagaatcatttgaactcaggaggcggaggttgcagtgagctgagatagtaccactgccctccagcctgggtgacagagcaagactccatccttgaaaaaaaaaaaaaaaaaaaaaaaactccagtgtcgtctgcttgactataagtcttatttttccattaaaaatgtatggctaagcaatggttattaaaaccacaggcaagctgaccttaacagccacattccaaagtgaacatgcctgagttctgatgctttaaataaacccttccaccccaccccatcctgtgcgaaacaatatgctccactttgaaaaataacgtatcaattaataagcttgtataactaccgatacgagacagaacagtctctctgacaagttactgactaggaactggagtaattaatgctggagaagggggactggccggtgaggtacagaaagcaggtgagaaataggggaaagaaacattccatgcaagcaccaaccactcctacagatgcactaaaaagcttagtaattcagggcaatttgctgacttcagaaccatacaaggctctacctccagttctttgtgaaatggagtaatagctgctatattaagatttgcttaaaaaaaaaaaaaaaaaaagacacctgtaacagcactttgaaaattgaagctctgaaaggcaaggcaccatcgttaaacgtggtaacgcttcgtatgagaatactgtttgggaatacctcataatggaaaagctaatttaaaactggaagcacacctctcacttaggcatcatttatgctctttgttgatgtctgaggcagtgacactggtaactaactgaaaattatgtcacttctgtaaaagattaactgcagattatcttaaagatgtagttttatactgttttgcctccacaactatttaaggagcaaaactaatgaatttgaacataactctctccagaaaaactcccagtgtgggcacggaaataaaagaggttgatggatcattccttacactacagaaggggatttctacttgtttatttccatatagtaagtgttgacatttgagccatctctacctccttaatatcaatacttttccttgcttcattgcccacaaaaatcatgaataaaccactggttgaataatgagatcttgctactctgagtatgtgctttcaatcacactgcttcgataaatgtctgttttgtggaagaaaactaatttcctgttgttgaatgatgttgacatttattacagaatttctggaaagatgctcaaattagctgcccatagagtcatttgctaagcttcttccaaaccagagggacagccttatctcggggttctgaaaaagaaagagctccacagtaattctaactgcaagaagacagaaccaagatttcataggcagttaaaagcagcaaattctacctgcctcagacacatacaaagatataaggaagcacagatttttaggtaagtttgtcttctgcagtgtgacttataccttcaatgggctcacatgcttatcgaatcaactacactgcccacgagataagatgccctcaaagggctctgacaacactgcggccaggaagacagaagagctggcaaaattcacagacagaaaaaagtcaacacagagctcagggcatgctttagtgctaacaagagtttgcacacaacctctggcttaagtacaccaaacaagaattcatattctccaatttggaaatcattaatgttatagtaattcacagccatatataagcattcaaataactacccactgtttagagtaaatctttattaattttaagttaaaaacaattaaaattggccagcccggtggctcatgcctgcaatgccagcactttgggaggctgaggcgggtggatctcctgaggtcaggagttcaaaaccggcctggccaacatggcgaaatcccatctctaaaaatacaaaaattagccaggtgtagtggcacatgcctgtaatcccaattactcgggaggctgagtcacgagaattacttgaacccggcaatcacttgaacttgggaggtggaggttgcagtgagctgagatcacgccactgcaacttgggtgacaaaagtgagactctgtctcaaaaaataaataataataataataataataataataataataataataataataaattaaaatgtatagcccagcataccgcagcacaatagtaaacacacagaaaacatacttacgaactgtccgtctctatcatgccatccccaaacaacaccgtcctctgacaccggtagctgaggagtgttttctgaaaacaaagcaatttccaaggcctgtggcttatggtgcagatcctcactaaatattgtttcaccttctagagcaccttttgtgactgtattagtccagagatagcccatttgatatccaccacaaccactggccagtctttcagaaaatgctgggtttcctaaccctcccatcgggtaataggaaaattcactcaaaaaacgggagactccttctgggaaactctgccaatccacttttgagggatgttcacatctatttaggacaccttctgtgagtgataaaatgtggccactacttggtacaatcgtgtctttgctgtccacggggacagcgggaatcccctgcgctgcatcgcagggggcacctgtgtatctgtccgctagggtgggatcaacaccaaccagaaagaaattgccactgggagtgtcacgtgactctattttctcaaaactcaccttagcatttcccataaaacccatttcaccatttaaagtcgactgtgtaagagtggacttggcgtttccttctttgaaatggtgtgcacgttcactcgtcccacatggacccaggcagtcagtaattctggggtcaatactatctttctccaaataaagtctctcttcctcttctttacatgttagttttggtttactcaaccctgatgtattattaccaaagataccagaagcttcttcaattgattcagaggaaattcccttccattttgggcttttaccaccactaacagaattctctactatttctgacttctgtataactggattaacacttggactgaaatgtggtaacacactaagaacattatatttgcagtcgtatactcggtgtgtttcataacttttttctatttgattagtttcaaaatcagcgttctctgttgcactagaactaacacaggagagtacatcctgacttggcactgcctcatgtctttgtgtacctgtttcccactcataggttgttttagaatctgacttgacagtctctatgtcatcttcacttgtctcactatactttgcttgcagtgattctttttcactaccttctaacctttgagggtcactcagctggtctcgtgacacactgactgaactcttcacacatatttcaccctctgttttgtcacctgggcttgtttccctctcttcttcctctgtgcaggtgaaaataaatgcggaggaaacacagttactgtgaagagatctggagtgactgggagacttgccatcggggggcactccttgtgccatgctaagctttaggccatctgtcctctgcaccgtcccctgcgtgtccaccacacgctccacacaagtttggtcacaggtctgtgttgcagcctcatctgcttgacaccaagattttgactcaaaagcccttacaccatgaccctcagccttccaaacgccaattctgtcctcttcttggtaaaaggcactattttcagattgcagagacacctcacctctgtctggcagcaggggacttctggcctccaggctgcagtcccctctgcgctgtgccttcctgacttgtctggggacaggttccggctcccagcagtcatcaagctggcttggggctgcttctcttgaattagcgtgacctgagagacacccacttccaaatcttactgcagtgataggcctcttaggacttaaatcaattctatctagaccaacaggaaggatactatctgctttgttaacgtccaagtagaaatcatcgttgtctcttagtggtgtgatagagttattttctctctcctttttagaatgtaaactctggtcgacaacaactgttaccacctccgggtcatcactccctgcaacacatgcagtgtcagtacaaaagctaccaggtgaatgtgcagtgtcagtacggaagccaccaggtggatgatccatctcacttcctactcctgagttacagctctcactttctcccaggacacacgcatgacttagtgagtcactgtccatgttgttatttaattcagggagtaggtcaataccatgtagtgcactactttctgcgtaatttttagggaattcagtgcaagcttctgcctgtaaagcctccatctgcacgttatcagtgtttgcttcacaaggtgcatggctgaacgccacaggctcagggcaaggcttggctttcccactgcattcccctgtcctttcacctggacccagcgtgtcccaaggcgagagttcttcctgccgtggctctggctcgcccgcccctgacatggcacgcgaggctgaaggcactgaagagcaacactctcctcttgcagctactgtgtctacccaggtgcccagctcctctgccacgcttgggcaggcagagtcggcaacacaaatgctgtgaaacttgcactctcctgaatcctgacattgctgatcatcaataccaacagggtttccatctttcctctccctatcggataggtctaaagacttactctcatcaccactgctgaggtgaacgctgaccaccatttctttctctactaaagagtttttacaagtagctgggtaacagtgcagatggccactcacaaaggcttcctcctgcaggcctcggtcagaaggcaccagcacacatgagaaaagctcctcatcttcccaacaaccttgtcggctgccgttacccacacacagtagatcacagaccccctcagaattctgctcattaacaacaatatctgaattcttgtcattctcacccaagttttcataccttgttgagaatgtatatataaaagaggaaagagggttcaatgactgcttgggtctatgaccctgtttgtgcccagaccctgcgaaaatccttgtccgcgcgctaacgccagctacactgctggctccactgccagtacggtgaacctcctcacctttgacggtatcaaataatgaagacaaagttttacttatcttgttttctggttccttttcctccacagatttttgtaacaggccagttttttcactgtcattgtcactacttagttctctgctgaagcagcagcccatgtttgagagctcacaagcacacgacaggcgtgctggtcccaagcctccacagacgcacctcacagtaacttgctataatttctgaggagaagccaacacccagagaccaaaaataaccccttgcacagcggtcacatgttcctgccactcaaacccaaatcctaatgacaacagagcccgactgacagccagcatactccgtgtgcccaattccaaacaggaccaggatccaaaagctcagaacagcagcaagaatgctgcgctgtattttttcttactctcataaactcaataaaacataacttaaaatattatcccagccagaaagatttcaggcttctggtttttctacagtgttccagtatttcccaaattatatttcatgggatggtggtaactaaataaaatagttcataaattcccccaaaggaaaacagtatcagaattttgttccgtaaaatatatagctactcacagttgtatctaattttctagctttacgaaatgatgtctgaaataaatagcaatttaaaaagagacgaaaaaatcaaaggagagcaaaaaaataaatagcaataaaaaatagtatctgtaggtatcaagaaattattactaattgtgtcaggtgtgaaaatggaatgatgtcagttagagatgcatgctgaagtatctgggataaagtgacacattatctacaatttgctttaaaatgccctagcaaatatagtaaatatatacacacatatataaaagttaaaacagtcatgtgcatacagggaggaaaagatttaaagacagtagtccaggccggacgtggtggctcatgcctgtaatcccagcactttgggaggccgaggtgggtggatcaccagaggtcaggagtttcaagaccagcctggccaacatggtgaaaacccgtctctactaaaaatacaaaaaattagctgagcatgggagtgtgtgcctgtagttccagctactcggaaggctgaggcaggagaatcacttgaacccaggtggcagaggttgcagtgagccaagattgcgccactgcactccagcctgggtgacaagagtgagactccatctcaaacaaaacaaaacaaaacaaaacagtagtcgaatgtggcgatgggtaatgttcaagttaatgatgctgcatttggttcatggtattattcgctccacttctgcagatgtctgagcactccaattaagaaaaaggaaggaacaagaaaaaaaagggaaaatagatctacaagctctggtaccagaactagaaagtctcttgaaagtacttgatgcaggaacgcacagcctgccatctggtgaaaaacaggcgttgtccacaactaaacaagttgctcatgtactatgtggtccagtccctaactgtggactcacataatgggtcttgtcttacattgacatctgtgatgttttgcttttagtataagtaattctttttcttattatggttctgacaggctatgtgaaaaacaaaataattcttttagttcctctgcaagagagattttgttgtttctttaacctatgagttatgactggtgtcctattaatgttttactttttaaaaatattaacatttttatgataaaaagtttaggaattacacttaaacataaaggtaacaagaacacttatgaatatactaaaattcaagtactgaaatcatcataatgattatgatgataatggtagtcaacactttatatagcactatgtttcacaaaatattaattacatctatgcatccattttgtcacacgtcttaatttgcacccttaacaacccccaaggtagatactactaattcactgtacagataagggaaatgaggcaccaagaactttagtagcagcttcgaatgacaaaacaaaactcagaccatacattgaccatactgttatgctactcaaagagaattaaacatctacatggcaaaaacgttctgcactaaagacacaaacgattcataccagctgtaaaatgaaaggacatagtaaagcagagaagctcacgagatcacctgcctggctttgagtctcagctccatttttacatgtgtcatctctggcaaattatttaacctctttgtctcagttttctcatttgtaaaatggagccaacaccgacatctatttcaaagagctgttaggcagactttaagtagttggaatagaatctcagagtcccacttcaaagtcccccataatctggccccagcctacctctatgatctcggcttctaagataccattcccccgacctcttctatctcatactaaccaatgccagcacactgcctcaatgttgtttctttctccagtctcctccccacacttttcaagccttgaagtcctttgtgaaaccattctgtgctgctctaacagaatacctgagatggggcaatttataaagaacagagattatttcacacaattctggaggctgagagtctcaagtcgagaggctgcttctggagaggcctttgtgctgcaccatcacacatgtgaggaaatgcagtcactcccaccacaatggcactcatccactcctccacttgtgagggcagagcctggtgtccttatcaccccttagaaggccctacctcccaatgctgctgcacggcggactgattttccaacacatgaactttgggggacacatgaaaaacacagcattccattccagctcccacaattcatgtccttcttataatgcaaaaaatactcattccatcccaatacctccaatagtcttaactcatttcagcatcaacttaaaagtccagagtctcatctgaatcagatagggtgagactcaaggcacaattcaccccaagatcaattcctctccagccctgagtgttgaaagtaacaagttatgtgtttccaaaatacaatggtgggacaggcacacacacaaaaaaattcccgaccaggtgcgatggctcacgcctgtaatcccaacacttagggaggccaaagcaggcggatcacctgagatcaaaagttcgagaccagcctgaccaacatggagaaaccccgtctctactaatacaaaaaattagccgggtgtggtggtgcatgcctgtaatcccagctacttgagaggctgaggcaggagaatcgcttgaacccagcgggtcagaggctgcagtgagcagatatcacaccatcgcactccagcctgggcaacaagagcaaaactccgtctcagaaaaaagaaaagaaaaaaaaatctatttccaaaagggagaaataggcaagaagaagcaagaggtcccaagttcaagacccaacagggcagacaatattaaatattaagcctctctggagaatcatctcctttgactccatgtcccaaccctctgggcacagtggaacagggttggctccccagggcctcaagcagccccacccgatggctttgctgggctcagtccacccagcagctgtcaggggttggagtctcctgcccacagctctcccaggctgatgctgcaagctggcagctccacagtttaaggctcccaggccactcccatgactctactaggcaatgccctggtgggggcttctctgcagcaggttcaactccaaatttctgcttgccattgcccgagtacaggctctctgcagtggctctgctcctgtgacaagtctctgcctgggcccccaggctgtccatgacatctcttgaaatctaggtggaggctgccccacagctctagcattcttcttgcctgaaaaatcagcaccacatggatgccaccaaggtttatgacttgtaccttctggagccgcagctcaagccaccactgggcccactcaagcagcagctgaggtgactaaggagcaatgcacaggatgtggggagcagaggtccgaggcggctctgggcagcaagcctgtggagggcccccagtgctcatctaccaaaacccttctgccctcctagagggcaaatgtgatgggcctgtgatgggggaacagccttaaagatatctgaaatagcctcgccaacacagcaagaccccatctctacaaataaaaattaaaagttagctgggtgtgggggcgcgtgtctgtagtaccagctacttgggaggctgaggtaggaggataacttgagtccaaaagttcaaggctgcagtgagctattactgttctactgcactccagcctgggtgacagagcaagaccctgtctctaaaaaaacaaacaattctgaaaagcctttcagatggctgaaagagctgagtgttttaaattatttccttctggtttctctttttaaatgaaataacggtgccaaatacaaagtatttcctcttgagtttggactctgaagccagattgcctgggttcaaatcctggttctaccactttttagtccagtaatcttggggataaattacttaaacctctttgtgtctcagtttcctcatttgtaaaatggggataacagtacctaggggtaagacaggtgtagggctaacaggaatttatgagtaaacggaagtgttaggagagtgcacagtaagagccatgagagtctgcagtgattaccaccatatgtgatatattcttttacactggagacatttatggagcacctacctgtcaggaagacactggaatacatcagtaaacaaaactaaaccccagatttgatggagcttgcattctagtccagggagacaaacactaaatctaacaaatacctaacattgttagaaggtgctaactgctacacgtaaagggtctgaggcaagccagaagtgaggagacggatgcggatagatggggctcgctgagaaggtgaggccgagactgagaaaggtaagagcataagcctcaaagacttctgggaaaggggcacaccagaaccaattgaggcagagagccctgcggtaaggtgatgctggaatggtcaagggtcaagagcccactggggctggagcagcgtgccagaggagagccagtgggcagcagagtcagagaggacaggtgccagactacgaaggctagggacctgccagaactcaggctaactgtgatgttgagcacaggagtggcaggttctgacttggccttctcgaagggatcctctggccactgtgttagaaaggaagggtgggttggggacaccagtgaggagtgactgcagctgtccaggtgagaagcactggctccatgagatgagaagtccaaacaaaaaatgaagcagcctgaccatctcagaaactctgacacccctgcgtgactcatgtatctcatctacacaagttccctgatttgaagatacacgtttctcctactttcacaatttctataattgtgacatgtcttcgaattgctgccaaaactgaaaattgctgtttcaggatctggcagtggattacctacgtgtgtttattttgcagaaatacactgagttgtacttttacgatctgtgcacatagctgtatgtgttgtatttccacacacatgtaaggacaccggggcctaggaaggcagccagttgccaggcagcggactccgacacatctgtcgcttcctcccagtgatgtgactattctctcagtacaactgtttgcatggtactgccacacaaagttgatttataaatctactattgaacaaaatgccttaatagcaattaaactgaatcctaaaatgaaaaagagtttgcaaaaaaactatttgtcatattctaaatgatgcaaatactaagcaataaaattactaatttttttaaagaaattacaaaatgttctaagttgagagatgtttttactgatcccagtgccttgaaagactactattacatctgtcacacttccacaacaagagaagttttagcagcatgtaaatcatttacacaaggatacaactaagaatagtaagccaaacagagaatgaagaaatccctctatttttaaatatgccttggagctgaaaagatcacgggtatgtgttatagaaggcattccttctgtcagtggccaaaatgctacaatcaaaatgttacaatactatgtcatcaaaaagaaatatcctacattaaaaaggatctactccgtctcagcacgaatacattctaagaggaaaagagggcatctggtcagagtatcccccatcctggggcaagttctccgaagtaccaggagaccaagaaccgtgcatacactctgggggtaaatggattgttttgtcactaaatcatgctgaggtaaaggcagctttacacttcctgacatagtaacaaacatatttctaagacaggaaactgtatcaacatccttaaggaaagttcttaggtcttttgtttttatttttttagagacagggtctccctctgtcacccaggctggagtgcagtggtgcaatcacagctcactgcagcctcgacctgctgggctcaagcaatcctcccccatcagccacctgagtagctgagacagcaggcacacaccaccatgcctgttcttttttgctttgtagatatggggtcttgaactgggctcaagaaatcctcccgccttggcctcccaaagtgctgggatttataggtgtgagccactacatccggccaagtcttttcttttcttttttttgagacagagtttcgctcttgttgcccaggctggagtgcaatggcactatctcggctcaatgcaacctccgcctcccgggttcaagcgattctcctgtctcagcctcctgagtagctgggattacaggcgtgcaccaccacacccagctaatttttgtatttttagtagagacggggtttcatcatattggtcaggctggtctcgaactcctgacctcaggtgatccgcccgcctcagcctcccaaagtgctgggattacagacatgagccaccgcacctggcccaagtctgttcttaaaacagactgacaaggtggtaacaacctgccaaaaggtctaacctgcaagattaacataccaagagcagccacgtgtcacttgcgtacaaatacaggagttggatattttcatagaaattcaagctttctgattgctaagcctactcttattcaaaatataggcctgcaataattaatctgaattgctaattaatagttattcattcagaagctgtgtcatcaaaaggcaaaggtggttttttgaaaactgataaaggaagggactaaagttttttggtattaccatctgtaaaggagtttaaaaaaaaaaattctgggccgggtgcagtggctcaagcctgtaatcccaacaccttgggaggccaaggcgggcagatcacttgaggccagagttcgagaccagcttgggcaacatggcgaaaccccatctctacgaaaaatacaaaaattagccaagcatggtggtgcatgcctgtaattccagctactcagaaggctgaggcacaagaatagcttgaacccgggaggcagaggctgcagtgagcagagatcgcactactgcactatagccagcctgagtaacagagtgaggctgactcaaaaaaaaaaaaatcattctgatatagatgttttgctgaattgtacatagagtttagtatgaggatgagttagatttccaatttcagatttccagtttcacactatgattagaaaagacttgctgtgactttgcatctttcttctgaggaggtaatttaacataaacacttctacctaatattacctgtcccttaaacatcatcattcactcacattcctctctcaaacctgctgttgatttatgataaaacacaagaggatcatttcaacagaaaatggtttccaggctgatgtagtgtctccaagggaaaagcaggtacttggctggtcgcacacaggagtaagaactggagtccctgagtgggcttcaggaggggcaaaaagccgctgagaatgatgtttgctatagatgaagtttgtggcgctaacagggaaggtaaagaacctttaaccaaacgacactgttgctgaataccagtggtcagatattttttcttcctcaagaaggagaacccatcgctgtggcccactgccagtggtcactcttcatcataaacaccctcaaaaccctttcaatcccctctcgccttctatcaccttaccttcaaagccaagatcttaggaggaatgtcaccgtctaagttgtgtctaccactcctgtctctcacccactgcaatctggcttttgctcctatcagtcctgggaaatactcttgctaaggtcacaactgacccctcgctttgttaccttactacacttcacttgagtcagcctccctgcctctatctccaccccacactgtcctctggttttcctcccatccctctgaccactccgcgtcctagattccttcctgtttctgatatattgagggaatcgagagtttcatcactgtccctgcctggaactcaggtaaacttaatgcaaagtactgtaatcataactattggtacgatatacttcaaaatcagtagatccttatgacctcaaggtgagaacattcaaaatgaccttgcttgactaggggcaagataaagagtgcttcttctagactcacctacgtctcagtgcctcccacctccaggtgtacgctcatcttgtacctaaggctcacacacaatgtgatcatgcaatcttgcatgctgtgttagggctcctcgaagacgtgtatctcacgctcatctgaacaacctctccatagaaaatgtcttagccatcatgatcacttgcactcagttttgatgaatggatggatactcaaattttatgcaggcagtactagctgcttgcctaccagacacaatgcattgagctggccacagaagggaacagaatgtggagacacagagcatgtttgtgcctgcccaaggatgctcccatccttagagacagggcctaactataagtgggcctgggggtgggctgggggtttaatggggtaatgtaaaagttctaagactacattatggtgatgattacacaactcagtaaatctactaaaaataattcaattgcatactttaaatgggtgagttttacagaatgtaaattatactttaataaagtttttttttttaatgaacagaacacagtaccagaagtttacagtttagtggagaaaacatgtacacaaatttgagtaattctgacaatcatgtcactcattataatatattgttctcatactaaatagggaaaccatttttttttttttctgagacagagtttcactctgctgcctaggctggagtgtggtggcacaatctcggctcactacaagctctgcctcccaggttaacgccattctcctgcctcagcctcccgagtagctgggactacaggcgtgtgccaccacacctggctaattttttgtatttttagtagggacggggtttcaccgtgttagccaggatggtctcgatctcagggaaaccatattcttacagtctaatagagatcacttttttgtgttctttggctaaccctgtaaatagttactagctcagtaagctttttggagagggcaggaagctgtctaataaatacaactaaatagtaccagtggataaatgcaaatctgctcctgaattattcatgtatttctttgggtatctctattgcacgtctcctcctactcaactctgacagaatggctaaactgtaaatagcctggttcctcaaccctgactgctaaatgtattcacttgcccatcataacaactggctgagcactgccacctaatcactaaaccaatgcaaactcctggtcaactatgaagcatgtaactctccacacctttaggtgcactatgaacaatgctaattagaaaacattcatagcaatgcctacaataggtttctaaagatgtctgaatattatgttggactgaaagtcaaccacggagagaacaggaacttgttgaagcaaacaaactcccttaaagatttatactcaagggatatctactttatgtcttatataattttcttcttagactaccaagcgtcttatatttggatatttttaaaaaatcaatgtgcaccgggcacggtggctcatgcctgtaatcccagcactttgggaggccgaggcaggcagatcacctgaggtcacaagttcaagaccagcctgaccgacatggtgaaaccatgtctctactgaaaacacaaaattatccaggtgtgatggcgcatgcctgtaatcccagctactcgggaggctgaggcaggagaatcccttgaacccaggaggcggaggttgcggtgaccaagatcgcaccattgcacaccagcctgggcaacaagagggaaactctgtttcaaaaaaataataataaaaaaataaattaaaaatcaatgtaaaacagaatacataaaaattttacataaataatatatttataaaatataataatttagaaggtgtcttttgtttttttaaaattcttctttgttacaagctggccaggcatggtggctcacgcctgtaatcctagccctttgggaggccaaggcgggaggatcactttgagttcagaagctcgagactagcctgggcaacacagtgagacctcgtctctatttgaaaaaaaaaacaattggattaacaatccaactcctcaattcctacgtgaactgcttataatggggggggaatagatgagatttatggtaatttttattttttacataaaatatttttactttttaaattttatgcaatttataagatcctttgatcaaactgaatttccagtagtagctctctgaagcactttatatatgcatatgcaaatgatgaaaggtaggatttaaaaaccaatgaattctacttccttattctttcattaatcacagctaaaatgtgaaacaaattttctgagtaaaagcttactattcaatttgtgtggtttaaggaacacaagctaccaaaatgtaaagctactcatccgcatataacagattatcaatgatacaataaaaattttgtaatatttgaaaataaattaatctaaatggtatgctgctgttggcagaactgcacacaaaacagacacgcacagaagctagaaaggacatacagtattgacagttaccatacccaggggttgtggtgatgaatggatcccctaccacaactttttgagaaatatctacattttctaatttttgttacaataaacatttttcttaaggaagtatctctgagccttgactgtgattaaaaaatctgtgattaatctcaaaattgaattacctgactcaaaggtgggatggaacttgtctgagaagtggtttgagatataggaccattcatctgtaaaattgaaaacaaagacaacatcagtacaatgtttaaaaagaaacaacatattttcaaaccacagtaattaggcaaaactaaacccaccaagaaatgcacatttcacatgacaaattcatgaattcataagatattcagaatgtaggaggcttaaaatttttaaattctgaatgaacatcatagataaagttctttgtagattcaatggggaaaactaagaaaagctactttgctcaaagccactttggaactttaaatattactgcttgacataaaatgtttaaatgaacaaaagtagtcaaaaaaatgtatattaaaatcctaactctttaaatacatcctactatagtgactataatgttattaaactatttacaaatcactacatatccttgatttaaaaaataaatggatttgagtatctagagctataacaattttgtttttgttatcatctactacttatagtttcctctactaagctacctctacatttttcagactgatggggctcaggactttctccccaaaaaatatggcacattgacatttgaggaaacagcagaatcaggccatggaaactagaaagaattctccttgccccttctcccttgaagcaggccataaaacacagctgacattcccctgaagacccttccagaggggccctgctctgtaccaggagcagtaacacacagggatgtcaagaaaaacctgaacacaacagccttgctaagcttctccagtttattagctctaggtcacatcccttttgtccaatcatgcttctccacaactgtcaacatctgcattagacttcgcaaaaaaaaaatacagttttccctgtttctttggttcttcctttgtggaggctcccatgtcacatacaacttattactaaataaatgtgtatgcttttctcttgttcatctgtcttttgttgcaggggtctcagccatgatcctcagatgggtaagaaatcttttctcccctacgagactctaatatctgtatgcagatcctaagatgtgccagtgttcctgtttagaactccttactaactccaatatagagtcctttatcaaaaaaagcaatggactccccaccaccccattcgacagcacccaccagatgagcgctgtccttgccctcctggactctctgcgtctgcggttcagccacaaccttagcgtcctgatcagaagtcatgggctccactgggagaagtgtaatgctaacctcaggatgct

SEQ ID NO: 1258 - DNA, 117888 bp, Homo sapiens
atcactgtagtagtagctggaaagagaaatctgtgactccaattagccagttcctgcagaccttgtgaggactagaggaagaatgctcctggctgttttgtactgcctgctgtggagtttccagacctccgctggccatttccctagagcctgtgtctcctctaagaacctgatggagaaggaatgctgtccaccgtggagcggggacaggagtccctgtggccagctttcaggcagaggttcctgtcagaatatccttctgtccaatgcaccacttgggcctcaatttcccttcacaggggtggatgaccgggagtcgtggccttccgtcttttataataggacctgccagtgctctggcaacttcatgggattcaactgtggaaactgcaagtttggcttttggggaccaaactgcacagagagacgactcttggtgagaagaaacatcttcgatttgagtgccccagagaaggacaaattttttgcctacctcactttagcaaagcataccatcagctcagactatgtcatccccatagggacctatggccaaatgaaaaatggatcaacacccatgtttaacgacatcaatatttatgacctctttgtctggatgcattattatgtgtcaatggatgcactgcttgggggatctgaaatctggagagacattgattttgcccatgaagcaccagcttttctgccttggcatagactcttcttgttgcggtgggaacaagaaatccagaagctgacaggagatgaaaacttcactattccatattgggactggcgggatgcagaaaagtgtgacatttgcacagatgagtacatgggaggtcagcaccccacaaatcctaacttactcagcccagcatcattcttctcctcttggcaggtaagatatgctagatatacgatgtcagagtagggaggaaccttaacaatcacttcttcaggcagggtataaacttctcacctgaacactcattgcagcccccatcaaggacagaaatggtgccctgttaagaactctcaatgtatcttgtatttttcctttatagcacactttagatatttgtgtaattatttgtttaatgacttctactaggtttctaaactgcaatgaacagagtacttgattcattattgcatttcccagaacatagtatggtgcctttaaaaatggcaatagtgcattatgtattttgtgaattgaataaatgagtgaatgaatgaatatctggatgattaaaaaaacaaatgatatacactaatgtctctgaaaaataaaattattattcacaacaggattcatatggtgtacaaattaaaaatgcaaattcctggccttatcccagactaattggtcagaatcttcaggagagagtcccgagaaggcacaatttactaaatgtctatggtgattcttttaatcaggaatgtttgggaaataattattggattagatcttcatttttgaaagtatgaagatcctgaggcttaaacaggtaaataatgaagatggctaatattcattgaacatctagcatgtgcaaaccccgtggcaagtgtttttgtgcattcgttcatttcatgctcttatcagtctttccctattttagaggttataaaggtatcaggtaacttgtataagatcatacagctaataagcagcaaaaaaaaaatcacatttattctctaatagtccagctgtatgaccactgtatcctatttccaaggatgtgactgctgtgatatctttagctaaaggatctggttcattctgtctcactttttctttaggctgcattagaagttagctttctttctcagtccttgaaaactttagataaaatatgaagcattactatttggaattgaattcctatttcatctattctgaatttttcattctgaattaggggcaaatggtaaccaaagaaatatgtgcttaattatttatcattttaaaaccatatgttaaaggaatgcttttctgcctgtcttccaaaaatttctaatacagcacttttgactagcaatgctctatgaaattaagcccaatatgtgaatgggatgggaagaatcttgcactcaatttcccacaatctgcagttttgaaatgtagatggccttctccgcccaaccaagtttgtaccccatcccaatggagtctactgaagttcatttaaaaaatagccactgtataatttctggtgttattagtcagctatttaccaaatgtaatgggttttgtgcaggaaaggctagaaaaaatgtgcttggaaaaaaatctatttcaataagctttcagacctcctaccttaatctataatgtgcaaactctcatctagctcttatatcctctgttcctgtttaaaaaactgccaggattggacatgggattttcagtcagttatgatgctttatttaactatgtggcttaacttgacccagaaaggttggaggactgtctaaattaccaaaataagctgcaacatccacaggaaatcttaatagatagatacacattaatttttaattacatgagatgtgtaataccagatgctatccacaactgtatgagtattattttcctaattacttattaattgtcaagcagaactttttcctttttctctcttcatgaatgtgttcaattttaatactctctagaaaaaaaaaaaagtgtgtcaagtcagtaagccctgaactgaaattgatacaattatcaacttcaaccttgttctatgattaaattgctgtgtagaaacaggtttcaaaaataaaattagaaaacagagtggaaggaagatgactgaagagaaacaagcaaaccacagtttaagaaaggtgaaatgagcatttgctgctcacctactatgttttagtagtgtcaagggcttattagtggcaaaggtgacagtcaaaccccactcacattggctgtttccattccttcacacagcctctctggttacaaagtccttaaaatagttaagatcgattgcttacattgctttaattcagagttctcaatgtcaaaatcacctaggaagcttccaaaaaaccatttaaaaagtaaaaataaaaaactgttgcaaggtttttatgcacctaatttcttgccagaaattcagattcaggtggtctcctgtgaggttgtaaagttcaagagtctttttttttggcagtggtgcaatctccatacgctgcaacttccgcctcccaggttcaagtgattcttctgcctcagtctccctagtagctgggactacaggggcctgccaccactcccagctaattttttgtacttttagtagagatggggtttcaccctgttggccaggctgctcttgaactcttgacctcaagtgatctgtccgcctcagactcccaaagtgctgggattgcaggcctgagccatcaagctgggccttcaagtgtttgcatttttaaaccctcattttgtgattctaatgtgcagccagcactgagaatcattgagttaatggagattgttttggtatctttttactttcactttacaaaaacgcatgttctgtaataaacacaccattaatttgaatgcctttgtccaaattgaatgcttaaattaagaactagactatttgtgtgagatgagatcaaatagtttctagattgagttaagaccttccaaattagctaggctgatgcacctttcacataaagccttctttttttattggtttcagatatcattttacttgaccccaaaattgagatttgagagatttgatagcatttattaactctgagctgagagatcttcaattttatttagggtaacctgtgcattttattaaaaaactatagaaaagcctaaaatggtaggatgattgtccaaagtcacacatctgaggactaaaaccaagcggctctgactgcagtgctttttaagtcaacaatgttatttcttgtttataaggatccatttaggttcagaaggggtcaagtaacccgctaatttctgggtgtataatttgacatttgatcacgttgactcccttaaaattgtcctgccccagacaacataggcagacacagtgatgtagtccttttaatttatatcataatgaaaatattctgagacttttactgatccacctctgttactcaggtagagttgaccctctccccgtctttgtgctatcattgtactttatacagatttgtatcatagcacttgtaacttttcattacatgtagtggttttccagcctgtctgtatctgccagcctgtcagtcgctccaaggtggtgatcatttctaaatatttttgtatccacagagcacaggactataatatacacatggaacaggctttataaatacatgctgaatttaacatcaaagaaacgttagctccaatgctaacatacataaaatattaaactctgcatgggtagatttctaggaccattcactgcagtttttttatagcactggattcccaatgccaaggatacaacaatgtcaacaatagccacttactcaaatttgggtataatatatcttgtgtcgttctctctggtagttccatatgtatgtctgcgtgtgtgcatgcaaagaaagacaatacaagagagaagatgaagcaaggtgcaacatagctgagtgtgatttaaatgaagttaatatttattggtcagagttttctgttaaatatgttaaaatcaggtaattaatttatttggaaatattgtgttcctaattcatgtctgttgtttgctcatttatttaactcccaaagctttaaattaggggccatgtttatcatcaattaaaatagttcattatatttggaggtggagggttgcttaataacatttaagtacaaactacccatgctcaatataattagatctaatgttatgcaaccaacagatcagctagctacaaaaataaaaggggtatcaggaataggtgtcatcatgaacagaaacaaagaggaaaaaacatttcctagctgatacacatgagtgaattgtgaccagggaattcactcatcaggtgaaaagcacatcacatggaagcaaagagaagaaaaaaagtcacatttcagcagagagtcatgggttttaggtaaccatgacgacagctcagtgaaataacagcttctcttttttctttatgaaaaagattttgtggaatgtcatacggtttacattttttcccccagataaacctctaatgctataacaaaatctttgctcccaaaagcttttaatatctggcagtttattgctatttctttaaatttaagagaacagtatttaggttcaccttcctcattaatatatctatttcttctatctccccttttttctttgacttggaacacttgatcgtccccccagcatatgttataaatcacttgcgttgaaatagaaaaaaaacagagtcatcatcagaacatccaggctcaaattctacccctgccatttagtagacgacattggaccagttatttaaaatctttgacctttgttttttccaaagagaaaaaaaatgaggtagaattaccatctatacatgttttgtgtgtgtgctaataggaggattaaatggaatgggaaacagaataatgtagtggaaagagtatagtcttttcagtcacatcagcatgaatttgagtgaactttcatacttacttagctacaagaccctaagttacttaattattctgagacgatttttgtccctaaaattagaataatataggttaaagcattactgtgaagggattcaataagatgtgtttatatggcttgtttaggatctgacctattgtttgagtttcatgtgtggaaataatatatttttaaatgatacatcaaagttagatataataatgaatattcaaacagtgttatacacccaaagttaaaaacaatttggtgacctgcccaatggtcttgttttcaaaaataattatgatagttgtcattattaaacactttacacttggcactatgctaagtgctttatacatgttagattatttgatcattgatagaaacgtataattcccatttacagatgaaaaaacttaatacccagagagcttaagtaacttgcccaaggccatgtaactaatagggtcagtattggaaaccaggtctttctgactagaatcttcatgatcataagcacaatgctaatataatttctcctagcctgcctcctctcctgtatgcagtgtaaagactaaggtttggagtttttcaaattatttctggaaccagggtagattttctcctcgttagtaatacctccagtcatccgaacacttagtcacttggcagttggcatttcagcaaaaatagtttcattcaagcctctctaatttaactgagttggctgtaggagtctttaaggcagcaggatcttttgaaaatatcctgagattactcaaagaggaataaaaatgatttagtctacatacttgtagcgtccagttaacccaaattataaaagcatccaacatattacattcaatgtaaaagttaggttagttttattcaaccattcctaagccattaacacgtcataattaatgtagtgggtattgcttcagaataaggaaacttgtgtttcagtgctttggttttgactctaaatatcatatggccctaagacaagtcactcaacagttctagttctcaattatatatggataaaaggatttaggaacgttatgaggtataaggcaaactagaaactggcatttgttgaaacagaaattatttgttgaatagtttcttttcgtatattatgtcatagtacagtttaaaaaaattgagatttagcaagtctaaaaaacatgttcattgccagtaagaaaattagccagaattgaagttgcatctacctgtattacggagcccaattttttctctaccacacaatgcataaattcttaagttatgtcttagtgaccaaaaattaagagtaggttctctaagcatttcttatctaacacagtagcagccatctatggtggggggactgcccattcaattctatttgagatgactacatttgtttatacatgcttatagatagcaaattcagtgggataggaggaccaataaaatagtcttgattattttcaaatgtgatgcaaacagttgaccgggaagacattttaccttcaaattattattctatacgtctcgcctactgttcacaaaattataaatcataacatgggtctttatatcccgttagccttttgtagtcttccacagtctggcttagtatcctcatcatgaaaatagagataaaatcataaaaatccacagggtagttgtgagaatttctaattttaatgtatatggagatatctcccttatggcctaggacagagtagtgactcaatataggtttaaaaaaataagttctagaaatatattctatggtaaaggtggtaccaacaacatgaccaagaaaaatgagcactcaacacatactttttgtaggagattctttggctcatccactgactctgttcattcatccaacaaattcttactgcacatcaacagggtgctagaaactgtactagattctgagagaaaagaaataaacaacaatgtgaaaataaatgtgtcttcatgaaggatgcgtttttataagggacgtaacaatcattgtttattagagacgaaaatgagtaagtgtaagttgggtaaagaacaatgttatctccctagtggccccaagcctcccacggaagcatgcacctgttgtgaacagtcaatgacggcagggtggactctcctgaatttcatcttttgcttcgaatgtatctctcactacctaattactctattttattaaatctaaggtatcaatgaatttaagtgatgcattcatttatgtaccactaagaaaaataaaaaaatatatttatcttaaaagccctttttggcttacgtagtcacatatttttatcatagtttattcttctgcctccatataaatgaaactacaagaaaaataatttggtgaaggattcctgaaatgtttttacattcagagtcagccccttttgagttacttttaaagtcagagtcaacaatgcctgtttttactaattatttgctttggccttaaagaatgggtaggatattagatgcatggcaaagagtgggcatgcttagccacaatcagagtcatggaatggagaagcacaagcagtgtccagagaaagtaggccatctgactttagcagcaggatcacacaggatgtgagcacatggagaatggttgcctgactcgagatattttttggaggtagaattgccaatataaaagcagtgccatcgcacaatgctccatgctcagaagcagaccctacatttgaggtttaatgatctgtggtcttggtgttgaaattcttattaatcttatctttgggtttgtgctttataagtgaagttatagggacaatggagcatatgcttggttcatatgcatcctgcagaccttttgttctttgttttcctgggatgggtcttggctaccactacccatccaccagccctacctagtttccacctcctcaccctctgcccaaggccactggtgggaggaaagaggtcaacatttcactgtcactctccatccctggtggggtccttggtgcaagcaaaaagaggtgtgaggttgggtgttgatcccatgatttgttggttcagagtaaaacagaggccttctctaccgaggctggctgcaccttagcacggtgcacaggtgattacatatagacctctcagccagtattatggactgaattgtgtctcccaaaaatgtgtgtgttgaatccctaatttccagtgtgactatttggaggtaggtctttaaggaagtaattgaggttaagtgaggtcattaacagtggggtcctaatccaacagtactgatgtcctcataagaagacaaaaaagacagagccatctctttctttgtgtatgcgtagagaaacggcaatgtgaagacagagaaaaggtttcctctgcaagacataagagaggcctcagcagataccttgatcttggacttccaaactcatgaactttgagaaaataaatgtctgctgtttaagccacccagtctgtagtattttcttatggcagcctgaactaatctacccacctactcaaacaagtcttagcatggaggtttcaatccctagggagtcacctattcactatagactgagactgtgggatacctattccctgtagattgagaaagtgaatattgatttccctacccccagccaaggcctcaacatttatctggtgctgcaaattgcatagccagtcctgcctagagcaccacaatatttacaggtaagacagacgaggaagagctagtaggacacaccaagtagtaacagcaagagagaaaggcaaaaatcaaaggggatgtgattatagaaatcagtacatagaggaatgtgttttgtgaaaatgaaagtggtcaactgtgcctaatgctatcttaacatggggacttgcagggataattggattttataatatggagtctttgaaggttcataacaaactcattggccaagagatgacaggggaagatgactagagtgcctttatgtgggaatgggtagccaggaaatggaattttcatttaagatacttgctaagatttaagctttaaatcatgtagtctatattcaaatattaactccccccgttttataaactataaatgtttgatgaagccacttaacctctataagcctgttttctcattgatgagatggaaatatcaaaagaactcctctcatagaataattgatttactgttattgaatttcaaaccaaagttttcaaatgtctttgtgtcaggcaccataccattacacaataatacatagtgaataggatacagtttatattttgatagagtttatcacctaacaggtatgtttataaagattaaatatatacaccatattgccttattcattgatttaaaaattcatttacaaaaatattagcactttaagtattgagtattttatgtaacttatcttctagtggagtaggtctagtaagtgtgtgtggtgagacagtaaaacattatatataatattttatttaaaaaagttaaaggagttaaaaaatataataagttatatatattgttttactgtctcacccactcacacttcctagacctactccactagaaggtaagttacataaagtactcaatacttaaaatgctaatacttattaaaaatgtttaagtcaatgaataaggcaatatggtatagacattaaatcttcatgaccatacttattagactgtaaactctataaaaataaaaactatgtttatcgtgttcagtatgtattcttgtattctggtataatgcctgacacatagacattttaaaacttcggtttgaaaagcagcaacaataaatcaatcattctatgagagttcttttgattacatagtttgttagaaggtgctaagtgcacagataaagcagaaattagtggtgtacagtaaatgtttaataacttgttctcaatggaggagtgggaaagtagggagagatgattctgatttgccaattgttgtggtgtaaatactgacaatggtagatttccatctaatgatgggatactgctgaacattctaatattgagaagggttacacactttgaacttttgctagctagtgctaaccagctctacaacactgctaaagtgggtaaggctgaatatgatgttaaatagatgtttagtgtagatttcattaagataatgaagatatgaataacccaagcaggtatcaagggaaaacagtctacccagaaaaaataaccagtacaggaacatgttgcataagagtgattggtgagttttgggaagggcaaagaggccagtgaagttatagaagagagggaaagggaaagatcagtaggaaataatgtttgcatcagtcaggatctcagtaggaaatagatacccaaaccaagttatattaagacagtttatttagaaaaatttgatcaaggtttagggaaaccaacaaagaacaacatcctgttgtcagccacaactgagatacaggactagaactctctattttattttaacctagaacctacttttaaaaattttttaatgttgagttctgctagactagttataaaagcacaaaatacactaaagatgaagttggaaaacttgggttgccatcacaacactgccatttatttgccatataacctgagaaatgccacttaccctctctgagtctcattttccttatttgtgaagcgaaatgtattgttttgtgatgtaaatgaaacaatgcatgtgccgtgttttcttaaaaagttttgcttatagaaaggtgagaaattcttatttttaagacggtatttctacaatgaaaatcaccttggttctagctaaaggatcagagaaatttcttttcttaaaaaacaatcaaccacgagtattgtactgcacatcaaaaaaaaaagggacaataataggatattttatgaacaaaaagcacaaaatgaaactatttctagtccttgacattctgaatataatatagattaatgtttttaaagctactgtttattgagtgttttctgttggtcatgccatgtgctatgggctttatatacagtaagatgcctatctctattgttaccaaccccagcctcagcacttggcacagtgcttaatatataataggtgtttaataaatattttattttctataactatgtgaggtagttgttattatcttcatttgatagatgaggcctagacagttaaatcattttcttaagtggtagatgcaacactagaatcctgttccaggttttaacttttatggctcattctgtaaccttcaaaaagctaattctaaaatacagtagtatgccacacaatggcatttctgtcaaggatggaccacatatatgacagaggtcccacactactataatggagctgaaaaattcctgtcacccagtgacatcatagcagtcataatattatacacaatgcattactcatgtcttcgtggtgatgctggtgtaaacctactgaaatcccacttgtataaaagtctagcacatagcattatgtacactacataatacttgataatgataataaacaactatgttactggtttatgtatttactatctatattttatcattattttcgaatgtacttcttccacttataaaaaagtaagttaactgtaaaacagcctcaggcaggctctccaggaggtgttccacaaaacgcctggatgttttatagagattgttatagagatgatagctccatgtgtactattgcccctgaagattttccagtgggacaagatgtggaggtggaagacaatgatattgacaactttgactctgtgtaggcctatgctagtgtgtatgcttgtgtctcagtttttaacgaaatttcaattatgtttataataagtaaaaaattaaatagcataaagcttataggctaaggatataataaatatttcctacagttgtacaatatgtgttttaagctaagtgctattatcaaaagactcaaaaagttttaaaaaattaagtaaaaaagttacaggaagctaaggtgaatttatcattaaaaaagaaaaatatttttataaatttaatgtagccgatatatatatagtgtttataaaatctactgtagtgtagagtagtatcttaggcctttatattcactccttattccctcacttacttacccaatgcaacttctagtcctgcaaggtccatttatggtaagtgtcctgtatatacaagtatgccatttaaaaaaaaattttatactgtatttttactgtaccttttacatgtttagataggtttagatgtatagatacttgccattatcttacaattgcctatagtattcagtacagtaatgtgctggacagatttgtagcctaggagcagtaggttttaccaaacagccaagatgtttagtaggctataccattctaggtttgtgcaagtacactgactatgatgttcacgcaatgacaaaatcacctaatgatggatttctcagaacatatccctgtcattaaagacacatgattgtagtaatctcctcaggagaagtctaacaacgataattaggagttccaacatttctgccttctcctactgactcagtggtggtgacaatttgtttaacatgagggtgttttgtacagattgtctgtagccgattggaggagtacaacagccatcagtctttatgcaatggaacgcccgagggacctttacggcgtaatcctggaaaccatgacaaatccagaaccccaaggctcccctcttcagctgatgtagaattttgcctgagtttgacccaatatgaatctggttccatggataaagctgccaatttcagctttagaaatacactggaaggtaatctctttcttttcacttttaattttttttctgaattcatatttacagtctcttatccaaagtcctaggaggtatttgagaattcagaattttctgagttgaccaagaatatgtgttgtatatacttatatcgacaatgaccctagctgacactggtcagcacgttataattcaacgtgttagcttcaggagccaggcatggtggctcatgcctgtaatcccagtttacttgggaggctgtgacaggtggatcacttgaactcagaagtttcaggctgcagtgagctatgattgtgtcactgcattccagcctcggtaacaaagtgagagactctgaggaaagaagcagcagcagaagcagaagaagcagcagtagcagctttagtgaaatatatgaatatattcatcatggtaataaatacaggcaataggcaacctaatggtgagtaaagtcagttttttccattaaaagagaaaaattaatttcatttccagaacattttgtattgtggaatttcagatataagtctgtggactgatactattttcctacgttttagtgttttagttttctcctgtttaaaatattctaggcagtgggttctttgaggtaagttcattcatttaactgtaataaggacacagcacataggtaaagcctccctctcattatcccttaagttttctgttcttcatcagagattacatctcatgatcttctctaactcctaaatatttatcctacaaatgttttcatcttgcttgcattttgcattcaaacatcgattcattcttttctgcttatagctgactcagtcatgaaacccatttcactcacataaatttgcattaggaaaacaaaatcacaaacaaacacaacaaaacaaaaacaaacaaaaaaaaactcaatcaagtcacaaatttaccaggagtttggggaagacataggcactgacttgtggcaaggcagacaactcaaaatttaacactagacatcgcagctcctaaaaggcctgtgacaccttaacatgtagaaaaactttcctctcttttgtaatcctttctccttgacttgttctttttttttcctttttgtcattgttttacaccccaacttttattattgtactgtgcagagtggttttactgtttcattcatttccctgttttattcaaaaccataatctcagggtcttacatccagaatcaattgaagcaaggcaagtctcatcctaaagatgaattctgttttccagctatgaaaatagaaattaggtttattcttctatggtaatattcatgattaactttttaaagtaatcaccgtatccaaaacaccatgtcaaacactttgtatggcattaattcactcaattctaataactatcccctgaggaagattgtatttattattcccacttttaagggaggaaacattatcagagatattcatcttttggttattgattcccattgaaaagtggtggagataatctgcccccagctttatcaagtaccaaagtccaagttctttccattgcactctgataatcaacagtgggttgagagtttctttaaagtggacaataccagtttggtcttttgacataagaaggcaagacataatgccaggtaatctcagagcctatataacaaatctaaggtacacaatttcaaagtcaccatctgggaggattgggtgacccactggactcttcagggattaacaacagtactcagaatgctgatattaatgacattgcaaagcgaagctacatctttaaggaaactggagcattttgctgttttttcagccataagtgacaaagcatatattttattattaagaagcatgggttagttgcagaaataaggcaggggaacatcactcgtctagggtctcaagtcaaagaaaaaaagtggctcaagatgtgtcaactcagccagtggttttcaagtgagagtctaatacacacaggtgaggagggaacagcagatttactacaaataatttgctactacaaataatttatgtttgtaaattattttttcccataatttattctcattcttacacactttagtaggcaaagtgtgtgagaagcaaacagatgcaacatagcatattgtctggcacacagtcgttcggtaagtatctgataaccgagtatgtaaataatagctagaatctttcaaattgcatctaaaccaccacttaccttatccatgcctgttgtatgaagtccatgtcatgagagaaaatgtgagaaaccattaagctcagctgctaagaagaacttttctttaccaggtacacattttaaaattattttttcttaaatttgtattcagcaataattttaagcttacagagatgttgtgaaaataaaagcaatacaaaaaacatgaatatatattttacccaaacttacttacattgtatcctgtttctctctctctctctcccagtctgagccattttaagggtaaattgcatagactgtaactctttacccctgaatattttagtgtgtatttcctaagaataggaatagactcatatagccacagaacagttttcaacttcagtaaactctatattgatataatgcttttatcaaatctactgtatatcagtttttaaaattagatataataatatcctcagtatttttcctctccaaaatagaatctagtctaggatcaaatagcatttagttttcatggttctttagtctgaaatatttccataaccttgtacatatgtgtctttatgtgcttgacagctctggaggatatagttcctcctcttcctcctcatttttttaatagaacattcttcattttgagtgtatctaatatttcttcatgactagatccaggtaatgcactattagccaaaattccacataggtgattatgcatctttctgagatggtgtcacatctggaggcacatcatgaccatctgtctcacgttggtgatgttaatcacctactccagatgtggtccaattttcccactgtataattatttcttccccttgtttaataaactgtctacatggagacattttaagactatgcaaatacctcacctcttatcacaatttcttctacagttggcatcgtcgatggttacaaatttatgatttttcaacttcagcactgcttttaaatttattagccaatattcaggattctactattagcaaaaatcctccattttttctatctatctatctatctatctatctatctatcatctatctatattaatggtatggagtaaaggctttccattgtttgatagtgtataactcattgatgtgcttaattatctttgtgttccaatggttccagaatttgcccatggtacaccttcaagctggttcttatgtctccatttcatatacacattttttaaaacacacattctctctggtaagcaaattattctagagcatcttgtacctacaatgctccaggcctgaaattagccatgactccaaggagtaatgttttctttcattgggaaggaaactcaagatcaagattcggaagcaagttttcctcaccagagagacacattttatctcacatcatgaataggacagggatgtggggtgtcttggtctataaggagtacacaagtgaatatagcagtgaggacagtaggacttgagaggagagcaaatgtcaaaattatactctgctctctcaataaatgcatatgaaatggaattgttacttttgattatacctcaaagttattgcttccttttctttcttggtctcgtgagaagtgtataatgcacttcccatggaacaaaatattcatagtcattgctaggacaaaggaactgttttatttttgtctactgaagttatttaagtaaactcagctttcctcttagatttcattgctgaaatagtgaagatgtgtaatttgtgaattgtgtaagagagaccacatggccgggtgtggtggctcacgcctgtaaacccagcaatttggaagtccaaggcaggtggatcacctgaggtcaggagcttgagaccagcctggccaacatagagaaaccccgtttctactaaaaatacaaaaattagccaggcatggtggcacatgtctgtaatcccagctacttgggaggctgaggcaggagaatcgcttgaacccaggaggcagaggctgcagtgagcctagatcatgccactgcactccagcctgagtgagactcttcccataaataaataaataaataaataaaaataaaataaaaacctcatgtttctagataaagcaaagaaaaataagtctgtattataagaagttttctgattaggttaaataggggaccctgtgcagtgtcagttgtcacattaaaacagaaattttctctcatgaaactctctatccattatgtcctgtatttcagagtttacaagagattttttgtttactttttcttttatttatttttttaatagcactgttggagaatgggacatggggactgaaatttcaatgaattggttaaaagtaatcaaactgactaggattacatcctagctcaaccacttcctagatgtgtgaccttgggtatgttatttaacttctcatatgtaaaatgtggataacaataataatgtataagattcaaagaattaaatgatgcaatacatgtaaggtagttagaacattttttcaacaaagggcacaacagtattgtgttaagctgtggttagttactgacaacttagcaatcattaacttctctggcaattagcttaacaaagtaagtttacagtgagtcctgagaaaatatattataatggcctacatttagtggaaaaataagggaaaggggaggatggaaaattcatgaagatagaaccaaaaataaataatgtttctggagacagataggatttcaggacaagtttcaaaaatgaggtgacagcaggaacaaaggtatcttctgttacccaaaagggaaaaaggagacaggaacaaggaacaacttcttggcgtttaatggtgtgtttccaattctgagcacagtggctgcctatagtaggtgctcattaagtattggctgacagactgataaatcaataaataaaagaaaactaccttcattgtaaaacttacatataccaagaatagtgtaaaatcaaattaatcataggtaggaccaagtcaatcttggttgatcatatattgtttcaaaccacccccttctaacaaatgcagtttatgactatggaaacttactattggaggagacttctcagtatattcagtccgacatcccacactatgctaagatgcccattgggataacaccaccatgtgacccatcaagggaaaacctaccccacaagggaaaacatgaagttctttaggctaaaccaaaatctaattccattcgacttaaatagagccatccatgaacctggtattatggtatactatggaagtacaaaaaaatacaaagatgacttacacagcttatcttactgaaaagctcaccatcaagtgaagaaactccacgtaaatacataaaatggtaattgatataaaatgaggtaggaacccagatacaccagaaatatttcctaaggaggtgaaaatagaattggatcttgaaatatcagtaactgctcactgagcagagaagaggaggagaggcatttccagcagagggaacaacatatgcaatgacacagaggtgtgaaagtgtgagatgagttaccaaaaaatgagaagttctacgtggctagaatattgagtttgtagtgggaaataacaagagatgtaaggagtttagaaaaatccgtgtataccagtgtctctcaatcttcttgaaggaaaaaaacacattataggcctctaggaatatgttcacaaatccctacagaattaagaaactgaagtttattctaagattctttcaaatcttcacttttaaagagttataaattcattcgtaatacattaaatgttagctgtcatcaccataaaaacccaatgtttaaaaaccataacattcttatcttcaaaagtatgtctgaaaaatttgccttgaaaacatgccattgacaagggtagttgtgataggttattaaacaaggaattgatattatcctacctatacttcaaaagatatgatgttagtggcattagtagaatgcagaaagataatcagtgagctattggggggagtcatggatgagagcttgatctaaagtagtgagaatgaggatgaagatgagttggttagtatacagaatcagaagctctcggtgactgactgtaaggcagcaaggaaagcaacaagttcaggatgattctgacacatctgtgattgatttctaacaattggtccttgtttttgtcctagtaagctatacgtcattttaaaaatgtaatttctcttcatataacagcacttataaagctgatattatgcttccttctctagaaccttaactttttttctgcagcccttcagctctttttgtttcaatgtcactatcaaacacttcactaggaactatttcaccacttcacatgcaaggactttttaaggagcaatctacagagtggtaaatgagctgtgggctttaatgagaaacaagggaagttttgaaatttttaatgacatttaaacaagaatagtgtgtgtatttgcagagaaaagccagctggaaaactacaatgaagcctccataggtaatctagttttcagtcttcctgcctgagaaatggacttccttagttcatgcaacaacaacaacaaaaaaaaaggtcacacagattcaaaaaataaattcatttgacactaattgtataaactagatagccaaggagatagttaacatggagtgacgcattctagtaattggaaggctaaactatttccctagtatcttcctcactaattctgagggaatcagaaactcagtagtttggtgtaccctgactccgagagaggcagaaggttttgaaagatgattgccagaccaggaaaacctttccgggcctgttttaattaatcccccagatttaccaccttgataaccacattggtattctgatcaggcaataatcctgataataacaataagaattcctatgtgccagacattaatactcctcacatgttatcttatttagtcctcacaacagtcctaggacatttcattgattaaactaaagcaccattctcagcaaagtaattattctaataaatttaggagacagtctctgtccttacattataagctcattccactcattttactcaaaaggtaacttttttctcatatatatatatatatttttatactttaagttctagggtacatgtgcacaacatgcaggtttgttacatatgtatacatgtgccatgttggtgtgtgctgcacccattaactcatcatttaccttaggtatatctcctaatgctatcccttccccttacccctaccccatgacaggccccggtgtgtaatgttccccaccctgtgtccaagcgttctcattgttcagttcccacctatgagtgagaacatgcggtgtttggttttttgtccttgtgatagtttgctgagaatgatggtttccagcttcatccatgtccctaaaaaggacatgaactcatccttttttatggctgcatggtattccatggtgtatatgtgccacattttcttaatccagtctatcattgttgtacatttgggttggttccaagtctttgctattgtgaatagtgccgcaataaacatatgtgtgcgtctttatagcagcacgatttataatcctttgggtatatacccagtaatgggatggctgagtcaaatggtatttctagttctagatccctgaggaatctagttgtactggcatatgcaatttattgttcatgccaaatatgaatattgacaaagtaaagtgaatttatgtaagccttgtgtcatcttcactctgaattaaaaggtgcaggtattatcttatggcaagtactgtcttaggaagattcactggaaagagagaaagagagaaacttcccagattagtgcagagtcctttagggtcaatgaaaacactgatattgaagacatatagaactggatttcagtatcagttctaaaattctgggcatctacttcctcatttataaaatttcttcaataattacatgctcaggttatcatgagaatttatgtacatctagctcctattacatacacaaaaaatgtttccctttttctcctgccaccttctctgtaatcttcaatagtcttctcaacttctcttataatttagcataggctgtcagtcttcatgatgtgtatttatccaagctaaagagcttttgtttaatttttcatgatttgaactcactgctgtggaaaatggctatttaaaagggataatgtcattttccaagaattcaattgagggtcctagaagatctttatggagcaaaataataatacaccttttctaagtatagagtcaggcattaagacatatagacatttcacttccttgggataagtcttgggaaaaatatcactacacattagcaatacatattgcaaataaaatttataactctattttatgcatttattaaacaaatacgagttaaaagacttcaggagttttggtctgtagcccaggctggaatgcaacggtgcaatcttggctcactgaaacctctgcctcccgggttcaaaggattctcaagccacagtctcccgagtatctgggactataggtgtgtgccaccatgcctcgctaatttttttgtatttttagtagagatgggatttctccatattggctgggctggtctcaaactcctgacctcaagagatccaccaccttagcctcccaaaatgctgggattacaggcttgagccaccacacctggcctaacttcaaggtatcaaagacaaattaacaatgtctgatgcatacataggactgctttgtaatcttctacactaatgatttgtactattttggtttcagaatccatttataactcttacaatatatgaaaaatttctgccagcttttatttatgtgggttatatttatgactacttctcatttgtaaaactgaaataaaaagatcttgcatatttgtattaatttatttaaaaaattaatttgttatgtgatagtataaataatataattttaatatttcaaaaatactaagtggaatgagattactttatattttttaaaaacacactacatctgactacttctacattcaatatattataatttattgtttggttgaagaacttgatgaaaatctagcctcacacaactatgtaatcagaatagagagaagtatttttaaaaacattttcagataattgtagatcctttctttttgatactaaaacttcacaaatggtaatttcctcagagtttaattacactgtcaaatctgaaatcatatcaatgaactttttgtccttgctacattaaagtccattgatctgtctagcatcatgaatgagtattttacccattagtgattttataatagcatgcattggtcatttgtaaaatactcagttaagtgatcttccaaatgttaaaatatctcattatacaatattcaaaatcacattattaatatcaccaccaatctcatcagaaatatctttaagtatgaagacattgacaagctcataatgatgttatcaatttttcttaatttaaatttttgcttgaaaactcaaattgtagcattggcaaaaaagaaaaaaaataccattagctttttttttctgtttaagtgacagacttgctttgttcacataagaagtctgccaaatgcctgtctaaatagccagtttatctctgaatcctacattcaagtgaaaatgatttcctgtgggaaacatgattatttcagctctcaacacaaataatggcacaaatgttttttccctagacgaacatatttcagaatgcagcataaatagtgcatatgtaggttccattttgtgaaacagaaaattaaaaaggcatgtaaaaaaagatagtttaaaaaattgttttgcttcattatggacattaagtgaaacttgcatttattcatttttactgcaagtctgtggctggtgaagaatataataattacagtacacttggttgccactaccttgatttgtgctaagacaccagaagatttgcccaccattgcttttgcaccatcagtgcaaatgtgaacacagaaaaaggcaaaatcacatcatagtatcattaggaaaatagttttgacattgcaaatcctctgaaagagtttcagggacttcaaggggtctgttggccccattttgttaagcaataaaatattgggattgtagaataatttcttttttaaaaataagggcatctgggaagaccttattaatttcaaatacaattctgcattttcaggatgaaatgtcaaagaatgttgatatctaaaggcacatttgcgaaatccaaaaagacatggtggctaacaacgtacattatcaggcctttcctctagagattttggttcagtaggtctggcagtggaagtgggggtgtttatgacctccagtgagccacagtgacttatataataatgttatatatatatgtgtgtgtgtggagatatagatatatcacataattatttgtatttatatattaaaccttattatcaatacaaagagcacacacccacacacttatttttgtgggggcagggtaaaaggtgttttcctgcaatggtacattagtcaccttgcttctctctctggtggctgttgaggttgtctacagtggattgggtgcatcctgagggccctcaacagaatgaggtccacacacaaccttctagtatttggaaagttgagggacagcatgaaaattgcacagtaaaagcacacactgttgagctatgaaaatgaagcagttttttttttatagtaaatagtaggtcattgtgtttcccaaacgtgatctaattggctattacaaattatctggcacatatattgattccagatgtgattagtgttcacttggttttagggttttacatatacgccaatttggcagtcctaacgtgttgatgttgataatgtttcatggccaaaactagaatatattttcataatacacacacacacacacacacacacacactgtatagctggatcctaggaaactttaattttagtaaatgcctcagatgatttttatgatcaggcatacagggcagctctgctctatagctggttactatattcacatttcttttcttaagatgtaataattaatggagggggagcagattttataatcaactgtagaaatatggttataaaaactcgttatttcatggcttatacttctcttcattgcaagctcctcttacctcaaggacagaaaaaaatgatgctgtttctatgaaaagatttttctgtttagtaaaatctctagtgtaaaaggagtggcctgttttcaatttgcaagtctgatcattagcctttgattcatataacataaatagacttctttgatatctaaaaagcttggctatattaaagtaagaaagtaatagatacttgcatttccacattacaagtgagcaacagagaaaacaaaattagtacttgttgagcacctgataccttgtacattttcaaataaatcacttgaaatttgcaattacaccatgagacaggttttcccttgattttacggatagggaacctgatagtcacatggttgataacaaccatagttaagtctactattccaaattcatctgactccaaggctgatacaaattccacttcactacaaagccttcttcagcctgctaaagtaaagctggggactctgataaactcccaaccctgcctctggtatatgacccaacactaaccactctgctcagagtaggtatctaaaagaaattcttgtgtgaaacaatgaaattttggtgggaaaacagaaacatgattgtcaataacaaaagtatacaacacagacttctacttctgggaaggtaaagtaggtacacttttctctattagtccctctaaatacaaccacaatctctggacatggcatataaaagaaacagaaagaatgtaaatagtgaagagaagaagccaggtcagctaggaatattgggatctcacggtatgatggtgagtcccctgggttttattttcctcatatattcaagatttggagctgaagaagcttgtaacctagaaacacccagaggtacaaacaaaagtaaaacaaaacaaaacagaaagaaaaaaacaccaacaaaagccttctctctctagtcaaatgacaaagaaaggtgcagaaaagttttaaacagtaactactctatttcattcaaattcaaaaacagaaaaactgaggcacaatccccacccaagtcagcaaaagttgactggggagactagacttctacccttactaggctataacaaggtgcctcctcaattcccttccagggtgatgtaagagaaggctcagtttgcattccaaccagggaggaattaaccactcttcctactttacatggaggcaatgtggaggacctgcaattctatccccaccaggcagtaaaaagaggaatcctttcttcccttctggattgttgtcagaggaggcctactggatagttaggtcttctagcactgtctagtggtaattaggccacccaatccatggcattaggggaaagtagttgaggagcagtaatgaggggtattcttacctctcctagcaaggaagacatcagtagaggcctagtggggagccaggtcggtggggaacttggacttctattgctacttaaaagtaataatgcagtgtttcccttctgctggagctgagtcagagaaagccaggagattatacatttttttttttttgagatggagtctttgctgtgttgtccaggctggtgtaaagtagcgtgatctcagcccactgcaacctccacctcccagagtagctgggattcccctgcctcagtttcccgagtagctcagattgcaggtgcccaccaacaagcccggctaattttttttatatttttagtagagacaggatttcactatgttggtctggctagctcccaactcctagcttcaagtgatccacccactttggcctcccaaagtactgggattacaggtgtgagccactgcgcccagctgagattataaacttttataaaacagaagatttaataagatctgtagtctcataaaatacccaaaatgtccaggttgaaaacagaaaataatcccttatcatactaagaaaagttacatccttgaattaaaaaaaaaaaaaagacagcagacgttaacactgaagtaacagatatgttaaaattatctcaaataataggttgaagcaaaagtaattgtggtttttgccattgaacagaatggtgaaaaccgcaattacgtttgtaccaagttaatagatttaaaacactcatttttgaattcctcaatgaataattataaacatagttgaaacaaatgaaaaaaatagaatgacttcgcaagaaaatggaagatatcacaaagaacaaaacaaaattagaactaaaaaatacagttaccaaagtaaaagtctcaatactaggttcaacagcagaatggagaggaaagaagaaagaataagtgaactggaagatagaaaaatagaaattaccaaatctgaaaaacagaaaacacactggaaaaaaaattaaaaaggctcaaagagttgaataactacatgaaaatgattgaacttttgtgttattagtgtcctagaaagaggggagaaaaatcagttctaagaactcaatgaaatagtgactgaaaacttcccaaatttagcaaaagaaactacaaattaaagaatcagagttaaacccaatttaataaatcccatagcaatccacatcaaaatatatcactattaaacttctaaaaactaaaacaaatattcaaagtagtgagaaattaattatatcttatctattgtggaaaaaaatgaatgacagatctttcctttgacactatggaggccagaaggtggcactgcatttttcaaatgctgaaaaaaatgaactgttaacccagtgttctatgcccagggaaaatactcaggaatgaaggagaactcaaggtctcctcagatgaagtaaaatgaaaagattttgtcaccaccaagcagacctgccctgaaaaaaaaatggttaatagaagtttcttaagaagaagggaaatgataaaataaactttcttaagcaaaaatatagggaattcaacagacttctgttgagttttctaaattgtgatttaatggttgaaacaaaaataaaattttatgtcattcatctaaatgaacataagataaatatttaagacaaataaggttttacacttaatttgaactagttgaaggatgatgccagcagagataaattatgtaaaaataatgtaatacttagataaatcaccaataaagtgatacaaagaaatacattcaaaaaacttgataaataaaaatggaatttgtaaacattttcaagcaactcaaatgaagacaggaaaaatgaaccaaaaaattcagaaaagtaacaaacaggaaaaaaataggtttaagccataacattatataatacttatattaaatgtgaatagtctaaaaataccaattaagagattgggagactagattttatttaaaaatgacctatattgagcctagaggaaattcactttagatataacaatatttgtgaaagttaaaggatggaaaaaatcataaaacattaatcaaaacaaagttaaagtggctatattaatatctaataaaatagacttcagagcaaaaacaattattggagtaagagaggcacattttatcaagattaatgagtcaatccagtaagaagacatcacaatcctaaatgtgtatgcaccaaacaagcttaaaatttgtgaagcaaaagctggtagagctaaaaggaagaaatagacaaattcacaattacagttggagaattcaatactgctgtttaaccaacaggactaggcaaaacatctgcagtgataaagaacttaacaccatcagccagaagaatctaatcaacattgatagaacattccattcaataacaacaacaaaaaatatttatttgaagtgctgataaaacatatgctaaacatatgactgccccttgagccataaagcaaatatcaacaaatttaaaaagattggaattatacagactgtgttctcctaccccaatggaatcaaactagaaatcaataacatgagggaaagatcttcaaacacttagaaactaaacaaagcacttctaaataacccaaggagtaaagagaaagacttaaggaaaataaaatacatttaaataaataaaattaaaaaccaaacttaccaaaatttgtcagacatactataaaattgtgctgagagggggaagtatagtactaaatgcacacatgtggaaagaggtaaagtctcaagtcagtaatacaaactcaaactccagaacctagaaatagaagagcaaaataaaaccaaagcacagagaatgaaggaaataataaagataggagcagaaagcagtgaaattaaaaacaggaatcaatacaggatatgaatataacaagcagctggtttttgggaaatattaataaaattgacgaattagcaagattgaaaagggaaaaagagaaaagacacaaattaccaatatcaagaatcaaaaaagggatatcaatacagatcttgcagacatcaaaagggtaataaaagcgtactatgagcactctatgtacataacatttgacaacttagatgaaatgaactaattcctaaaaaagcgcaaactataccactcacccaataagaaatagacaacttgaatagccctataaatgtaaaggaaattgaattggtaattttaaaactaccaaaatagaaatcctaaggaatagaatgttttccttgagaatcaaccaggaatttaacaaattaacataaattctatacaatctgttccagaatgtagaagggaacatttctgagtcattttataaatccagtattaccttaatattgaaaccagataaaaggatgccaagaaaatgagacagatcaatatccctcatgtacatatatgtaaaaattcttaaaatattgacgaatataattcagctgcatataaaaagaattttatgcattgaaacaaatgaaatttattccaaaaataccaaactgcttcaatatgtaaatattctgtatcttgaccctttcaataccaatatcctagctgtgatattctactatattacataatattttttcaaggttaccattgagggaaattgaataaggagcacatcagatttctctctattatttcttacagctgcatataattctataattaactcaaaataaaaagtttttaaggccaggggcggtggctcacgcctgtaatcccagcactttgggaggccaaggcggggggatcacgaagtcaggagatcaagaccatcctggctaacacagtgaaatcccgtctctactaaaaatacaaaaaaaattagccagatgtggtggcgggcacctgtagtactagctactcgggaggctgaggcaggagaatggtgtgaatccaggaggcggagcctgcagtgagtggagatcgcgccatggcactccagcctgggcaacagagcaagactccgtctcaagaaaagaaaaaaagtttttaaaaagacaaagttctttaaggcaaatatttgaaatttacatttaaatagatagatgagataaaagacgtattaggaaccctatttcagtcaagcaaggagcaatacttacttttatttattgacctttcttgatgcataaacatcaagagaaccaatgtgtaacatcatccaagataatatcaacagttatcaatatatgtgagaaaagacttagggaggacttccaatatatattttattctaaattttacattatacaaacagctattatcactttgttttctgccaatttgagatgaataattattgtgccagagaataaaataattgctcagtgagtatgcaattcatctgaatctatggatcatttacagagaatctccttaaaatatgcatcataattttaatcactaacatatacccaaatccctaattttgtaagtacttctaaaacatatctaatgatctttgtaatcattcttcttagacgtatttactttgtttttatttatccaccagcattagcaattgcttatttttgttgcttactttataaagaaagattttccatatcaatcaatttttatggccactatttatgttattgtaaagtaagaacaaaggtaagaccttttgctcaactttcagttgagtttaaatccttgctttgggagagcttccaagatgactgaacaggaagagctctggtctacatctcccagggagatcaatgcagaagatgggtgatttctgcatttccaactgaggtatctgattcatctcattgggactggtcggacagtgggtgcagcccacagaaggtgaaccaaagcaggatggggggtcacctcatctgggaagcacaaggggttgggggatttccctttcctagcccaaggaagctgtgagtgactgtacctggaggaacagtacactcttgcccaaatactatgtttttcccatgctctttgcaaccagcagaccaggagattccctcccatgcctggctcagcaggtcctgtgcccacagagccttgttcactgctagtgcagcagtctgagatagacctggcatgctggagcttggcagggagaggggcatccaccattgctgaggcttgagtaggcgattctatgctcacagtgtaaacaaagcagcagggaaactagaactgggtggagcccactgcagctcagcaaggcctactgcctctttagattccacctctgggggcagggcatatctgaacaaaaggcatcagacagcttatgcagaattaaacgtccttgtctgacagctctgaagagagcagtggctcttggagcacagcgttcgagctccgataatggacagacggcctcctcaagtgggtccctgaccccgtgtagcctgactgggagacactacccagtagaggccgacagctgcctcatacaggcaggtgcccctctgggacgaagcttccagaggaaggatcgggcagcaatatttgctgttctgcaggctccattggtgatacccaggcaaacagggtctggagcggacctcaagcaaactccaacagacctgcagctcaggggcctgtctgttacaaggaaaactaactaacagaaaggaataccatcaacatcaaacaaacaggacatccaaagcaaaaccccatttttaggtcacatacatcaaagaccaaaggtagataaaaccacaaagatggggagaaaccagagtagaaagactgaaaattccaaaaaccagaatgcctcttctcctccaaaggaacacagctcctcatcagcaaggcaacaaaactggatggagaatgagtttgacaagttgactgaagtaggcttcagaaggtgggtaataacaaacatctccgagctaaaaggggatgtttaaacccatcgcaagaaagctaaaaactttgaaaaaaggttagatgaatggctaactagaataaccagtgtagagaagagcttaaatgacctgctggagctgaaaaccacagtacgagaacttcatgaaacatatgcaagcttcaatagcagattcaatcaagaggaagaaaggattgaagatcaaattaatgaaataaagtaagaaataaagtaagaagacaagattagagaaaaaagaatgaaaagaaacaaagcctccaataaatatgggactatttgaaaagaccaaacctacatttgattcgtgtacctgaaagtgatgacgagaatgaccaagttacaaaacactcttcaggatattatccaggagaacttccccaacctagcaaggcaggccaacattcaaattcaggaaatacagagaacaccataaagatactcctcgagaagagcaaccccaagacacataattgtcagattcaccaaggttgaaatgaaggaaaaagtgttaaaggcagccagagagaaaggttgggttacccacaaagggaagcccatcagactaacagcagatctctcagcagaaaccctataagccataggagagtgggggtcaatattcaacattcttaaataattttcaacccagaatttcatattcagctacactaagattcctaagtgaaggagaaataaaatcctttacagacaagcaaatgctgagagattttgtcaccatcaggcctgccttacaagaactcctgaaggaagcactaaacatgaaaaggaacaacgggtaccagacactgcaaaaacacaccaaattgtaaagaccatcaatgctatgaagaaactgcatcaattaatgggcaaaataaccagttagcatcataatggcaggatcaaattcacatataacaatattaaccttaaatgtaaatggagtaaatgccccaattaaaagacacagactggcaaattggatagtcaagacccatcgatgtgctatattcaggagacccatctcacgtgcaaagacacacataggctcaaaataaagggactgaagaagatctaccaagcaaatggaaaacaaaacaaaagaaaaaagcaggggttgcaatcctggtctttaaactaacaaaaatcaaaagaaaaaaagaaggccattacataatggtaatgggatcaattcaacaagaagagctaactgtcctaaatatacgtgcacccaatataggagcacctagattcataaagcaagttcttagagacctacaaagagagttagactcccatacaataatagtgggagactttaacaccccactgtcaatattagacagatcaatgagacagaaaattagcaaggttatccgggaattgaactcggctctggaccaaatggacctaatagacatctacagaactctccaccccaaatcaacagaatatacgttcttctcggcaccacatcacactgtaaaattgaccacataattggaagtaaaacactccacagcaaatgtaaaagaacagaatcacaacaaactgtctctcagaccacagtgcaatcaagttagaactcaggattaagaaattcactcaaaaccacacaactacatggaaactgaacaacctgctcctaaatgactgctgggtaaataacaaaatgaaggcagaaataaagttgttctttaaaaccaattataacaaagacacgacgtaccagaatctctgggacacatttaaagcagcgtgtcgggagaaatttatagcactaaatgcccacaagagaaagcaggaaatatctaaaattgacaccctgacatcacaagtaaaagaagtagagaagcaagagcaaacacatttaaaagctagcagaagaaataactaagatcagagcagaaatgaaggagacagagacaagaaaatcccttcaaaaaaatcaatgaatccacgagctgtttttttgaaaagatcaacaaaatagatagaacattagcaagactaataaaagagagaagaatcaaatatatgcaataagaaatgataaagaggatattgccactgatcccccagaaatacaaactaccatcagagaatactataaacacctctatgcaaataatctagaaaatctagaagaaatggataaattcctcaacacatacaccctcccaagactaaaccaggaagaagttgaatctctgaatagaccaataacaggtgctgaaattgaggcaataattaatagcctaccaactaaaaaaagtccaggatcagatggattcacagccgaattccaccagaggtacaaagaggagctggtaccattccttctgaaaatattccaatcaatagaaaaacagggaatccttcttaattcattttatgaggccagcatcatcctcataccaaagcctggcagagatacaaccgaaaaaggagaattttaggccaatatccctgatgaacatcgatgcgaaaatcctcaataaaatactggcaaactgagtccaacagcacatcaaaaagcttatccaccacaatcaagttggcttcatccccgggatgcaaggctggttcaacatacacaaatcaataaatgtaaatccatcacataaacagaaccaaccacaaaaaccacttgattatctccatagatgcagaaaaggccttcaacaaaattcaacagcttttcatgctaaaaactctcagtaaactaggtattgatggaacgtatctcaaaataataagaggtatttatgacaaacccgcagccaatattatactgaatgggcaaaaactggaagcattccctttgaaatccagcacaagacaaggatgccctctctcaccactcctattcacatagtattggaagttctggccaggacaatcaggcaagagaaagaaaaaaaggatattgaaataggaagggaggaagtccaattgtctatttgcagatgatatgattgtatatttagaaaaccccattgtctcagcccaaaatctccttaagctgataagcaacttcagaaaagtctcaggatacaaaatcaatgtgcaaaaatcacaagcattcctatataccaataatagacaaaaagagagccaaatcatgagtgaactcccattcataattactataaagagaataaaatacctaggaatccaacttacaagggatgttaaggacctcttcaaagaggactacaaaccatggttcaaggaaataaaagaggacacaaacaaatggaagaagattcaatgctcatggataggaagaatcaatattgtgaaaatggtcatactgcccaaaataatttacagatccaatgctatccccatcaggctactactgactttcttcacagaattggaaaaaactactttaaagatcatatggaaccaaaaagagcctgcatatccaagacaattaattctaagcaaaaaagatcaaagctggaggcatcatgctacctgacttcaagctatactacaaggctacactaaccaaaacagcatgacactggtaccaaaacagatatatagactaatggaacagaacagaggcctcagaaataacaccacacatctacaaacaacagatctttcacaaacctgacaaaaacaagtaatggagaaaggattccctatttaataaatggtgttgggaaaactggctagccatatgtagaaatctgaaactggatcccttccttacaccttacacaaaaattaactcaatatggattaaagacttaaatgttagacctaaaaccataaaaaccctggaagaaaacctaggcaataccgttgagaacacaggcaaagacttcatgactaaaacaccaaaagcaatggcaacaaaagccaaaattgacaaatgagatccaattaaactatagatggttctgccagcaaaagaaatatcagagtgaacaggcaacctacagaactggagaaaatttttgccatccatcaaactgacaaagggctaatgtccatcaaaaagtggacaaaggatatgaacagacacttctcaaaataagacatttatgcagcaaatagacatatgaaaaaatcctcatcatccctggtcatcagagaaatgcaaatcaaaaccacaatgccataccatctcatgcctgttagaatggcgatcattaaaaggtcaggaaacaacagatgctagagaggatgtagagaaataggaacccttttacactgctggtgggagtgtaaattagttcaaccattgtggaagagagtgtgacgattcctcaaggatctagaactagaaataccatttcacccagcgatcccattactgggtatacccaaaggattatatatcatgctattgtaaagacacatgcacgtgtatgtttattgcggaactatttacaatagcaaagacttggaaccaacccaaatgtccatcaataatggacaggataaagcaaatatggcacatatacaccatggaatactatgcagccataaaaaatggatgaactcacaggtcagacccactgaaatagcaccaaatatcagagccaagggatgaacagagctctaaagtaaatcaaaagcccagaaatcaggagactaagaggcagtaaatcatgtgattaagaacatagattttagcatcaaacatgcctcattttgaatcccaaagctgctacatctagctacataatctttggcaagctgcttattcttccctaagccttctttttctcaccataaaatggtgctaatatttgtagccatctaaagttacagctttgatttttagtacgatattgtaaaaatatatatgtaacaacgttcttagcacacaattactagatagacaaggaacttgctattaaaatatttgcattctagtgaggagaagcataagcaaaccagaaaagaaataagcacaaaattcagttaagcactatgatgtgatataatatctatatattttataaagaattacttgggagaagcttgcagttgagataggctacttatagctgacttctctgatgaagctgaaaaccatcattctcagcaaaatatcacaaggacacaaaaccaatcaccgtatgttctcactcataagtgggagttaaacaatgagaacacatggacacaggatggggaacatccctgtttgggggtggggggctgggggagggatagtgttaggagaaatatctaatttaaataacgagctgatgggtgcagcacaccaacacggcacatgtacacctatgtaacaaacctgctcattgtgtacatctaccctagaacttaaagtataataatagtaataaaataaaataaaaattattgctttggcaaagaataaatggctatatcccattggctttaaaaatttgagtctaagcaatccattaaaataatctattttaacttaaaattttttatagatttaggggtacaatcatgattgtgttgcacagatatattgcacagtggtgaagtctgggctttgagtgcacctgtcaatcaaatagtgttcatagtgttactaagaaatgtttagaaatgtcataagaatcccaccatttttggagagagatcattaatactaaagacgcaagaccctccataagtcatttaacttcatacagctcatgttttttatttataaggtgaagataatatttctgttctatctgtttatgtaattatcaactaagataatgtttgttaaacatagaaaacctctgttactatattattataatgaagaaaataatttttaggatttatacaacatactaggattttggtatctttaatcaataattttaattgaaaccatatttatttttctttttcatcctgcagtaaattcagattttgtgcagtgagtgacttcacttaccaatagaaggtgtgaaagcttatgaacctggtgaaagcttatgaacctggaattgtgactttagtgtataaataaacagaagaaaatgcagtaagaaaaagcatcagatttataggtgaaatacttaaaggatggcacttaaacagagtaagaaatatgacttgtatgtatactaaaagcaactgtggctcagattattccttctgaggttctatctgccattcatttcatggaatattgtggaattagcctatttcaccttctattaaatgaggcccactttatggtatcataagaaaactcaaggctgaggtgcactgattgcctcagctctggagtttgacacgagcccaggcaacatggtgaaaccccatctctactaaaaatacaaaaaattagccaggcatggtgatgcacccctgtagtctcagctactcagtaggctgaggctggagaatcgcttgaacccaggaggcagaggtcgcagtgagccgagatcgcaccactgcactccagcctggatggagtttttccatctcaaaaaaaaaaaaaaaaaaaaaataggtaaacccaaataatatgccttttaagaaaaagaagttgattttgctcttatgaaacaatatgaagttagatcttcaagatctggtagtgcaattctgtcatccttaactcacagcttccatctcttgatcttcatcctgttttcaccctaatcgaaagggtgaaagtgggaagaatagcgtatgactatttttctttaaaggaattatttagaagtgtttcttatcatgatcaaacagacatggtaacatttagcttaaactggaagatgttatctccagctagtggccatgtgtccaacaacatttagattattattaggaaaaagagaaaaaattagcatttgtgaaaaaagtagtagtctctgtcacaatcttttacccatgttttgtaaagtatttaaaacaaaaatcaagcactcttaccataatgttctgtcacagtgttgttttaaatttcatgtaaaacaacattagttctgtagtggtaaatgaagtgttaaagtctctctttaactccagacctttcaagttattaaaaatgcgaacatttattatctaacttaggaagtagagaatattggagtaagtaatactatgcagtgttaacaaacgtatgccaaaatcttagtgatgtaatccaataaaaatgaatttcttgctcatccaaaatccaatttggatgtttctggttggggaatgaccttccctatggctatgttagtgagtctactgtcccccacttatctgatgtatcttctccatcttcctgggagactgagtatgaggatgcatggagaattgtacatgagaaatatatgggccaagccttgaagtggcccacataccttctgcctacatgtcattgaccactacttattcacagggccacatataaatgtgaggttcattgtgcatccaggagttaagggaaagtggttttttgaacacagtgaatggatgtgtcttgggtgtttctgtttgagtctcttcgttgttttatttttccctctaggatccagtaattcctgaactttagttctggcctgggctggcctgcctcattttcactgaagcctcgattcttaactgtgaaagaatagataattttctctttcttaccattgcttgctgccctactctttctgaaatagtttcccatgttatcccattttctactacatggaaaaagatcatgctattctgttttccataatcattatatattcttttttccccatggtatttcccaaaaatttattattccatgttttatgggtgaatagttatttctattaactacttttttagagtgaagaatcatcgacctcttctatcctaacatctactgttatcccctccatgctgaacaacaccaaaactatttttcatgtaggttgttcagggctttctctctattcacttaattattccatcaggagactattgagagaggcctataacataaaaacataagggttaaattcaaagccatcgtcaatcttactcaaagacataaaccttagaacattataggaatcttcaaaaaagttagcttaattgattttaaaattatgccagcaactaaagctacatgttttagaaagagaaatatatgcctcatgtttattgattaaaaaacatttatagatactttgcaatatactaggaataaatgacatattctgccctcttgaaacttaatataattaagaactagattgtgaaaaactaattataatccaaagaaaataaatgattaaaagaggcaaatttaagtgtcattaaatgaaggaagctaaccaaatatttcttgtcaaagaaatttttatggatgatctgatatcaccaagaatgagctggaatagtttcagtaaagtacaaagaagaaaaggaggaaaattgacaaattctttcctacatctttacaaaataaccttacaaattaccagatagcctctgtaattaataacaacagttaacatcactacaatcctacttttctaaaaacttttcacgtccattatcttaattattcttcttaaatgccttataccatatttattattatgcacactttataaatgaggaaactgagattctgataatttatccaattgacaatgttacagagctaacaggtagaaaacatggatcattagcaagggagatcatgtcctcaagtgttccaaatagaaaagccaagttttagatgcagctagagaaaagcagttaagagttggactacctgggtttaaattctagtactatcacttactagttaaatgacttttgtaaatttaacctgcccttgcctgaggtccctcacttacaaagtgataataatcacaatacctacctcatatgctattgtgaagattacataagtcagtatttgtaaattacttagaaccatccttttattgcaataatgaaagttccttaaagttactgtcttgcatgctgatgcacacactgtaattttctagccctatatagaagccaaattccaaacaatagactaggacttgagactcaaactggacaaaaattgtttcaggaaaatattagtcctaaattaaacttatatccaaagtgtaaagagcagcagaatgacagagtgactttttttttttttttttggagacagagtcccactctattgcccaggctggagtgcagtggagcgatcttggctctctgcaacctgtgtctcccaggttcaaacgattctcctgcctcagcctctcgagtagctgggactacagacatgcaccatcacccctggctaatttttgtatttttagtagagacaccatgttggccaggctggttttgaacccctaatgtcaagtgatccacctgtctcggcctcccaaagtgctaggagtacaggcgtgacccactgtgcccggcctgatagaatgcttttaaaagcaacctttaggatgaaattatgtccttccacaaattcttacaatctagtaaaaaaattaaatttgataagaacaaaaattggccataagtatgtgggtattgggtcttatacaatatcttggtgacactaccaaaaattcttgccttctctgatccagttgactatgtgccctggagtcctgtgataggaagctgatgaagttttcatccagagagtaagaaccagcatgatagggccttttctaccccaagagagtactctgtgaaaaagctgggttgcagctttttattccaatggatatgacaagaattaaaggaaataaaggaactatcataactgcaacagaacatctattgtctattttaaattttattgcaactaatggctttatatcaactgaaagaatgtaacagaataattaagagcaaagcttggaagtttggcagataattggccaaaattctgaccctgccacttatctgcttgtggtaggccgttctcacattgctttaaagaaatctcagactaggtaattaaaaaaaaaatggttttatttactcacagttctgtaggccgtacaggaagcacagtgctgacatctgcctggcttctggggaggctgaaacttacaattatggtagaaggcagagagcacgcacattatatcgccagagcaggagccagcgtgaagggtagcaggtgccacacacttttaaatcatcagatcttgcgagaactcactcactattgtgagaacagcaccaaacggatggtactaaactattcatgagaaatttgccccatgatcaaatcaccttccaccaggtcccacctccaaaagtggggattacatttcaacatgacatttgggctaggacacatatccaaactatatcattactgaatgaccttagataaaccacctatcctctttgagacttagtttcaacacctgaaagttggttaaataatatcttctttacagagttactacgaagatagccgggcgtggcgggtgcctgtaatcccagctactcagaacgctgaggcagaaaaatcgcttgaacctgggaggcggaggttgcagtgagcggagatcacaccactgcactccagcgcctgggcaacaagagcgaaactccgtctcaaaaaaacaaaactcaaaacaaaacaaaacaaaacaaaaacagagttgctatgaagatgaagttctataaaaacttaaggaaatgcagcctagcacctaccacataggaatagaaggtgtagtaatagcagtaatctttgttgtagagaggcaattaagtagtagagaagagaaaacacaaacaccgaggttaacaagtagagaagcccacttaaaataataaacactttaataacacaaaaacctttcttgaatttatggaaatgacttataattcattgtgatttgtcattgtctttgtgcaaacaatgaaaagaatgagagcagctgttttcaaaccttatttgcattagaatcacctgtagaactggttaacacacacgatgggtccccacctgactttctgttcagtgactcactgttagggttagaggatttgtgtttgtaacaagtttacaggtgatgctgctaactctgggaccacatttttgaaaaacacaaaatatgtggagtgtttgtgccctgggctctgctgtaataattacatagtatgaaacactcatgcaccacttcatttgcttcgttactctattcctcataatcaaagaaatctcctgagtcaaattaaaagtattttctaataaacataaatgctaattaattacatttatggctgtagagctagcactttgagcaaactggaagttggttgaaagttaatgcttctcgtgtatctagggacttgcttagatccaaaaatgttttttgatctgcaattctgtatttcttctgtaagtagtttaaattacaagccttttcaaagtattcagccatcaaatacagcctcctaaaaccattgtgcataaccttttgaagctgtgtacttaattcctcaatcaagttgcacattaggagagtaaattggaggaatataagtcagtgggtcttaagtcactttttaaaaaatcttcagatgcactaatgtacattttctatcttctttttatttcctcttctccaattccatctctgaaacactatgaaatgttaaaataggttaaaaatgcacttaaatgaaatgcaataaattaaatgtgctctattcttctgaagatttaactacacaccttttcatatttcagactcttagcaggtatgattaaagtgcaacatctgtaactcatcttcctcaaaggaaagatacggaattatatgagatgatttatgtgccaatgcctagccagtgactgttacatagtagttgctcaatttcttaaatcataattttcaaaggaacatggaacagttaccaggaagaaaatatgtcaaggcataagtttatagtgtaagattttaaaggcagaaggatttttggactgtcagaatatagaaggtgaaaatttcatatcaaggaaatcatatattcacaggtagtttttgaagcatgagctcaggtttagagaatggagatcagtccagcttaattcagtgcagtgcaaccctggtcacatgttagaacgacccggagtggttttcaaactccaagtgcctgagtcccattctaaaccagttatatctgaatctctaggtatgagagctaagcatcaatattaaaaagaaacaaacataaacttttcagagtagtattagggaagaaaagagcaaaagagatcaactagttgcaattttctattgttgggtgccgggcacggtgtctcacgcctgtaatcccagcactttgggaggccagggcaggtggatcacctgaggtcagtagtttgagattagtgtggccaacatggggaatccccacctctacgaaaaatacaaaaattagccaggcatgctggcttgtgcctgtaatcccagctactctggagtctgaggcaggagaatcacttgaacccaggaggtggaggttgcagaaagctgagatcacaccactgcactccagcctgggcaacagagtgagactccatcttaaaaaaaaaaaattctattgttgccattgacctgaaactgggtttattaatttcctataggaatgtagcttgcaaatgttaaggcataacataatttgggggaactcttactgcctttcacaaagaacattgagctattttggcatctgtgactaacatgtctctactggctcagtaaaatttctttccatgaggaattcgtggacaaggttgagataataacacattctgcaccttgctgtaatttggtagctaaaaatgacaagtccacaaattcattgcaggggtatagtgcaaagaaatttccaagggtaagtcagtacagacactacccaactgtatatgcaaaaaggagcacaggaattggaatcaattattcagttcattgattccccaactactagctttaatgtatgtgttatttaacttctataagctgtagttttcacatttgtaaaactgaggtaatgataatattcatatcacaagtagccctgagattcaaatgagattatttacatgaaagatatttgaaaagctggatatatatgggcactattttggggtacttagaatttcctctttgacttattcttccaaaacagagtcaaatctcagccagagaagctaccgatgttggagtaattatttctattttttttcaagttgacttcaccaaccaagaaaataaactctatgaaaagataaaatagaaaatagtttgttcacatttttatattatttgtcattcataacattttctctgttttgtcacttgacaggtgccagagtagagctctctaaaattccctcgtaggttttttggaaattgtctctcttattcccaatctctgtaggatatataagtgaaagattgagagtattttatatttgtttatcttttaaatatgaaggtgttcaagtctctgattttgattatcggaaatcaaaacaaacaatttgatctctaattctgaggtgtctctagtctatttgaagagacaatatatacattatttaaaattgttactataataaaactgtttacaactgtttatattaatctggtatgtattacaaagaatcttggttcaacctgggcctttacattatttctaagcacatatcacaatgtattccgacaaattccttgtgctttttctttagctgtttttttttttttcttaataatattaggggcttttctagatgcaacatctgtcaggtcagtatagtagtgagtaatgaaataccagcctggctgaaaacgctcttaaaatgtcggtccattctacttcctaagacacctaagaacacctgatataggatgagagcaggcagcaggcaggtttctacagaacaatgaagtttaggaaggagggagatgcgtgatgctagggtggtacctaatggttgcagcaaaagagatacttttgcattgagagtgcaccatattcttggttagcagcaactatttaccacatgcaacatgattatagaaatactagttactactcaggaagtattcactttgcaccagatctgtactaggtgcttttatacctgctatcaaaattaatccttgccaccaactgataagtggacattatttacttcctctcttatcattgaagcccaaaaaatataaataacttgacaaggattatacttccagtatgtaacacagaatttaagccaagttctactcagttcaaaaatcttttttacagcagtatcttcaaagtggcatagatacactactgcaggttcacaaaaactttctaaggggtacatggtgcagagagttttaagaaaatttatttttagctcatccttccaagcatacttttccaaatgaatctgattgagaagactcctgaagattctccttcaccaactctcctttcaaaatctcccttctctgatgtttcagaagagcctatcttccacctatcctgaattcattctcaatacagtctgctcccagaatgggaaaaacttccagagtgtttaacaagtggggaatccgaaacattggtgctagtgttgccaacatgtataactttaattactaggcaacaaacttcttacaagttgggtagtttataaataaattcatcatttgtgaaattgcttttatcaaataattcttgcttgagttgtcagttgatggatcaaattgtaaaaactatttttttttttgctggattgtatcattattagcatatttagctcaaatgagttcaaaaagataagtaaaatttaaataaaaatttctttacccttatctagttatttatgggaacaaagcttcttggcagttatttatttttttaaaatttagaatataattgatatacctatttttgttacagagaattttggtaggctacttattcttttccctttttaaaatttataaataaaaattgtatatatttatggtgcatcacatgatgctttgatgtatgtatacattgggaaatggctaaatcaagctacttaaaatatctgttacctcacatacttatttgagtagtaagaacatttaaaatctactctcttagcaattttcaagtataccatacattattattaactataatcaccatgttgtatcatagatctcctgaacttattcctcctatctaacaaaaaatttgtatccttagacatagatctcctgaacttattcctcctatctaacaaaaaatttgtatccttagactaacatctccttaatcctcactaatatttttcaaatattttaagcataacatatataacatttagatataattgtgtagaaaaatagtatacaaatacaagttcaagtataaaaaggtaactccagaaagttacagactatcaaagaagagtttaagttgtttttgatatggatgatggaatcaaataattatggtggatacattttttgaaagtaatattatatgttcatttttaaattgacactatttgcaatatccttttattatatcctctgaaactatttatgattatgattaaaacaatttgatagtacagtaggaaaattatagttaacaacaatttattctattgtatatttttaaatagctagaatagaagatttgtaagattcccaacacaaagaaaagataaatgatcgaggtgattgatattccaattactctgatttgatcattacaccttgtacattataggcatcaaaatatcacatgtaccccaaagatatgtacaattgttacataccaatgaaaaatataaaactttaaaaattcttttaaattaaaaaaatcagtttgggacctactttaaaaagtgtgagagtatacactttaaaaagtgtgagagttttaaatttttcatttggtgctactcagagataaaatcttgaaaacaacttctatgaagaacattgtcctcagtgacatgatttattgctacatagcaaaggaagtaaaccattgtatttaggagcataagttctacactaaaacaggcatctgctctaaccttaatgtctaatttgttattttaccttagacaagttctttgtcccctctaagccctttctttccatttctataataatgtaggtacttaattggtcagatccttctaaatgtcacataaaattatgtcaagatctagaaaaatttctacacagattaagtgtcatgtatgtatattcacagaagttgtcatagacaaaactgtgtaaaggagagggatgtgcatgttcttaggctaatctcccagagggatcagggattggtatggtctcccagaatgaataaaataagttcaaaaggaggtaaaaggaggaaaaaacatcactacccgaaggggcagaaacactgtcagtcacaatagtgggagagcacaaggcatgtgatgcaaaaattaagaactgcacctttaataaggaagatattgccaataaaatagttctacttgtatgaaataaagctagaacttccctgcctaaatcctgtcttttttcactgtttctgttgtaactctggtttacattatgatcttattcacaatttctgcttgcttgatatttcttaattctgaaatttaataatatgcccttcgtcgtgttcccccaacttggttcctgcttacaattcaattttgttatccaaacttctttttctggtcctaactctcagttttgcctgagtgggcactaaaaagttatcttcctcttcctcttcttaatgggcacatgggagagaacacaaaattctaagagctcatatcttagcgtctaattgatacggattaaaatcccaactctacctgggtagcttggtaaactcagaacttctctgaacctcagttttctttgaatagggataataatttctaaccaacagagttactgtaaagatagaagaacatatgtcacaataaacatttagcatactcaacatttagaaaataattgctcttattaaaatttttcccattattactgttgctgatgcaataaatggaaatatttattggagttctgaatatttttgaaatgaatgttttgtaaaatcagacacattatgaactgatatgaaagatgttcctgtgaaagaggaattgaaatgtgaagagtcacaaattttacgctttctctggaaccagaaaccaaacttaaagtgttctccagaactggaaagcaaggggacacataacaggctgaaaagatctgctatgagtgttgttacagactgaagtgaaagtgactgctggttattataaaatgttcctatgacttgtccatattgaaacagaaattataggcagaatgaacaggagggaacacaaattggctcaacctcttttacctggttaagctctccattgtacccaaatttgggccatttaattccacaaatatttattgaatacacactgggtatccagaatgtaaagagtctcaatacggaatgaattttatttttgattttatattttgaaacagtcttcaagttatagttataaatcaaatgggataatcacataggttttcagtcattaaagtaaacatatttttttcatttttttttaatgaacaggatttgctagtccacttactgggatagcggatgcctctcaaagcagcatgcacaatgccttgcacatctatatgaatggaacaatgtcccaggtacagggatctgccaacgatcctatcttccttcttcaccatgcatttgttgacaggttggttaatatttctttataaataacgtgctcattggatttaaatagagggtgcctatcaaatgtgatttaagttattaaataaaagctaagaagttatggtagtctattgtctgtgatcaggttgtcaccaaaacagaccttaggctaagaatttgcatgcaaatgtataataaagaaagtgtttataaagataaattaaaagaaggtggattaggcaggatacaaaagaaagaaaagtaaaataagtgtacaatgtcagttgaaatccaagactccactagatcctggtagaaggtaaagtataccctagtttgtcctaccttaagaaaaagacagatgagtctttgtacttccatgctaaatagccattggctacaggatgccctgaggtaggggatgtaaaactcccaggagcttgagtccagataggctttgtggccccagtacccaagggcagccttctaaaggcttcaggagaaagttgttaagagcaaagaatgaaaaagcaggaggatggacacacagaactgctataggaatttaaggccatgtgggcctggcactaacctactacatctgtcatcaatacatctttccttctggaaattgtattgttatttcttctctttttgaacctaacacactttcatataaggaagtacaaactgatctcttccactggcctgaatagtatatgattaattctccagacagagtgcactatggcccaactgtcctatttaatgtgatttaattctcttggagcttttatttcccttattagccttcttccattacatttgtaatgtcttagatatattaggttttagacttaattgtaggtgatgatagcagaaaagaaagtattcagaggaaggtcagctgtctactcttgaaattttcaagaagaaaggagaaaataaagcatcaaatcatgactgacaaatgctatggagtgttctttgtcccctctacagtaattttctcaccacagttaatgaataaagggcacagatttatacctgccattaagataatactatcatcctcttgggtaaaaataagaggagttatttttcgtgttttaaagataaggaaactgaaactgagaattaaagattttacttaatttaccaaaatcttctcttcattcatgtccacaggaacatggacataaaatcaaataagaaagtgaccattatccaggaaaatcattaggcagatttttattggcttcatggcaactctcatataatgagaattaagtaacagtctgtgttaagttttattcagaaatcagtgtataagaacatgtatgaacaccaaagtgttggtgtcaataccaacatcacaaccacctatacccatacataagagagaaaagcatagtgctggaataaaatgttatcagaaaagataaattgaacgctttttaaagaatcatttttatatcactttttggtgtaaattttttgccatttttaatatctagaactacccagtgaactctaaagatttaagtatgaccactcttgccacctccattcaatatagtattaaaaggtctacacaattagcaattaggcaaaaaaaaagaaaaagaaaaactatcaaaatatgaaaggaagaggatattgtttctgtttactgatgatctgcccttatacacagaaaagcctgagaattcactggaaaactgttaaaactgataaattaagtaaacttgcaagatacaaatgcaacatacaaaaaattagtagtgtttctgtacactaacaatgaactatctcaaaaagaaactaagaaaacaaccccatgtacgacagcatcaaaaaataaaatacttaggagtaagtttatccaagaaaatgaaagatgtgtacactgaaactatacaatattgataaaagtaactgtagaacacaaaaataaataaaaagatatcctgtattcatagattagaaaaattaatgtcgttaaaattactatactacccaaagaaatctacatattcaatgtaatcctatcaaaataccaagacattcttcacaaaaatagaaaaacagtcttcaaattcatacggaactacaaaagaacctgaatagccaaaacaattttgagcaaaaagaacaaagcatcatatttcctgatttcaaaatatactacaaaactatagtaattataatggcatggtaatggcataaaagaagatttattgttcattgaaacagaattgagagcccataagtcaatccaataatttacattcaattaacttttgacaaagatgccaaaaacaatggggaaaggacagtgtctgcaattagtcgtttggggacaattggatatccacattcagcagaatgaaattggacccatatctaacaccatatccaaaaccaattcaaaatgaattgaagacttaaatatagggattagaaattgtgaaactgctagaagaaagcatatggtaaaagttccaagactttggtctgggcaatgatttttttggagaggagccccaaagcaaaggtaacaaacacaaaaatagacaaataggattacttcaaactaaaaatctccaagcgaccaagaaaacaattaacatgatagacagacaacttacacaataggagaatatatttgcaaactatacctctgataaggggttaatattcaaactatattaaaaagtcgattcaatagttagaaaatagaaaaactaattttaaaaattgggcaaaggatgtaaatagacatttctcaaaagaagatatgcaaacgtccaacaggtacatgaaaagatgctcaacatcactaatcatcaggaaacacaaatcaaaaccacaatgagataatattaatgttacttcacaccttttagaacagctattaataaaaagacaaggacaagaagtattagagactatgttaaaaaaaaaaaaaagagggactttaggaagccaaggcgggcagatcatgaggtcaggagtttgacaccagcctggccaacatggggataccccttctctactaaaaatagaaaaattagccatgggtggtggcagacgcatgtaatcccagctactcgggaggctgaggcacgagaattgttttaacttgggaggtagagtttgcagtgagccaagatcatgccattgcactccagcctgagtgacagggtgagacttcgtctcaaaaaaaaaaaaaaaaaaaaaggaaggaattgttgtactgttcatgggaatgtaaattaatatagtcatttgggaaaacatagcagtttcttaaaaaattaaaaataaaactatcatatgattcagcagttccactcctgggcatgtatcgaaagggaaatatatctgaacttccaagttcattgcaacattattcatataaggcaagatacaaaaccaacccaaatattgataacgatggatagattaagaaaatgtggtatatatacacaatggaacactattctgccataaaaaaggaaaaccctctcatttgcaacaacacggatgaacctggagtttagtatgtgaaataaaatgagtcagacacacaaagacagaaactgcatggtctcacttatttgtggagtcaaaagaaaatttaaactcctagaattagagagtagaggatggttactgggggctggagctggggtgggttggagggaagttggacaaatgatacaaaatttcagttaagtataagaagtaggctgagcgcagtggatcatgcctgtactcatagcactttgggaggctgggatgggtggattgcctgagctcaggagttcgaggccatgctaggcaacacagtaaaaccccatttctactaaaaatacaaaaatttcgccaggcatggtggtgtgcgcttgtgatcacagctgctcaggaggctgaggtaacagaatctcttgaacctgggagaccaaggttgcagtgagctgagattgtgcccctgcactccagcctgggcaacagagtgagattccatctcaaaaaaaaaaaaaaaaagtaaattaagagatctgttgtacagcgtgatgactaaagttaatgacaatatattgtattcttgaaaattgctaagaaagtagattttaactgttcttagcacacgaaaagtaaaaagtaagtatgtgaagtaatgcaatgttaattagtttgaattagtcattcacaatgtatgtatacaggcacacatcaaaatactgtgggcttagttccaggccactacaataaagtgaatatctcaatagagacacaaagttttgggtttcccagtgcatctaaaagttacgtttatggaatcaacccaggtgctcatcaatggtgtattggacaaagaaaatgtggtacatttacaccatggaatactataagaaagaacaaaatgatgtccttcgcagcatcgtggatgtagctgtaggccataatctgaagtaaattaacacaggaacagaaaaccaagcactgcatgttttctcttataagtgggaggtaaacattggctacatatgaacataaagatgggagccatagatattgggaactactagagtgaagagagaaggaggggcataacagctgaaaaactacctaatgtataaggtatactatgttcataacctcgatgatgggttcaatcatacccaaacttcagcatcatgcaatatacctttgtagctaacctacacatgtcccccgattctaaaataaaagttgaaaaaaaaaattaaaattaaaattatgtttatactttaatgtagattattaagtgtacaatctcattatgcctaaaaagcaatttatataccttaatttaaaaatactttactgctagaaaatgctaacaatcgtctgagccttcatcaagtcaaagttttgctgggggagggtcttgccttgattttgatggctgctgaatgatgagggtgatggctgctgaaagctggggtggctggagcaattttttaaaataagacaaaaaggaaatttgttgcatcagttgatactttctttcacaaaagatttctctgtagcatactatgctgtatgatagcattttacctatagtaaaacttcttacaaaattggactcaatcttctgaaagcctgctgctgctttatcaactaggtttatctgatatactaaatactttgttacaatatcaaaacattcacagtatcttcaccaggagtagattccatctcaagaaactactttctttttttaaccataaaaatcaaatcctcatgtgttcaagttttatcatgagattgccacaattcactcatacctttaggctgcacttgtaattctagttctcttgctatttccatgatatctgcagttatctccaccactgataccctgatcccctcaaagtcatctattaggattggaatcaacttcttccatactcctattaacgttaatattttgttctccttccatgaatcagaaatgttcttaatggcatctagaatggcgactcctttccaaaaggttttcaatttattatgcccagatccatcagaggaatcactatctatggaatatatagccttacaaaatatacttcttaaataagatttgaaagtccagattactctctgatccatgggctgcaacatagatacgtgttagcaggcatgaaaacagtattcatctcctagtatatcttcctcagagattttgggtgaccaggtatattataaatgagcagtaatattttgaatggaattgtttttccagggagttggtctcagcaatgggcttaaagtattcagtaaaccatgctgtaaacggatatgctatcatgcaggctttgttgtttcatttaaacaacaaaggcagagtagatttagagtatttcataatgggagtttcagaccagtaaatgagcactggcttctacttaaagttaccagctgcattagcccctagcaagagtatcagactatcctttgaagcttaatcctttattatcctttgagcattaatttctccttagtagctgtgaaagttctagatggcatattcttctaatagaaggctgttttatctacactgaaaatctattgtttagtatagccaacttcatctaatatctaaatcttctggataacttgctgcagctttccattgcacttgttgcttcactttgcagttttatgttatgaagacttctctttccttaaatcttgtaaaccaagctttgccacctcaaacattgtttctgcagcttcctcacctctttgaccctccataggattaagagagtcagagccttgctctcaattaggctttagtttaaggaaatgttgttgctggtttgattttctatccagaccactaaaattttcttcatatcagcagtaagactgtttttctttcttattgtgtgtgtttactggagtagcactttgcatttccttcaagaacttttcttttgcaattgcaacttgactaacttttgcacaagaggcctagctttcagcctacgtgagctttcaacatgccttcctcactaagctcaatcatccctagttttttatttaaagtgagagacatgcaactctttctttcatttgaacacttagaggccattttagggttattaattggcccaatctcaatatttttgtgtcttggggaatagggaggcccaaggagagggagagattcaggggagtggctggtcagtggggcagttagaacacatgcatttattaattaaagtcacctttttaacattggcactgtttgtggtgtcccaaaacaattaccatggtcacgtcaaagatttctggtcacagatcagcataacatatacaataataatttaaaactttgtaatattgcaagaattaccaaaatgtgacagacataaagtgaacacatgttggaaaaatgggagtaacacacttgccaaacaccaggagtagattccatctcaaggttgccagaaaccttcaatttgtaaaaaaaaaaaaaatgcagtatctgtgaagcacaataaagcaaaccacaataaaatgataacacttatatttccaaacataaatagcttataagcagatgaaaaaatgctcaatatcactaataacctgtgaaatattaactgaaaccacaatgggatatcacctctgacttgttcaaatacctcttatcaaaaagataaaagacaaatgttggagagggtgtggagaacacggaacacatgcacatttttgggtgggaatgtaaattagtccatggaaaatagcatggagcttcctcagtaaactaaagatagaatcatcatatgatccactcattccacttctgactatatatcaaaaggaagtgaaatcagtatgtcaaagagttatttgtacttccatgtttgttgtaacataattcacaataggcaagatatacaatcaaactaagtgtccataattgggcaaatgggtaaagaaaatacagtatatgtacacaatgaaatactatttaccatttaaaaagaaattctgtcatctatcataatatagacaaacctggaggacattacattaagtgaaataagccatgcacagaaagacaagtaaccacataatctctttagatgcagaatctaaaaaactttgaactcgtaggagtaggaaatagaatcgtagtatcacaaggtgatgtgcaggagtggaaggggatgaatagggtcaatgaaaatgttagttgaagggtacaaagttttagttagacatgagaagtaagttctactggtcttctgcacagcatgatgattatagtaaataatgatatattgtatcttttaagattgctgagagtagattttaaatgctcttaccacaataaaatgataaatatgtgaggtgattgccattttagcttgatttaatcactccacaatatatacatatatcagcatcacattatgccccatacatacctgtaattattatttgtcaattaaaaataaaatttttaaaagtgtcaatttgtctagatgccttgatgtttcccacttgtttttataaataaggttttattggaacacagccatgatattcatttacatattgtcaatggatgctttcgggctacaatgtcagagtcgagtagctgtgaccaagaccacgttgtttgcaatgcggaaaatatttaatagctagccgtttgcagaaaaagtttggggatccctgccaaaccacaaaattccatacacactcacacacacatacacacacacacacacacacaccagacaagagaaagaggttttttctgtagcccacctatatttaaagaaagtactatcattaaattcaatgtctgtaggcatgtttgtttagtagagagaatgtcattctgtagatatatagctgtgaaaagccactctgcaacctttgaaaattagaattttctgctcccttagaattctctattaattctattttactattagacatttgcataattattaaaataactcaaaaatattaagcaaagatcaaggtaatttctgagcctttgtaacaaagctgatgaagattctgatgattcaattatcattatacagaaagctagagaactgtgggttaccacagaatattgtgtggcatctgagccatcctctcaagttgctacctatgaagactcatttttccgatcagacaggtctattgactgccattcaattatgcacaaatatatttattggcaaactatgtactgagtgtattttcttaaacattccacatttattcctatttctgggctctgattagaccattcctcaaatctgtagcctacttttcttgacctatctagtttgtacacaaacttcaagactagtttcagttttgacctcctccataaactatgcccaggtcatgtctgtctataactatcactccaaaatctaattatgaataccatttcccaacttggcattcagtgacctcaggtcggtatcctgaaatcagccatggtgagagtatttacaccatgaaattggcaaatggtacacgtcagggcttttattccaaaagacctagttgttaaaataatggccaacacaccactgctctaatctattaactcacagcacattctttctatgtcccttattttggacacatcaattatctttttatttttatctcctcatctgttaactgttttcttggctgcaggaagcttttttgtttaatgtaatcctgtttgtatattttttattttcgttgcctgtgctttgaggatcatttccaaaaatattgcccagacccatgtcatggagcgttccccccattttcttctagcagtttcacagtttcaggtcttacacttaagtctttaacccattttgatttgatttttatatatggtgtgagataagtgtctaatttcattattctgaatgtgactatccagtggtctcatcacaatatattgatgagcctatccattgtgtatttgtggcatctttgttgaaaatcaatcataaatgcttgactttatttctgggatgtctattcttttccattggtcaatatgtctgtttctatgccagtactattctgtgataattactacagctttgtagtatattttgcagtcagatactgtgattctcctgctttgtttttattactcaagattgctttggctattcaggatcatttgtggttgcataaatattttagaattgtttcatttctgtgaaaaacatcattagaattttggtagggattgcattgaaactgcagattgctttaggtagtatcaacattttaataatattctttcttccaaattttgtattttattatttttatttatttatttatttatttttgagacagagtctcactctgtcacccagactggagtgcagtgacgtgatcttggctcactcccacctccacctcccaggttcaagcgagtcttgtgcctcagcctcctgagttgctgggattacaggcacacaccaccatatctggctaatttttgtatttttagtagaaatggggtttcaccatgttggccaggctggtctcgaactcctgacctcaagtgatccactcgtctcagacttcagattgctgggattacagtcttgagccactgctcccagccaattcttccaatttttgaagaagagatatatttcagtttatttgtatctccttaaattcctttcatcaatattttatagttttcagtgtatagctattttacttccttgtttaaatttattcctaagaatttttaaaatttttatttttaattaacaactaatggtatatatttagtaagtacaatgtgatgttttgatctatacatttttgtgatgctattgtaaattgattgtttccttcactttttttggatagttcattgttagtgtatggaaatgctactgatttctgtatcttgtttttgtatcctgtaaccttactgaagtcattttttaatttttaatagaattttagcagatttcttagggttttcagtatacacaatcatgtctgcaaaccgggaccatttaatttcttcctttctaatttggatacatttcatttctttttcttagctaattgctctagctaggacttacagtatttgttgattagtcatggtgagagtgggtatccttgtcttcttcctgatatgagacaaaagaagttctactttttgccatgaagtatgatgttagcattgggtttgtcatatatgcaaactttattgtattgaggtacgttccatctatacctaattttttgagagtattatcacaaaaggatgttaaacttgttgaatacttttttctattaatacagctattaaaatgatcatatgatcatgtgatttttcacaaatataactgtgaaatttgtatattaactatccttgcatctttgggataatccctcttgatgatagtgaaccagccttctgttgaattcactgtcaaattcagtgttttagtattctttgaagagttttgcatctatgttcattaggaatattggcctgtaattttgttttgtcatactctcctagtctggctttggtatcaaggtaaagctggccttctgaaatgagtttgaaagtattctcgccacttaaatattttggaagagtttttgatggatttgtattagttctttaaatgttggcagaacttatctctgaagccatcaagtcctaagcttttctctgatggaataatttttattactaattcactctctgtactcattattggtctattaagattttctattttttcatgattcagttttggacattgtgtgtttcttggaatttatctattttcttctagtttacccaattcgttgttcttagtagtctcttatgatttttatatttctgtggtatctgttgtaatgtctcctctttcatttctaattttatttatttgcatcttcttttttttcttattctggataaaggtatgtcaattttgtttaccttgttaaaaaccaactcttagcttcatttatcttttgtgctattttcatttacttcttctctgatgtttattatttccttccttctgttaactttaggcatagtttgacctttattttcagttttttgaagtacagcattggattatgtatttgaaatattttttgttaatgtaggcatttattgttataaatatccttcttaaaaatgcttttgctgcatcccataagttttagtagtttgtgtttccattttctcttctctaaaggttttaaatttcctttttaatgttttaattgacccatttgttgttcagaaacatatttttaagtttctatgtatttgtgaattttttgaaattctttctattgttgatttctagttgcataccattttggtcagaaaagatacttgattatttcagtcttcttaaatttgttaagacttgttttgtgtctaaccatatgatctatccttatgataaaccatgtgtgtgacaataatgcacattttctgttgctgttagaatgttctgtatacatctgtcgggtccatttgatctaaaatgtggtgtaagccctatgtttctctattgagtagggtggggtggagggagagcatcaggatgaatagctaatgggtgctgggcttaatacctggttgatgggttgatctgtgaagcaaaccaccctggcaaacgtttacctacataacaaacatgtacatcctgcacatgtaccctgaacttaaaatgaaagctggaaatcaaaaaataaaaataaaaataaaacataaaggatccaattggtaaaaactatctaaaacctatcctatcacctaaaaaatattcagaaaatacaaaaagtggagaaagaaacaaaataacaaaattaatgatatttcctttttgtgaaatttctatttacttcctttgctattttatattacattttggttttattattgcattgtataggttgttcacaatttttaaaaattagttctttttgtcataaacattataaatattttttggttattatcttttaatgttttaatggtacttttttgctattcagaagttattccttttcatatggtttctttttaattcagtcatttgttcatggctttaaggtcatgaacatttgtttcttatacagtagtactatctgtaaaaagagtgaattgctctaaatctctaattttctttctggactttgcaactggataatctctttttgaagaaatgacagtaatacattagtacagttgcaggtctttattgggatttttagttacagcttaatcatgcttttagttatgattaataggtaagttacaaatagagaagttcaatttatagttaaaattatttttctcctctattcagtttaaggtttgacaagggactctaagctgttctcaggtttgtaaaaacaaacaaacaaaaaactttctggcgtggatatggggttgaaaagtttgagaaggttgaagactccaaaagaaagaattggttgaagagttgtttattctgtttctacacaaacatcagatttgggaaaaactaaagacaagggtatctgggtcattaaatcagcctaacactacaacagccatcaagcaaagctgatggtgtctgtaaatgctcttcaacttggatggtgggagagggtgtagaaagcatgaagaactatttaagaacatactaagttccaggtcttgtgacagaaatttttcatatgttacttctacagatgtgacctgcctcaggaagaaatgtctgcctcatacacttaaatttaccctcgtatgtactcttgtctaccctgtggatcctcctcatgctgtactctgcttacttgcctgttttcttaacagtgttcaccattagttctgcattgatcatatctagtttgttcatagttttattgctaggacctaacaaaatgtcaagaaatacgatatgtgtctgataaatatttaagccctttaaatattatattcaatcattcattcatatttattaattcaatgaatctattcactcattaattcatttagaaaatacttattgagctcctgacactatactaggcaataggttatagcagttaacaaaaacctcaaaagcttaagttattatcaatattatttcagttaattcttacaattaactaaaattgtatcactacaattatataaagtattgcagtccatttgtatagatgttaatataatttaatatattaatatattttatattatatattactataatagatattatatagtacattttatatactatataatatagtatatactatacatatatatatttcatattaatataatagtgaaattgtctcactacaattatgtaacgtattgcagtccatttttatagatgagaagactgaagataaagaaaaaataattcacttttctttaaatggatactaaaagatgataccacgttttgaacccagattttttgagcaatttaaatcacattatactgtttccaaccatagattatatcataaatattttggcatagtgaagagcatggaaagagtcaggttggatacacttctgaagaagataaagatatgttattatttcagagaaagatgagtgtccaggataaaatttcagaaggggcttctttggctctttattaactttgttttttgggttatctttgtttgtttgttatgttttttgagatggggtctttctctgttgtccaggctggagtgcagtggtgcaatctcagctcactgcaaactccacctcccgggttcaagtgattcttcttccccagcctcctgagcagctgggattacaggcacccaccaccacgcccagctaatttgggcatttttttttagtagaggcagggtttcaccatttggctaggctggtctcaaactcctgacctcaggtgatcacccatctcggccttccaaagtgctgggattacaggcatgagccactgtgcccggcctctttattgactttatagcacatagacctgctagtgtggaaggactttggtgaaggtggtcatttggatcttggagataaactagagagctctattctgacaactagcatttcagaaatttttccatgtagaacattgtgtcaggagtggttaatggcagtgtgggccaatggaagaaaactttttttacatttagaatctgttaattagtatccctgggagttcagataaataatgtagcttttttgagacttattttcttcatcactaaaatgggaatccctaaagaggtcctgaccaactcagaagttatagaaatcaaagaaggtatgcatctaaaatgctctctataaagagtagggagcatagtgtggtaatgaattaaagagtcagagagacctcgactgagatatgagtcagttaaccactcaatcatggagcctctgctctatataatggatatcacataattccacctttgtcagcgtgttggaagtattttaaataacactcaggtgatactgaataataagatgctacaataattatcattctccaacaatttgaataactattcttcaaaaatttgttattctcaaaagtttgtaggttttgcattattccagagcgggcatggcaaaggaatacagtgctttattggggtttagaggtcccaatcagttgatataaatgttacagggtagtattaatgttttagaagattccgttttattgttttatctattcattctacattcattcaataaatacttatttagcatgtgtgggccactcactggacacttcagcttctgcattcttcctaaacaggcatgttaatgtacatgcaaatggggattccacctatacttataagtcaagaggtagttcaagcatcaccttgtcagtgcagctttctccacttccccaaggtccttactccagtcttttgagtctccaagaatttgggggctaaccttttatgtcaagcttaagacattgtattagaattgtattattatgaattatattataattgtccagtttacctagcaagatcttgaattataatttcaattctcattttatctatcacatctttgtatctgtagttttctgtgctcagggtaattcccagcacacaatgtttaatcgaattaataaagtgtaacaatgtccaactgcagtgtgttaactagcaaactggctaagaaatgtagttgaaatatactctctgctgtcatttctcaaagcattctataaatacatttagtgaactcttgcatacaatggaaaattcagtaaccattaaaattatgtgtatttataattgttgggttttaaaatatttattatttattattaaataaggaaggttatagaataggatatttaaaaatattccatttcaaaagcatatgcatgtatattcaaacgcaaatatatctattaatagaggtgagaagggtataaaaatgttggtaatggacccctggttggtagaattatgcataaattttatttcctttgtgttttacaaattttaaaacttttttgcaacagatatgtacatttttgcaataatatcaaaaatagaggctatttccaaaactgcacagataaataagcaaacaaacatacaaaagggtagagagggatattttatcatttgcctatactcttaaagttgcttaaacttgtgtttgtttccttttatctatttttattaaagtaattactggtgactcatattttacagaattatctctctcatagattgattcaataaagagatctactaggcagttgagctccaggtcctgcatttttcctgacatactctgtatttctctctgtccagctccagcttctgaaatgccctctcagcttagcacggcctgcttatggcgagaaccatgtattcaatggctcctccttatttctgcaagtcttcaaattctccttttggtaattctctgcatggaattaactcttgcaaatccatgtctcacttttgtgtgacctattttgtcttatgctacacattgtccatgttttagcagtagattggaagcttttatgtgcatagccttcccaagaggaaagtaaaaggttggtgctagatggtgcaccttcgataaatgtcagaacagcaaaaaaagggctttagaaatatttccttctttgcacattcccattcaagaatggcttatacagaaaaaaaacaagcacacctctgcacatatgcattccttcatctgttaattcaactaacattaagtaccctttatgtgtcatgtgttatattagaccatggggatgaagtgattactaaatactattattctccaactagtttcctcgagggcagatatgtcaacaactaagtaatgtaaagcaaaacgtaactctgcagtaatagtggctcaataggacaggatatttggaagtgagaaaaagagcaccaaagaacggggaccacaggagtagtcctctttaacccctgaatctgcagcacctatcactatgcctagcataagatagtcaatgaatagccgtttgatactattgtttggaatacaattttatgactggtggttctgtgaagaatgagtagattttttacttgtgacatttgtgtgtaaaaacagtcaatatatagagaacaaaacaaaaaggtgtagaaatatgtggttgaaagaaacttcagaaaagtcaatagttacaacattacaaaaatactaaaaacaaaactaaggtttattgtgtgcttactacacaccaaattctaagcgcatcacatgaattgactcattcaatcaatagttacagaagaatagactgaaattccgagaggttaagtaaccagtactaaatactgtttcataaagggtttagatggaggcttaatagaaggaaagtgtatattggatatagacaaagaaagtatactcttcctccaacaagggagcaggaactatcaggataagggattattttgaacactagtcaagcagtgcagttactgctgcaggaggcattccaagcaaagcaagttgataaaaaatttagcatgctcagttggggcaggcagacagggaaatgaggattaagaagaatctggaggaacaggctgggcgtggtggctcacgcctgtaatcccagcactttgggaggccaaggcgggcggattatgaggtcaggagatcaagaccatcctggctaacatggtgaaactcggtctctactaaaaatacaaaaaattagctgggcttggtggtgggcacctgtagtcccagctacttgggaggctgaggcaggagaatggagtgaacctggaggcggagcttgcaatgagccaagatcacgctactgcactccagcccgggcgacagagcaagactccatctcaaaaaaaaaaaacaaacaaacaaaaaaaacaaaacagaatctgaagaggaacaaacagtgggccaaaatttaagggtggggagatgtgccatttagcatgctcagaagcttgggccagcagttttaactgattcttaaatactccgatgtggctggggctcataggagtcaacctgactggacaggcactagcttaggaactgagaccgaggtataaaaggcaggacatgacatccaccactaaaactcacagtctagatactaaattctaactgtgaagaggaatcctgtagtggaaggatcatgaaacctggagtcagaagttccgtgattatgtcctgggtctgcttcatgcttcttttgtgtgatcttaggaaagttgcagatctccaagcctaattttcctcacttacaaaaaggcagtaataatactactttcctcataagaacctgagttcatactttataaactataacacattaacaaagactagctcctgtaaagagctaaagtataaggggcttaaaaaaatattcaatgcttttgttctttactcactgtactctaaatgctctccagtattggcatcacctcactgattctcccttagcgtgtctcttaaatgtgtaggaatctagtttaggtgcaaacctgaaacaatacattccaggaatggccagcctgcctccctccttagctacagattaattacatcttctggagtgacattttggctgtattttccagtgaggcttctcttctactctactccccaagcctccccttggccatcctgctaagaagactgtcctaacccacatgccttcaaaccagacgccttgccaacttggcagcccagaaacagtccaaccagaagggcggcagtaagaaaggtccctggggcttcaggaatgaacagcagattgcttccctgctggtgactgcaaggctgaagcttgctcagaaaggcagaaatctcagggttatgggggtaggtaagcttggaaaccagaaaaatgtcttaaagtctattctagcaatcagatgggatggcagaggaggacctatctgtttctgggtttcttttcacactgttggattgtgaccagctttaaaaactgctccctgatttgttctctaaagcagaattaatgccctagaacaaagagcggttataccattatagtcatatttgtctatattctgacagctgtttttctttttgatgttattgttagatttagctcttataccactctgtgcttgttagactgattcatggtttgtccatctctcccactaaatcatgggttcgtggcagacagcatctatgtatcgatcatttttagcacctagcacagaacctagcacataggagacattcattacatacttattagactaagttgttgtataattgataactctgaggcaggcaggcatcgactgggttatcagtagcattttgttgtggagtgaaatattaatctaagagagttgaattgctttctatcaagtgatgaagacatcatgtactataactaacaacctaaagaatgttcctacaacaatgtagctgctctttgtaggattaatatattctagtactaggaaagttaaattgcttaaattaaaatattgataacttaaaaagcttaaaggcagggggaaaaagaaacatgacttgtcattattgctgaaatcttaaagagaatttcaagatcataattcaaattgtttattttacaaaaaaggaaattggggcccagagaagatgatgtgcccaaaggcacacagttttctgcaaagcggagggaagagtgtcaacctcttgccctgcagattaggagatcctgggggcaatgtggaatatactcaacatagcaggaggatatttaggcagacagaagcagcatgactgtaggatagatctttaccataattatttcgagagccaaatgtcagacccactgaaatagcaccaaatatcagagccaagggatgaacagagctctaaagtaaatcaaaagcccagaaatcaggagactaagaggcagtaaatcatgtgattaagatcatagattttagcatcagacatgcctcattttgaatcccaaacctgctacatctagctacataatctctggcaagctgcttattcttccctaagccttctttttctcagccataaaatggtgctaatatttgtagccatctaaagttacagctttgatttttagtatgatattgtgaaaatatatatgtaacaatgttcttagcacacaattactagatagacaaggaacttgctattaaaatatttgcattctagtgaggagaaacataagcaaaccagaaaagaaataaataagcacaaaattcagttaagcactatgatgtgatataatatctatatattttataaagaattacttgggagaaggttccagttgagataggctacctatagctggcttctctgaggaaatgacctgtaatttgacactgagaccacggagaagaggtagccatagaaatccctctgggacaagatttttaggaagcagaaggcacacatttaaaggtcccatggcataaaagagcttgtcttgcttcaggtttggaaaggagactagaaaagctaaatacggtaaacaagaggaacttggtgcaatatgagattgaagagatcagcagagatcaatagagccctaagtacagtatagaggaaagagtttaaattattttaatccaggtgctgaaataatttttagattgacatttttaaaagttgtcttggctattgtgacaaatagactgttagagtgaaaacttcaaaagtgacatggattactctattgcattggtctaaatgagaaatgatggtgatttcaaccacagaggtgacaatggagctattgggaaacagaaaaccgaaccttatgtatttcagaggtaaaaccaacagggcttgttaatggactatgtgataatatagatgtagttagtaattttaaaaataaagaaaaaagagtaatcaaagattactccaataattagaagcattagagagaagagtggagatgtttactgaagtagaaaggatgggtaagtaataaatttagcaaagaaaatgaactaaagttctctttgaacatctttgggtctttttaggatagggcaaatagatacccgaaagaggctgccaagtagtcagttgaatcttggagtatcaagctcaaaagagagaaccaggttagatacatgtatttggtagttttagccttatctatttagcattaatcacttcgtgttatttaatcatttaagttttaaaacttaattatttagcattatttaaaatcaatggagtgaatgaggtcacagaaattgagtataaacacagaagaaaaggaagcagtctggcataccccatcattaaaaggatgagccgatacagatgagtcagcaaaagcaaagaagacagagggtcattgaccagtgaggaagcaggaaaaaaaggacattaagccacaaaagccatgtagccaaaaaaaaaaaaaaaaaaacagtggaaaaataaatcaggtactcttaagagatccataaaatgaggagagaaaagtacttgttgggtctgaaaacacaaggatgatcatgcccttggcaacagaaaagtttcagtagaatggaagcttcgggagccagactggagcagattctaaacaaaacttttgaaaagttttcacaaaataaggagcatttttaagtgggaagcaggaaagaggatatgaacaagaaaggaggatttgagatttcctttttaagagagaggatatgtattagagaatgattatatgttgttgaaaatgaaaacattcagagaaagagacataggagaaaaaggaaaaaattgccacagcaaggtactggagatgtgaaatctaaagcccaatggagagaggagcctttgccatgagttggaaggaagcttccttcatgcctgaatggagacacaagatagagtatagatgcatgtattgttcttggacaaattagggtgtactgatctagttatttctattttctgattcaagtgtgaagggaggtcatcagttcttaaggggctgggggctgactaggagaataagaattagaaaggaagagtttgtgtaagttagagaaaacaatattagacaaatcatccattatttatgtcattaaatatatcagtggtctgaatttaggaagcatgttggtctggacaacaggaaagaactatagtgtcatgagtttcattattatctgcttgatattacacaaggcatttccatgtaaccatcctctttaatccttaaaaatgaatattaattatttccttttttaaagtctgaaggcggaggcaaagaaagattaaataattcgcccaaagttttagcactattaattgactaaaattaggactttgactcacttctgtcttactttaaattccctgtgttttgattctgtcattatatcaattaggaagtaactgataatcatatcaaaaacattatttatagggtggtatattagttttctagggctaccataacaaaataccacagactaggtggcttaaaaaacataaatttattttctcacaattctggggactagaaatccaagatcaaggtgtctgcagggttaatttcttctaaggcctctctctttgacttgtagatggccatcttcttgctatgtcttcatagggtcttccctgtctgtgtgtctgtgtcctaaacttctcttcatataaagataccagtcatattgcattagggttcaccctaataaggtctttaaaaactttatcttaaaatacactcacattctgaggtacttgggattaggacttcaacatacaaatgttgcagggaagcaattcagcctgttacaagtagtgagaatgaaagtcaaacagtagtggaataatgacagacttgacgttgaaaatgttaaatcagacctagcttttaaaattgtgatgataaaatagagaaataagaaaacaaatcatttgaagggagcaagaattaagaaaatagtattttagaattttttttattttaagatacaggtgactgaatctatagtttaagtgaaatttgctgaagaaatgagagaaaaaacattaaagcatgttgaaatgtttaaacaggtactataaaacatatgggtttaattccaaaagatattctgtagggaaattatctcagattttcctcaaaggaaaaatgaattaaagaacaataactaatgtataaaatatctataagaaatgctattttgaaaagctcctttaccagattattcataacatatctgtttatcatatgactgtttattaatgtaattttgatgacataagggtttcctgaagtatcaaaacaaatttctgcttgtcggattgccacagcagaaaacaaataataacatgcatggacaatacaaatgttatttttatcctaaagtaaagcatgcccaagatacatcttgttaagtacaaaatgtcacaacaatctagaataacaataaggataagaatctgttgaatactcaggaaagaaatattactaaattcaaaaagtcaaagaggaaatggcagctgaaagttttctgtagctgtgtccttatacaaagcatatttattgaaaggaaaaaagttttgtttctgtttttttagaaaaagtgctttcccaagagaaaaagaagcagcacagctcctgtacgtcaggtaaaaaaagtcaggagaaaaagcttcaagattcacatgatggggtattcttttaccaaaccaggaatcaattgctttggagaacggaaataacatttttgaaatcccttaacaccaatgatccctgttctgtgaggtgccttgatgctaatcagacagttgctcatatcagttaaatcattgaaatgtaattacctctagtactcagtgttgaggtatggaggtgagggaagcaggccttgagaaaagcccttactgtagtagtgtcactcttaagttgcgtcgccttcagttatgccatccccatatatttccttttatcctcactacaaaatgaggacattggcttttctgatttccaatgtccttctattttttcatgttctatgagtaaggaagatatttgatttatttttaagatattttatgtgcaattcttaaagttgatatatggctttctgttctagtgagatattagactatgagaatctgaaaattcccttgagacgatcagtaccaagccagaaaaatataataggaaaatttattttacatgcatatctatctctcagaacagtaaggctaataagattcagaaagaaaaaataaattaaaacaggagtactgatctaggaagctggcctgtaccttaccttggctgttggggttttggtctcaataacctagggcataagattttaaagtccataatggggcagaaatgaaagacttgagcccacccaaggctaggatcaaaatgtccacataaatcaaagaccctagaaatctgtatcattcatgaatgagtatagtagaaaaacaaaatccactacaagtcaaaggaagattttagccttcaagacctggatagtaaaataattccctgaaaaattagaaacctggtgcttgcactccacataagttttgtgttttgaaattaaacaaagtactgattcagaaaaagcaagtgcaaaacctctgaaattaaaacaaactaagaatttcaaggaacagattgattagaataactggaccattgtaaactagggagactgtacaggagaataagatcggggacgtaatgaggctccttgaggatcattttaaggagtttcatgcttcaacatgaaaaggaaagcaacattcaggaaatactcctttgttatgtcatttaattatagaaacagtctcatacagtcatttgtttttaaaataaataaatagagtattttgaaaaagtgcttctgaagtacaaagtggttaagtggtaaattgaatcacaatctgatcccaaatccaggttaatttctctatattacatgactttatttcttctttcacatagcaagcaaattagtcatacctccaaatttaaacttcagaattctaacttatttcagctggattagaatttctcttaattcttatgctctctttctgtacttgtcaatgaaagatcctttcactttcttcctttatagttaagtcagtacctattgcaaaagtagacttcttagcctataagcattgcatacaggtgacaagaatttgccaactacaaatgttaactgcttgaagagttgtttttcaaatatctgtttttattgaggtatttatttagtattgttgagttctgctcttacataatacttcgtttccaggtaacacacagccctgccaagtattggtatctaggtaatgctgaccattttaaatgaacgtttcaatattgagtctacccatccacgagcatggaatgtgtttccatttgtttgtgttgtctatgatttctttcatcagtgttttgcagttttccttctagaggtctttcacctcgttggttaggtatatttctaagtaatttattttattttatttttgcagctattttaaaaggggctgaattcttgatttgattctcagcttggttgctgttggtgtatagcagagctactgatttgtgtacattaattttgtataacgaaactttgctgaattcatttatcaattctaggagctttttggaagagtcttcaggtttttctaggtatatgatcatattatcagcaaacagcaacagtttgacttcctctttaccaatttgtatgccctttatttatttctcttgtctgattgctctggctaggacttccagtattatgttgaatggaagggcgagagtgggcatctttgtcttgttccagttctcagagggaatgcttttttcttttctctttcagtattatattgactgtgggcttgtcatagataggcttttattacattgaggtatgtctcttgtatgccaattttgatgaaggttttaatcataaagggatgctggattttgtcaagtacattttctgcatctattgagatgatcatgtgatttttgcttttacttgtgtttatgtggtatatcacatttactgacttgtttacattaaactatccctgcatccctggtatgaaacccacttgatcacggtggattatctttttgatatgctgtttgattcagttagctagtattttgttaagcatttttgtatctatgttcaccagggatattggtctgtagttttttgttgttattgttatgttcttttccggttttggtgttcgggtgatactgtcttcatagaatgatttagggagaattcactctttatcttgtggaatagtgtcagtaggattcataacaattctttgaacatcggatagaattcagctgtgactgtgtctggtccaggaccttttttgttgttgttggtaatttccttaccatttcaatgtcgctgctttttattggtctgttcaggctttctaattcttcctgatttagtctaggagggttgtgtatttccaggaatttatccatctactctaggttttctaatttatgtgcataaagatgctcatagtagccttgaatgatcttttgtatttctgtagcatcagttgtaatatctcccatttcatttccaattgagcttatttggattttctatcttcttttcttggttaaccttgctaatgctctatcaattttatttatcttttcaaagaacaagctttttgtttcatttatcttttgtatttcttttgtttcaatttcatttagtcctgctgtgatattggttatttcttttgctgggtttgggtttgttttgttcttgtttctctagtttcttgaggtgtgaccttagattgtctatttgtgctttttcagactttttgatgttaaaggttgtaaaccttcctcttagcatcacctttgctgaattccagaggttttgataggtcgtgtcactattattgttcagttcaaaaaatattttaaatttccgtcttcatttcattgttgatacaatgatcattcaggatcaagttatttaatttgtatgtatttgcctggttttgaaggttccttttggagttgatttccaattttattccactgtggtctgagagagtacttgatataatttcaattttcttaaatttattaagatttgttttgtggcccatcatatgatctatcttggagaaaggtccatgtgctgatgaatagaatgtatattctgtggttgttgggttgaaagttctgtaagtatctcttaagcccatttgttctagggtatagtttaaatccattgttttttcattgactttctgtcttgatgacctgtctaatgaaaaataaattaaataaataaaataaaataaaatgaatgttccttcctcttttagttttaggaagggtttgtatttaattggcaatattcctttcttaaatgtttggcagaattcaccaataaagtcagctagattagaaattttccttgtagaaaagatttaaaattaaaactcaattggtttaataaatttaatgttacccaaccaatctatttcttcttgaatgaacattagtagtttgtggttttcaaagaagtagttcattttgtttaaattgtcaaattagtggtatacaataattcataatgtctacttcttatccttttgatatctgtaggttctgtagtgatgctgctaatttattcttgttggtggtaatttctatctcttctaattttttataaccagcctaattagacctttgttcattttatttgtctttttttaagaggcagctttagtttacttgattgtctctattgtttttccattatacatttcagaaatttttgatatttattattattattacttgctggtctagtatcttctgacaaaataagtcacatattttaattaaacagtggcattttacttctgttctcatctttgacatcattaaactgccatatattgttcaaaaattttacatatggtttgttatagaatcagggtgaaatatgagtaataaagacaatgacctatatctgcacatgtggctaatgagcacgtaaaatattgttaataaaactgaagaatataattttaaactttaatttaaaatcgggtatttgtttgttattgaaaaacttacaaatatttttagagcaacttggatgtgtgaacgtaagttattgcctgtaaaatgtatgaattctaaatacacacgaagtatttctgatactgtcctatgtcatatgccttcaatatatactctataattactaggtttttcttaactttgtattaaaaaaaatcacattaacccacattcgactagctataaagaactttgttttctatagttttatacaaaatgatagaggtatgtgtgtgtacttgtgtatatgtgtgtgtgtgtgtgtgtatatgtgtgtgttcatgtttcatattagtcaagattcaatgagaaaaaacagaaacaatgctagttgttttaataatgtcagttgtttatataataataaataatagcttaaatagatatttgaaaattcaaaagtggaaaaaaaactgaaaatgcctagagataggcattggaggaagcagtaccactcctaggactgggtaaaaataacaaagtagtaagagatattagaatctaatagttttgggaagggcttcaaaaacctgaactcagatttctgaagaggggacactgtttatttagtagtgatatctcatatcacctgacattgaaggaggagcctcacagggcagtaattcaaactcctgagtaggaggctttagtcaactggtactgatagctcatgagtatactagtgctctacagaactagatctcagatttttgagcagagagggatgtaggggtgtgagggaatggggaatacggcctaaagcatgttgaaacttcttaagaggaatgataatgctgattcttggtgtgctgataagaaagctagaagctagactctactgctcttcctagggtcaagaacagtcactgaaataaacaagaaggaacaagtcctttgctgttctagcctatatgtagtgtctatcaggggttcaactagcaaaagagaaatgcagcttacacattctcagccccagtatcccaaagtggaatgtagtaggacatcgttggggctggaaacaatagcttaaaaactggcacagtccacctcttgtctatcaggcattgatacacatttaccctcccatacataggtaaatttcacacaataacaataacaaacttaaggtatttttttcaaacgaagattatttcattctatcttcatgaagaggtaactaatgtcccaaaagccatttctgattaattattcctttctgattaatagccatattatccgtctctgggagatgttatataaacttcaaattttgtcatggtttatataaacattctgtactctaaagagggaattataagattaaatatcgttgatcacacatatgaaataatgagacatgaaatgttaatatataaaaatactgtatatgtatacacacagacagacacaaattaggttatatgtgaaaacacagaaggaccaggaaagaaaagatgcgtagctgctgcagacctcattttatttatgtattttttttactacccattaaatgttatatttgcactcagccagcatttcagctggccaacgctctctacctatcaaatgactcaaactttctttcccagagaatttgaattctgagtgattttcacctttctttggttactgtagtcttccattaaattattgaacacagaaatgctaaaaattcctcaaagaaggccttgaatttcatgcatatagtctttcctgcactactatgtagcaacaccccaaaagtatcttgagaatatggatttttttaaaaaaatcatgttcttcataaaacttaacaatgtgaaattgtgttttggtgcaaagtcccaaaagattgtgctaattgattccacaacacttatttttatgcctttaaattcatgttgaaggtgtggcattatgacaatggagtgattgattgctatggtgaaaggcggaaaattttcttctcaaatggattctatctgaacacagatgagaaactttttttatgtttcttttaactatttataatttgaggaattatgacacctgataccttgaaagtagtgaaggagaaaaattgtgtttccatattagctatctatatcaaatcaggcaagaacaaaaaagaaaattgattttttttttgctagaagcctgatggatgtaacaacttttcctcaaaggaaaaataaaggaaatctcttattacctatatggcaacatctggccaaatgaaaatgtgcaaaaaaaaaaaaagtgaaataagttggggctgtttctggctcagtgtgaagtatgaaaagattttaaagttaggtgttagattggaaaaaatgaggatttatgatcatcttctttgacactttttataatgtgcatcatagaatatatgagaaaaaattcccatgaaattatgaagaaacagatatgataagtggacagatattgggtgaatttaagaaaaacaaagtatttttattgtacatttaattgtaaacaatgtaaataggcactggcctgttttctaagcctttgcataggttcaacaatacggctttcttccttccaaaggctgacctatctattcccactatacagggtcaaatctaataccagagaccaactatgaggctctgataaaacaccattccttcagagcagagtggggagcagccagtgcctttgccaccctcactcagctggagttactcaatacattgttattatgtctgtttcatctattttctaagtcatacctaccggaataggtaatctattgcaaaagtatttctcaatccttgctgcacgaatcagtgggtgtctttttttaatacccatgtgcaagccccaaacacagaaattctgaattaacagatatggaagtctgggcatcagtattataatgggttgagaaccattgcattcatgcccaaaatgaatgagtctagaattcgtaacatttacgtaaccacagatgcgctaaaaatgaattctaagaacacgatgactatagcactctcctaatctctttttttacacagcctagacatcttccttgcaagcttagcactttccttctcatactgagaatcaaattctaccctgttgtgtagaatacttggctagaacattagtatttggccttattctttttagtctttttctcaagaaggttgacactatttaaacttctatcactgagaaagtaatgccaagcaggcagactacccaaagctataacctcaaccacctgtttctgaacaatagatcttacgctaaattaggtccctttggaaataacatcaaatattactactctgaagtagcgaatgtagttaggttaaaaaaatatatcagaagttggaaaaaataggaccaagaaataaaatagtaagccaaagtcaaaccagagttcataaaattcctcgaatgttcatgtttagacccctggatcccctttcagaggcttaccctacctaaaaccagaataatattctaggcacagcttacttgtgaccccacatctttccttccaagctggcattctaccaacttcccagcatatctgctggacaatcatcaatgcataatgacagaaccatatgtaacttcttaaaaatacataccactgttgttatactgaatctatcttaattttgattaataatgattccctcttatttaattatattattctttttagttaggagttgatgggcttaagaaccagattggttcttaagaacattgttttaattcctggccctgccatttactattcatgtaactttggacatgttatttcccaggggctatgttttctctgataacaaaagttattcacttgtagatattctttggtggttaaaaagagattgtatatttttagtttatcttcttttaattcaatggaatgagcaaataactgggttaaggcaaggacgtgtgcagtagtttctcatctactatcagacagttttattaccttagacaagtccctgaacttctacttccattgagagtagccactttgaagaataaaatgcaaaaaaaaaaaaaaattaaaaatgaacaaaacctaagagatctgagcaacatcattaagtatatcaacatatgtgtaacagaagtgctagaaggagagaagagagaactgacttcttaccagaaactatgaaggccagaaaacaaaggattggcatattcaaagtgctgaaagaaaatattgtgaccccagatttctatatctggcaatgttattcttcaaatatgaaagagaaataaagaaatttcccaataaatgaaaaactgagagattgcattgctggtagacttcctccaaccatgctaaaggaagcagttcaagctgaaaagaaaggacactaaacagtgactcatccaccagaaaaagtaaagagcactgtgaaagataactgcatagataaatttaaaagactacaaaaatgctctttgagtttgtaacttattttttctatcctatttaaaagaaaatatataaggctataaatccaggttggtgggcatataatgtatacagataaaatgtgggacaataacagcataaaaatgagagcatgctccatataacaggggtccccaacccctgggccatgggctgctacttgtctgtggcctgttaagaaccaggccacacagcaggaggtgagtggtgaagtgagtataacctgagctctgcctcctgtcagctaagcggcaggtgaactgggcatgtgagggatctaggttgcacattccttatgagaatctaacgcctgatgatctgagatggaacagtttcatcccaaaaccatcccttcaacctccatccatgaaaatattatcttctatgaaaccagcccctggcaccaaaaaggttgggaacagctaggaattatgtattcaacacaaaagaaggcagtaatggaagaactgaggaacaataaagaaagacataacatgtatagaaaacaaatagaaaaatgtcaagaataatgacattttatcagccattacatgacatataagtagattaagttctgcaataaaaggacacaaattggctaactggattttttaaaatgacctcaatatatgttgtctacaagagactcacattagatgcacagataggttgaaaagaaaaagatattttatgtaaaaaatattcaaaagagagcttgaataggtatactaataccagacaaaacagactttaagacaaaaattttaacaagtgacaaaagaagacataatataacaataaaaaggtcaattgctgaagaagatacaagaattataaatatgtatgcacttatcaacaaagccacacaatacatgaagcaaaaactgacaaactgaagggaaacatttgcaagtcaactataatagagactttttaataccccactttcagtaagggataggactagaccaaaaatcagcaagaaaaaacttgcgcaatactatatgccaatgagacctaacagatatttatagaacactctacccaacaacagaatgcacatttttttcaagtgcacatggagtattttccaggattaattacatgtgagaccataaaacaagtctcaaaactttgaaaagattgaaatcatacaaggtatattctccaaccacaatggaaaaaaaatagaaactaataataaaaaggaatttgaaacatttatgaatatatggggaaattaagcaacatactgctaaataatagttgaattaaagaaagaatcacaagagatttagaaaatgctttgagataaattaaaaacaaaatataccaaagccatggagaatagcaaaagtggcaatgacagagattttttatttttttttgagatggagtctcactcttgttgtccaggctggagtgcaacggcaccatctcagcttattgcaacctctgcctcctgggttcaagtgattctcctgcctcggcctcctgagtagctaggattacaggcacctgccactaggcccagctaatttttgtatttttagtagagacagggtttcaccatgttggtcaggctggtcttgaactcctgacctcaggtgatctgccagccttggcctcccaaagtgctgggattacaggcatgagccactgtgcctggcctgaaatttatggttattaatgactacattaaaaaaggaaatatcacaaattaataacataaccaccagccttagaaacaagaaaataaaaaatcaaactaaactcaaataagaagaaagaaatagtaaagactcgagtagaaataagcaaaatagagaatacgaacacagtagagaaaatcaatgaaacaaaaagttgattctttgaaaagatcaacaaaaatgacaaacatttagctagactggccaagaaaaaaaaaaaaagaagattcaaattactaaaatcaggaatgaaagaggggacattactattgtctttacaggagaaaaaattacaaaggaatactataaacaattgtatggcagcaactgatactagataaagtagataaaataaattcctagaagcacacaaattaccaaaacagactcaagaagaaatagaaatctaaacagacctgtagtaagtaaagatacaagctactcatccaaaaaaaaaaaaaaaaaaaaaaaaacaacaacaacaacaacaaagaaaatctcaggacaagatagcttaattaattgattttctcacatgtttaaagaacatcaattaaagtctttcaaaaaaagtagagtaggagggaacatttcctgacttactctatggggccagtattatcctgtgagcaaagtcagacaaaactatcacaagagaaaactacagaacaataacacttgcaaatacaaatggaaaaaaaattctaagcaaaatactgaaaaactgcccagcagcatataaaaatgtttatgtcaaagccaaattggatttatttgaggaatacaaaggtggctcaacatattaaaatcaataaatttattataccacattaatataataaagagaaaataaaatcccatggtcatctcaataggtgcagaaaaagatagtacctttcatgatttaaaaaacaaacatgcatcaagctaggaataaaaaaagagctttctcattttgataaataacacctatgaaaaagccacagctaacacatcatactcacttattaaaaactgaaaaaaaaaactcaaataattttcctaatgtaaagaacaaggcaaagatgtttgcttagactacttctgtttcacattgtatcgaaggtttaagccagggccattaggcatgaaaaagaataaaaattgtccacactggaaaggaaaaattaaaactatttctgcagataatagtgtcttaaatcataaagaagctacaaataaacagtttgaatgagtttagaaaaattgcaagatacaaaatcaatatataaaaatcagttgtatttctaaacattagcaataaacaaactgaaaaggaaattaagaaaacaatttcagtaatatcagaaagaatagaatacttaggaataattttaaccaaatcagggcaagacttatatactgaaaactataaaacactattgaaagaaattaataaagatctgaataaaataacaggaagacccccccttgttcacagattggaagacttaactatcattaacatgacaatactttctaagttagtctataaattcaacacaatctctgtcaagtgagaggaagttaaaagatcatgattcaaatgccacagagcctcactgctcttaatgttgtagtagattttcttgaataaatgtttcagcatttgctgtgtacccttagaataacttctagagactttaagtgggggagtattattttttcataattgttactagttacacttgttttgcaaaggagaagatccgtgaagcttctcccactgccaatccagaggtggaaatgcagaaaccctttttaaaaaaaaattcctacactgaatgtaatttcaatatgtaaaacagatacaaatagaactgctctaattgtgattggggtaaagtctccaaagtccatttgggtggcaagttctcaaatatttcacggactccagatgacttatttatcaaaccttggattagatgacagtattcttttttttttaccttttaagttcaggggtacatgtgcaggttgattacataggtaaactaatgtcatgggagtttgttgtacactgttggttgaagtataaattagttcaacccttgtggaagagagtgtggcaatctcttgaagacctaaagatggaaataccattcgacccagcaattctattactgagtatatacccaaagaaatataaatcattctattataaagaaacatgcatgcatatgttcattgtagcactattcacaatagcaaagacatggaatcaacctaaatgttcatcagtgatagactgaataaagaaaatgtggtacacatacaccgtggaatactatgcagccaaaaaaaaaaaacaaacaaacaaacgagatcatgtcctttgcagggacatggatgagcagtgttctttcaagccctaatatttgtgaagtgtctaatatgttatttatatatctaagaactctcctctctcctttgtaaggaaaactgcttttcttaagtgccatttctctttcactccttcaaggaaatctgttcacttttccttatcttctcagtaaatgatatctaagtatttagtgcatacttaattcttttaagctttattgacagttacgtcagttttgagtctaagcccattaggtaatcaggcctctgagaagctcatattttttcaatgagtatacctaataacaacttctaaacaactacagattctcaaatgttttgggcacaacaacaaaaaatgataaattggaccctcactgatgcttttaaaagtaaataagcaaatcataagaaatcagggatatgggagataaaaacaatgattctcactgtccaaggatatataagtgggtaggggaaagccttcaaacaaggagtttactcctttgacctttgataaaaggataagctttgtcagacgggcccaaagaggagcttgctgataagagttgtcacaaccactccacctctcagaattcctctgccttcgccacttggctgtggagtgaaatatgtcttcatagctcctattacccttgatttttcttaactgggcctttctcatttcatgaattttactactaatcacttggagaaaatagataataagtaatcaacttgggattttaatagaaatttcaaaatgttcactatcacaagtccatttggtttatattctggagtcttcttgagatgtttctgagttttctcctttgatgttctaccctctgttatttgtttgttctcagagggggtttcactagtctctcactcttccacaaattgtttgttagcagaagaaataggaatccttttctccatgttatctccctttccatagtggagatttaataaaaataaaataatccattttcctttcttgaaagtggcaattaatatttttaactccagatcgaatgatgctcagatcactagcttttttaagacatactttagtttgtcaatttttccaattggaatagaggattagaagagtagaaaaggaaaaaaactaagaaatattatgtaaataaaaattttggctggagaaggaaataaatggtaagtacatgggaggatatctaactactattttggggcaaaacgcaaagaaaatagtctgttttttagcatttgatcgatcttttcttgggctcctttttccagcagtccagatcatttgttgtgattaagatgtcaggttgtcagcttcagttgaatttgctctctgaagaatgttttacattatcttctttgttcattaggctagactttaacacatcatgctttttcttatctaaattgccaatgatattagtgttattcttgcataaattatttgtgtattggtgttctgtatatttctataattgtaaaccataaatactcttagtcatgcatagaatatttgctgttctttggaaagaagcatttgagttcatagataattcatagagaattttgcttcttttagatggcatctctgtgttcacatattttttactttctttgctttcttgtcttatctacagatattacctctgatttttcttacatttagtatgggccataggtacttagccccatcatatgtattggtcccctgcctctaatccctccaacaacaacaacaacaacaaaatccaatctgcgtaacacctccatataattctttctatgcaccattttttcacacaattccactcttcaaagggcaatagtcttccactgcatatatgttacatacagaataaattcaaatactttgggctgatacccatagatttttgctattttgttcttgctgcccacttttctactattgttttagtctataagcaccaaactaagcactaatttttctcattttctgaagcagaggtggaaacaaaccttgcctgttcatatgcagattatcatgtaggtaattacatgaagattatcatgtagattattacataaagaataattcctctggattcctaccaaaccatgtcaattactggggaggctacaagtgttagagtttgtgtctgaagggccttatgcacaataggaatgatatccttttgtctgggggaaagacttgtcattcaaaataaaggagttctatatctgtacagatagtagatatatgataaacttttccactgtaattctcagaatcaagtgaaatctaccacagttggggagagcagtaaggctattaatgtcacatgaaagttgatgcttagggcttagggatatagtactgggaatatttcagtgaggatgttggaaaccagaaagtattgtctgctatgacaagagtgttgggtatgtgaaagtgtgcctgtactacatatgctcagtttgaacttatttaactgttattaccttgaataatgactcttactttatagcacttgaatacacctttctccatcagatacacgttcttggtctttgactgaagatataaaaatcatataaatgattaaagatataaaaagagataaatagatataaatggtttaagtggctttcttccctgaaaattccttaagggaaggactctgctttctgaagcttttcatctcccattttactacatacatttcctgtacttgcctgtaggtaatagcttgttagtatctattttctgaatatatgttttgaagaaacataatatattctcctcattcccaggggatacttctgaaaaccctctgggatagttacttatcaaatatttattatcaactgtgtacaggcacgattctcttttctatggacatagcagtgaacagatgaagtttttatttgtaatgtaaaatgtcacgtagttttccactcaaagatctttttcaatgtttttctttttcctgattaacttagaaaatgggcaagtcatataggcttactgagtgtatgtgtgtgtgtgtgtgtgcagaatacacaattggaagcacttggtgtcctggaaagtgccaagtacaaaagactcaggtttgattcctactgctccatttactaactaaatagaggaaagttgcctaaaccctcactttttgtttgtttgcctatttttatatgtattttaatgggagtacttttgtacaaatacctcattaaggctaagaacacttatcatatttagactgcaggtttcaaatgttgattctgccacttcacacttactggctgtgtaaccttaggcaagttttatatcccttttgtcctccagttttctcatctgtaaaatacaagtataacatagctcatagggttgttctgaggttcaaacgagttcctgtatgtgaagtactttgaataatacctggcatacagtggtatatgagctaactctcactactgctaccatactacatttcttgcagttttgttggagaaataaatatgatatatatatatatcaaaattctcagcatagcactggatgcatgactgtcatccaataaattgaaattattactgaagcaatcagtcattttttattattctaagagcctcagaagcatcactctagtgaagaatagtagaacaataatgtatgttaaatgaagagaaattttggaagaaagagaggcagcatagccatcttaagaaaagtaatagctatttgtcatatgtagaagttgtcttagtcactattgctcccctggcatactatgatctccactaaacagaagtattacattttgatttattataatttaatataatacacacatccattataatcatagttctaaaattaaaatccaggaacagttacttcttatctaaaccacttagattcaatttaacccttgggatcaagcccagactccccaccctgatatgcataaggcctttcacagtgtgacccacctccacctctctgggctcacttgttgttgatcccgcactgctctacattgcatcccacaccagatcacttttattttttcaattacatcagtgcccagggtccctgtcagtctacgcattctatgtgatacctttcccataatttactcatccaatttaaataccactttctcgtttcccatctggttagctgcttctgctgtaatcccataggctttatacacatctttaagagcatcatttatattaccttaacactttttgtatgtgtttatcacaacatggagagagatcaatgaggatagggactatgcttctacatcactggagcttgacatgtcatgattcttaacatgatagaatatttattgaataaataaatggacaactcagtgaagggagtaaggtaagttttgttatcaccacttcacaggtaagaggggtgaggctttgaaggcccatcagtaattcctactgaaagccaagttaatagcagacctcccatttacacccagcattgtctggaggtctgttaggagacattttctagattcatcttgactactgtggccagtgtggcctggctcattttatttgagtgcaatttctgcctaatgcagtgtatctcaatcctggatgcacattgaattattcatagcagggtgcctgatacttaatgatattaaatgttttttggaaaaggagagaaaaaaacaccgaaactgcctttctttcttaaacttttaattatttaggcctttttggttcttatactaagtttctccaagtttcatcattagtttaagtattttaatctgattttaactgccttactgattccccaagggtttgtttccccttttttcaactaagttaagaacttctagactatatacttaaaattgtagttaattgagatcggccacagttgaatttcttagctatgtaacaggattttcatttgaagctatttattcctgacaatctctactcttaaagtgtggagttctcttaaaggggctgtttttcagtgaaaatttccagatactcctcaaatgtgtttcaacattagccaggaatcaggaggaaatagagctcctgggatgctattatttcaaacccaggtagatgctccaagtttttcccagtggtctcagtaaaagtaggctgtctatctactaccgtgttgctccctttgagctcccaaactcagctgttggtccattgaattataccgtaactaggcacgattatgtcactgcatggcttaaaatcctccaatggctcctcacagcttttaaactaatattgactaattacctttcatgcaaaccctacagtgtctgtgttaaaccacatatacctacagatatccacataatatccttcctttcaatccatctgatctacttgcagggtcccagaagcgtaattcttttccttcatgcttgtgctttactcctactagaatgctttttttccctcttattactttgcctagatctctgctattcattttttaaaacttaagttcaagtgtcaccaaaggggcaccttgaccgacaccactcaaccctcatccaagtggatactaactcctctttctcttttttcccaaggcatgaagggcccttctctgctggcattcacactgtactgtgctgaattattgaccagattttagctctttgtaagacaagcacctttcctcatttggctttctacttccagcactcggtgcaatgcttattacatgccaggcactgtcctaactgatgggggttaatgaatggtacaatctaccaagattcaacccaaagtcatcaacatttcttagatcctttcttctccaagttctgatatctaaacactaaattagtgattcataaaatgtttaaataatttgaataatttaaaaaatttaatcttaaataatttaatcttgaacaatttgaaaaaattttggactctctagggaaaaatatacaattcctatgtattttatatatgatttatgagactttataaatatactaatatgaattcagtctcctggttgaattcatattgtttttaactggcaggcactgtaatggacacaggacatataatgaccaataaggcaatatcattgctttcggcgaatttcccatataggcaaaaaattacacatgatcaaataactgcaatgcaatatgacaaatgtgataatcaaaggaggaatatgtcaactcttaaaagttttcacagatgtagccattgagctaatcttaaaggggcaaaagatgtaggagaatataaaagtttaaagaacccctatggaagaaaaatcccaaaacaaagtatttataattttaataacaataataataacatctatacttactctatgctacacgttactctaattgattttacatacattaattcagttaatgctaaaaacaatcccttgtagtaagtactattacctattggtttcttagggcttccataatacagtgcaagcataactctaagatatggaaggtttggcttcggaccaccacaataaaacaaacattctaataaagttagtcacattaatattttgatttcacagtgcatataaaaagttatatttacactatattgtagtatatttatggtgcagtaacattatgcctaagaataaaatgtacataccttatgttaaaaatactttatgctgaaaaatgctaagaatattctgaaccttcagcaagttgtgatcttttttctggtaggtcagacctctggtaggtctagcaggttgatggttgctgactgatcagggtgatggctgctgaagtttggagtggatgcaacaatttcttaaaacaagaaaaaaatagagtttgctacattgattgactcttcctttcaaaaaatatattcatgtagcatgtgatgctgtttgatagcattttgcctacagtagaacttcttgcaaatatggagtcaatcctctcaaaccctactggtactttattagataagtttatagaatattctaagtactttgttgtcagttcaacagtgttgacagcatcttcaccagaaataagtttcatctcaagaaactattttctttgctcatccataagatgcaacccctcattcgttcaaattttattatgggattgaataatttgtttccatcttcagggtctacttgtactccagttctggtgcaatttcccccacatctgcagtaactttctccactgaagtcttgaaccccctcaaagtcatccatgtggtttggattcaccttcttccacactctatgaatgttgatattttggccacctcccatgaaaattaatgttcttaattgtatctaaatagttaatcccttccaaaaggttttctattcattttgctcaaattcatcagaggaatcactgtatgtcggctatacccttatagcatgtatttcttaaataataacaattgaaagtcaaaattactccttaatccatgggctgctgaatggatgttgtgtaggcaggaatgaaagcaatattcatctccttgtgtatctccatcagagctcttgggtgaccttgtcaatgtgcagtaatattttgaatgaaatctttttttttttttgaaggagtgggtctcaacagtggacttgaaatattcagtaaatcatggtataaacagatgtgctgtcacctaaacattgttctatttacagagcacaggcagggtagatttagtgtttttgatggcctttggacttttggaatggcttcaactgaataagcactggcttcaacttaaactaaccagctgcattagctcctaacaagagagttagcccatcctttgaagctttaaagccaggcattgagttctttctagctaagaaagtcctagatggcatcttccaatagaaggcaatttgtctaccttgaaatttgtttgtttagtgtaatggctttcatctcttatcttaacaagatcttctggttaattttctgcagcttttccatcagaacttattgcttcacctggcacttttattttatgaagatgggctcttttcttaaaactcttgaacaactgccagattcaaactttccttcttcaacttcctcactgctctcaggactcataaaattgaagagagctggggccttgctctggattaggctttagcttaagggaagtttgtagctggtttgatcttctatccaaaccactaaaactttcttcatatcggcaataaggctgtttcactttcttatcatttatgtgttcactggagtagcacttttaatttccttcaagaatttttctgttgcatttacaccttgactgtatttcacataaaaggcctagctatgttggctttggacatgctttcctcattattattcttacctctaatatttatctaatattattcctacctctaggtaattattcctacctcttgatttaaagtgactcttcctttcaattgaacatttataggccattgtagggttattaattgacctaatttcaatattgctatgtgtcagagaatagggaggcctgaagagagggaggaggactgttggtgatgggggcgtgagggaaggaggatggctggcaggtggagcagtcagaacatacacaaaacttcaccatcttatatggatgtggtttgtggcaacccaaaacaattacaagagtgacatcaaaaatcactgatcacagatcataataagagatttagtaatattgaaaaagtttgaaatattgtgagaattatcagactgtgagagagacatgacacgaacacatgctgttggaaaaatgtcactgacagacttctgcaattggggctgccacaaaccttcaattcgtaaacaatgtaatatccacataaagcaataaattgaattgcaataaaatgtggtatacctgttccacagactgggtagcttaaacaacataatttttttttctcacaattctggaaaattaaagtctgagatcaaagtgtcaccagggttggtttcttttaaggcttcttcccttgacttgtaaatggccatctttttcctatgtcttcacatagtctcctctccatccctgcccatgctcaaatttcctcttcttctaaggacttccttcatattggattctggcctactaatgtcttcatttcaacttaattatctctttaaagatcttatctccaaataaagtaacattctgaagtattaagagttaggacttaaaaatttgaattttacagagacacagtttagctcataatatgttataatccccacttcactgaaaagaagagtggagcacatgaagttaagtagcttgccccagtttgcagaattgttaagtatcacaatcatctagctccagaatctgtgaggctaacctttagattgtatgattctctttttatattttaaaataagaaataaaattcatagacctattgaattaattttaggacaactcttttatttgtggtacaccataattcacaaatagcaaaaatttgcctatgtctataccataggcataccaatttcttgaaagaaaagcagggtctagtctggttagtacttggatgagagaccaaatagcaaatacttaaaatgtcttttctaaggaaattaaattggctcctatattaagctgtagaactaatggcttctgctctgtgcaagtataatggccacaactaacctcactgcatgttaagtactgcccttagagtacctgatctcatttatgtcttacagctctttaaagtttgttattatccacattttacagatgaataaactgagacttccagagattatcttctctctcctcacaaaaatcaataacaggaatttgaaacaagttttcttatgaggaggttttgtatttctgacttctcttcttgctgccacatcccaaggccaaagttaggatgccttgtataagcctttgtgcttgtggaaattggactttcccctcttttgtgttcatctggcaggttcttcctacgttcataacaagatatattgtacggctttccccaattcccctcactttcactgcctgttgtcaatgtgagctgtttaggtccctttcagcactcttaaagtcacctcccaagtactctgtggccctcctcaggagggtattctaagttagtcatcatagatacatctaagtccagatccagaatctcatgttcatggcatcctctttgacctacttagctgttgccgcctcataccctactaagccagtgatggtctttggctcctcatagcctgtgaataaaaaagggtttaaattctacagggataaatcatatgtctttagactactgttattagtgtttcacaactgtgccgtcaccctttcttacatactctgagagattttgtaatcaaattctgtcacgtaaggtgaaatcagaagatgcctagttctcacttctgtgtatagctttgaaaggcctgctaatgcttggaacaaaacatgaaagccttgtccacctttctgttttaattcctaattactaatttcttgcatgttagtggaaaagcattaaacttggaacagagcaccttgattctggtcctagctctgccacctgggtgttataataaaagtcacaggaatctaaaatggaaccccagatcttctactgctttctagttgagttactattggcaaattcttaaattctttgactcaattttttcttctgtaaaatggaatcaataaaatattaagcaagatattgttcaaaggaaaactttagccaaattaaatttaaaagagtttaattgagcaaagaacaatttatgaaccaggtagcttcctcagctagagtaggctcagattctctagcacagccacatggtggaagaagattaatgtacagaaaaagaaaaataacgttaaaaaaatggaagtgaggtacagaaacagtcagattggttatagcttggtgtttgacttatttgaacatggtttgaacagctggccacctttgattagacaaaactcggtgattggcacaagaatagactatagtctgtttacaactccatttaggttatagttcacaatgtacagagaaaccttcaggctgaacttaaaatatgtaggagacaactttcagctaaagttgatttaacaatatattaagagtttattttatagacattgctttattgctaactttgtcatctgggttagattataaactcaagattattgggtagatagttggcacctaatctgtgtgcaaggcactgagaaacaaaagataaaaagctgttgttcttcagctggttggcagcattgatattcctccaatgtacttgtgcctgctttgaaaacaacaatgcctctgcctctatttggatttgttccctcacagtgaaagaaaaaagagtgattgtgatcctgaatttctgaaataaggagcatgtttaactgacaatctagcatctgttttctgtacctttcccacccagttgacaaattctcctccatctgcatcgcttaaaacttagtcagaaagtaacagaaacctcctcatggagagaaaggaaggaaagaacagaaacctagatagggaacactaaagtgtcagagaaagaagcagaagaactgggttctcatcttaactcagtcccttaccaactttgttcactactttctctctctctgcctttttttttaaagtatgatttcacattatctccttcgttgtatttcttatgctaatacatatcctttcctgatcttgtaatgtattcattgctgcttcttgagtataaagtgtgtgagtcctgagtcctctgagaaaaggaacacttaaggtgtttaatgctaattaatgcaggtgtctgttggataaacagcttacatttcaagatgaaggtcaagcagagcgtcttccaagagagaaaatctacacatcagactttggtagaagcatatgcatacttgcaactgcagaaacacccctgtcatcctgtgtaaacacacagagaacagggtacttactattattagtaacagagtggtagccaagaccccttgattccaatgttggttgtaccgttaactgtgacctttggattcaaattttattttgcctctgtaaaatgaggggtttggaagggaagaaaacaaattactgctttttcagaactaagccaatcatttatattgtctcattttatccttaactattgttacttgacatttcacttccttattttatttttgttctcataaatacattaaaatagatagtaccatcccttttctataaatgagcacactgaggcttagagagttttattggattaagtttaaatggaaatgtttattatcatttaaaaattacaagtttgttttaacaagtaactgcttcaaaacaagtactacatgaaaaaaataaataataataaaagaaaaaaaatttaggaatgcactggccttgctattatacaactgcaattcaataaattttgagtgactagaaattcgtgtggctggaggcatcgcaagctgcagttctcaaagagagtgtgattgtcacgtcatctgtcctggcctttcagaaagatgatatccaagaaaaataactccagattctcttgtattttcattatctcattattcccatggcttcagttatcagctagaggttggtgagctgacttctcaatttgtgtttccaaagttaatcttactctgaaatccagacccagatatctagcgaatgacctgacatccccactgaaatgtctcaaaaacatcttacagcacatctcatctagaatcatgacatcagcatcctcccctaatattccacttcttcaggggtttctgcatctggtaatacaaacactttgctcagtagcataagccagaaaagtaggcattttctgtggtacctggcccctcagttgtactgcttggatttccagacatcatctattttcctggacatcattttctcactgatttctttatccccctgatgcgtgcatatccaccaactcctactcttcctcagtcccttctctgcaacgaaatctgtgtggtcttttacaaatgataatctgttcgtgttatcattcaccttcccagatacaaacagtgactttctgttaggaaaaaaacacaaatctccctaacatggcctctgctacccttcatgatttggcctcagttcaccttcctagcctcatctggagctatttgctccttgatccctatagacatattggtcaatttttaattccttgaatttgtcgcatacttccaatcaaagattctttccaaattccattctgtccttcagaaatattcttctaccatttctctaaacagtcattcttcaactcttgaagaatgcaccatcaaagacttttcctcaggccacagaccagatgaggcttccccattaaatcctgttaccatgttacattcttccatatttgccagtccataactataggttgatttctgaaattgctagttactgtctatctccaccactagactccaaatactatagggcagaaaacttcaccaatgctgggcccagagccagtttattatagatatttagaatatattcattcattttttaaatatatgaatgaataaataaataaaaaggtcttctattacatatgtgtatgtaagttttttttgtgtgtgctcatggtggtggtagatgtgttacaacgaatcagttcccaaatatccaactatcttaaggcttccttgtttgttctttttttaagtaaatattttataattattttatttgtaaaaatgttgtgaagatagaacggagagttcctacattttccatacccaattcctctattattaacatcttcccttggtatgggacattagtggacattaaagaaccatgttgatataattattatcaaccacagtcaatactttagattacttagtacctaatatcttcttctgctccaggatcccacccaggatactatattacatttaatcattctgtctccttaggttcctcttgcctgtgatagtttttcagactttctttgtttttttgatgaccttcacaacttcgaggagtactgctcaggtattttgtaaaatgtcccacagttgatatttgtctgatttttttctcatgattaaactgggatatgtgttttgggatggacaaccctagaggtaaagcaccattctcttcacatcatatcaaaggtgtagagggactcaaaaatgtaccccaaagtatggtgccttgtgatgctgagtattttgaagtaaaggagattggaaggcctcagaagcaaagtctctggcccctctttctcctgtgaaataaaccatagaaactagactccctcttccccaagatcataaaaactagaacctttcttttccaaaacaagccataaaccctaaaaatattactatcatcttctcccacctttctttgtagcagctggccataaagaaatactctgacctacattatttgatagtaggtcataaaaccttcattgctaaggccctgccctatacgtaggaggagggactgctgcacagagaggtcaagaagaatacaaacagacagggcttactgggttgtttctctcagtctattacattagatcatactcttttgtccaaatttctgcaacactggccataagcataaaatctaagcataaaataaacaattttccctgggtctttggctcttcttttctgaagtctcccatgtcatataaaactttgattaaattattatgcttttctttgttaatctgtcttttgttataggagtgttggccatgacccttatgatgggtagagagcaattatcacacctctatcacccaaaaagggctatgctattaacataacttaccattgtgaatgttaaccttgatcacctggcagaggtagtgttggtcaagtttctcaaactgttaaatgatttcaccatgtttttatactgcactctttgaaaagaagtcactgtgtgcatctcatacttagtgagtggggagttatatatagtaccttcaagacagagtatctacataattatttgaattcttttacatgatagattcatatatttctctccatttattaatttgtatatttatagattatatctgtacagactcctctatatttattttatacaactttattttgtggctcaaactcttccagctttagcctttaggagtgatttcagttgactactctgttcctttgaaatatctctaacattgtgggtggttgtcgtttctttgaacatatccttagtttatggcactaaaagatgctcaacattcatcttgtatatttcttaccccagccctagaacctgccgtttcttcgaggaaccccagttccctttactggagaatatttcttctgttctgcctactttttcttcttctggcattccaattatgcatatgttacattttttggaaattatcccataattcttaattattttttattctttctctttacatttcagtttgggaagtttctcctaacctagcctcaagctcactgattcttttcttggccatatcaatgttagtgatatatacaacactgttggagtgtttttgatttctaggctttctttcaattttttcttagggtttccgtctttctgcttacattattcatgattttctgcatattatttactttttctattagaaatgttattctattaattttatattatgtatagttttttaaaattgatattattcacaattatttcagattctatgtctcatagttccaaaatttatatcatatctaatatgatataaatgattctaatgattgctttatctcttcagattttttttcttctctgttgccatgacttgtaattttttattaaaagccatatgttttattaggtaagataaactgaggtaaatgggcttttagtgtacaaatttatgttactttggcaaggagttgcacaatgtttaaatgtttgtcctagttgttacagttttgagatgagaggcctcaagtttctctagtgtatttgtttttgtctctattcttggttttgggtttccctacatactcttcctcagagatagttcatgtatttcagctcttttagctgtaatccactgttgttatactggagatttgttggatgctggtaaagtatgagagaggggagtgttcaaaatattctaattaaatcttagtcctttagtaggccagtgcattggggcttcacaatacagctttttcttcttttgcctctgcccctctatttgcttccctggttgcagtatttctatttatttccttgaaactctgacccctgtggcttatatttacttccccttaggtgagacaggaagactgaaagaggctggactgaaaggaattctcttcctgaaactgggataaggctctaacaatttcccctggatcatagggctttgatatggagaatgtcctgggcatatttcacaacggtcactctcctcctccctgtaacagagtaaggagagtatctttctgaggtcttcaccataaaaacctggtggagttcctggaggtaaagccccaaacatgtggaagttcccctaagacagcagcacccaggaatttcccactatcttcactagtctagactcagtctccagccattcatcgaagtgtttcagtgttcctaccactttaggaatccagctgctcctgcccctggtaagcagatctcagctatgtacctctggatgaacccatctctccacttttgaggatggcagtttgccccgcaacttcaattctctcatgggtccaagaaaatttgttgattattaatttgtctattttgttcttattttaaggataagggtgaccagagtctttacatgtctgacctgaaatcagaggtcccatgccagcttttatttataaaacacatctttccatatttccatctgtgttcatctttacatttttctaatttttctgttgtgaatttcactgtcactcagattttcagaaaaactatctagattcagttcaaattaagttttgctaaaaagatgactaccccctcctccccaaatgtcaatgtaattatctgagttaaacattaatattcccatgtgagctattctagtcatggtttggtgaaattaactgaagttgagaatcactggtgaagaacttaatcaagattaataccttcatttgaaaaggttgatgaggtgggtgagcacattaatggtttcatccattaaatcttttggtgctgagaattgatgtccttgtcctacttaggtaaagaatttttatttcatggcagaaacaagattatttataaattgaactatagaagtaatttttctcgattgacaaaaggtacaatttttgcctccagcccttatttagtggctcactgtatatcaggctgttcccaaatcagtcaaaatttgacaggggtggtggagggattatcagacagcctccttctcattttaaaaatttaatttaccaattgaaaacacatggttagtacgaataaaatgtctactaaaaattatctataatgtgatttccttttttggtaaaatacaggtagagtgttgtggatgcatattttaaaaactagatataacaaaagcatagagcaattacaggtgattttttcttttctcctttttctttgtattttctctattttacataacaaacaagtactgcttttgtagagaagaaaaccataaaagttaaaacaaaaggactagtttataaaatcataggactttaataaaatttggggtttattgtcaagccagtttctaatttcttctgttgaggaaactgaagcacagaaaaactcatcttcttaaatcttctaatttctcatttttgcctatcagaatactaaccatcactaaaggcactgctcacatatgcaaggctttggcatttctaaaacagcatatgttatgtctcatcaattttaaagtttttccagtatagtcataatacttaggagggggaagaagagaagagaggagctgtgagaaagataatagcttttatgtaccacttaactgtgtattttgtgttattttaattaatccttacattaccttcatgacataaatataattcccattttgtagaataaagaagatcaaacagatacaattttacaaatcttccctgtctcaacctatagaactcagatttttacacagttctttgtgtaacttgacctacagtagatactcagtaaatattcgtttaataattgaactaatttagaaagcatttggtatgcatggaccagatttttagtgtttatcagtggactgccaattcctcactaaattcacaactgaaaaccaactttgaccacaagtagtgtgttcaagttcagatcctctaataaacagaattgttttctgtcatggaaaaaatgatcaccatttcttccatttggcttccttgttctcttcattattgtgcttcaaaatgttgaaaatggttttctaaaattgtattcattttgtttgaagcattatcacttctttttcaataccaccttttctaccatgtaccaacctttgacctgctagcttaaaatgtacagctaagtaacgatagcttattatttagtactttcacaaaaactatcatattggaaacaggtaggacagatattattactcttatttaaggatgaggaggctaattctccaagttcagtgattttcttagagttatacagccagatgaaaacacagagctaggcctcaagaagagttccccaactccagctcttgtgttctttcttctatgtcatatgactcgataatgcaaagccattctctttgtcatattgttaatggctctctataaattactctacaacttgagtttctactccattcttactggacttttttcaatcctttaattttttagtttttttccagtcaaagtttttagttgcatgaaatagaaactaactctgcctgatttaagtaggaaaagaatttgctgagaggctactgagtagctcacaaaatcatggagcagcaggttcagaaataggtgagaataagcaagaagggcatcagctaagacggctgccaaaaccatgctatagaacacagggcacttgctgggcaatggatttctttgctggtacatctggctttgctgcccctgaaaactaaatattgttatatcaactgccactgcccatttctaggatggtttctgattgtccctgcttatttgtgtcactatctcctgtttcgaagtcatgaatgagtatgtcagattggcagaatatttatcatatggtcatactctaactttagaaaaagccgagaaacaaagtttaggtatctaaaccattgtcattggaggtaagctctgtctcccatcaagactcattaagcccacacttcacctatcacaacatgaatgtttaaatcattgaaagcctcccaccagaaccaaaaaaatgaccaaattctagcactgtttccaatttagttttatacgttctttctctggtctttctttgggaatatatttaatttacaactatgactcaattgtcactcaaccaatagttacctttattttgcagcattctggaggttcaaaactcaatgtgtaagttttattcacctgctaagaaattattttttcaaagctagcctcaatatttattttaaatgagtgaacttcaaggcctgaaagaataaactaatactttacgaaatatttttgaagtataaagaatatattcaacatctttccatgtctccagattttaatatatgccttattttactttaaaaattttcaaatgtttcttttatacacaatatgtttcttagtctgaataaccttttcctctgcagtatttttgagcagtggctccgaaggcaccgtcctcttcaagaagtttatccagaagccaatgcacccattggacataaccgggaatcctacatggttccttttataccactgtacagaaatggtgatttctttatttcatccaaagatctgggctatgactatagctatctacaagattcaggtaaagtttactttctttcagaggaattgctgaatctagtgttaccaatttattttgagataacacaaaactttatgcttcgacaatgttattcctgaacactttaaatcctgaaagtgcattataatccttaatttattaccagtttattatcacaggaatcaaattctgaggatctttaaagtcatggtcattttgcttaacataggccattttgtacatggcaaccatgtgaagagcagtagaatcagaagaagaaaaaaaaaggttttgagacatgactctatcaactgactgtaaggtgacctgggaaattcactctacatccctgaatctcagtttattcacctgaaatactgggaccagaacacattaaagaattatttagaatgatacattaatgagcctagtacagtgtaacacagggtaaacatccagcagttttggaatcatttttggaagtttcttgctagggttaccaagaaaatttgtagaaatcttgaacttaagtgtagttaataataatagctattataatgtttattgctctatgatgacgatagtaatataaaaccccaggattagaattagatttgagctctaaataatcttcctgcatagaaccatgtcagtatcttcttgacaaaatgaggaacagatagtagtgtttccttctacctgaaagtccactacatgcatattctttacatgtattattaataaaccatataggaggtaagttttattctcctaagataaaggtgaggacactgatacccagagaatttaagtgactttctcaaaatcaaacaccaataatgtggagaagcaagatttcaattctaggaggtcctcctcatctcaccgcactgtaattcacctaacgcatgagggttaattatcaaaaacagtgtggcttatgggtaggaggtatttaacaagcattgatgtttcattgcattcattgataatgacacataaatacataaataaataaatatataaaataaacgaatgaaactcaaccctctcactcttgtgctcaaatccagtgatacatgactagcatagtttcatacctgaagaagctccagtgtggaagtaagacaattgtgcaaggaagtaaaaaacatcaggctgtgttatgtgcagtaaaagagtcataaagaaaatcccacagcagtgctgaagagaaagccatgacttttgaagggttcaacctaaaaagagaaaacaaggccttgagaatgaataagcaggtggcagatagaaaagggcaggggatatgctaggcaaagagaatagcaagaacagtagaggtggaaaatgtacagcatatttatgaaatgctgaattattctatttgagtagtatgaacagtggaaaaggacacgaagaaaataagttgacccagtttataatagttcacacatactaagtattttttattagccaggaactcttctcaatgtgccctatgcattacttccttaaatcttcataattactctatgaagtaggtatcattatttcttttgctttttcatagatgaggaaacagagtcataaagagtataaattgattttcccaggccacttacctagtatatggtacaatatatacacaatttggggctaacaggagaggctataggtcatcaaccttgttctgccctttgagggatgattaattgaaaagatatgggtttaattgaacttttctgctttatctgaagactgtagccaatgcacaaaatgctaacacagctgacaaaggagatcagtttttggaaaatcttaagatcactaagaacagagaaatttgcaaagggtggaggtgtggtaagaggaggggtttcctgtaagtctcaagtgacatgtcttctctttcttctatgaaaaccacagtacataaaaaagggagcttattggtaactatttttcaaagattttccatttaggattttatgatttagtgtctgtttccatttccaaaacacgctagactttcatgggttcatgcttttaaatatgctattgtttctgcctgaattctgactctctttctccatttgtcaaactctcagatataaaaatcattttatacttatagtgatgtttactcacgcctttctcatagttacatagcatttctttctgtgtatgaatctgtcctgggttttattcttccccaaacccccaagatcagaatttatcttgcaagcttctccattctaagcatcacattgtatctggtatggactgaaatcaataaatcagtttgagtacaagtgatatttatcatgaagtgtcatttctcttaactaatataagtgaagttttctagaaaaatgccacacctcttaatactctggtcacttttggatatatattttaaaacactataagtattctatcacaccaggtttttttttatgtgtctgtactgagttgtttattctttacatacacatttattgaatacgtactttgaataacacattgccttagatactatggatacaatggtaaacaacatagtctctatcttcacaaagtttaccatggaagagaaagatcttaactgcttgctgaaaaactcatttatatagagatatgcctaactccaggggtcaatgaagtgatacttcagatgacatcaatatgacaggtagaattaactagttgaaaaggaggacatggttatgaatttgggccatattgttagaataatgcaagccactgataaattttaagcaggttataatcaaatttgaattttcaaaagattattgcagcttcagtatgcagaaaaattttagtagttggaaagcacatgcagaaagccagtgaaaatgctattataagagtctgaggaagaggtaaaggtagtttaagttgcagtggtggtggcaggaagggagacagaaagcatgattaatttgatattattttgaaggcaaaatttacagaacttggaaaattatttatatatcagatgaaggagattaggaatggctttacgctttctggcctgtgaaaatgatgaatggtagtataattcactcatataataacaagaggagcaaagaaagacatggaggaaagcttatggttttgttatacagtgaaatgaagttatatgggacggcaaggtgaatgtctcttgagaagttggatacacagcctgaaactcaaaagcggtgtctggccctcagatcctaatgcgagagacatcagcatataaattattgactcagctaatttttaaaaccccatggaagggtgatttttattctgttttacaggtaagtaaattgagactcagaaagataaagtgattaattttaaactacaaagctagtaagtgtcaaatactgaatccaaaacttcatcactccatcactgcacagagaagagggttccctttaacccctacattgtcttctacgcatatgctccacctctttgttccttccctagtgtcccaatggatactttttactacaaaggcaacaaaatttcctggatgagccaggggagaagaggctcaatgagtcatattagaagcttgaaggtatttatttccaattaaatttaaagaaacaatttacttgaaatgctttagagtaattttcacacggctttgaatttacaaagttaattttagagaagtttgactttaaaataagcaacagcagatacttgggaggctgaggcaggaggttctcttaagcccaggagtgtgaggccagtttgggcaacacagcaagactcatctctaagaacaaagcaaaacaaaacagctaaactaagtaacaccaattgcctattttctattttatgaatttttccatattgttgcctctgttgtactttcaaggagtttaaaatttatctctattcatagctaaattttaagcttactaaaaaattatttaagatttcttgatataattttgttcaaggggattattattcatcaaccaggtactcatgtttataattacttaagtggtttctgtaaaaaggcagctgatgtctgccatttatcaaactttttctcttataattgaatttagtgattctttagaaaattgagtagcaggtgattttctcatatgtataactaatttacaaggggaggccaaaaatctttggcaaagaagggttatgtcttcaatgttgttgataaatgtaatcttactttctacgtagcagaaaaactctgttgagagcttccttctccccatacattacaaaagacctggaaatttggtttcaaaaatgagaaggggaaacactgttcacagtaactgcagtgccccattctgccaatggaatttgatgacacttctatcattcatgaatttgttcaatagctctgtttggctgtgtatacctgtgtgcatgctgttcttttctgcctaggatggattgccatcaacattatatgctcagagtctaattcattcttttactcagtgggacagtcttctggggtgcattccctgacttcacagagatgtaggaagtcttttctccatgatgcctttctatcttcatcagaacaacattactctcgaaatgatttgtttacctgccaggtgctgagggtgaaaaggtaaatgagacagagtgccccccaactccccgcctacaggtagtgtatctcaatgaataagtgatattttaataaatgagttgaagaaagataaaacaagtaagacataatacttgctcttgagagtttgtgacaagcttgaaaaataagacatatataaatagatataattataataaatggacgtttgtgccaaatgtcacaaggcagcaaagaaactagtttgagaatccagaagagaatggagctgagtcagcagctgaagcaagtttggaaagaaaaactcaaattgtaagctgatttaggtgaaatattgatgaaattatcattctatcatgataagaatcaacagcagttgtaaattgttttctatatggtagacattgtaccaagggctatacatacattgtctagtttaatcgctccaggcagactcctaattcatttgagtaatggcccctaactacttcatgtgtttgttttgtgaataaatgggcatgttaatgcactttggaaatgatagagcataaaacaaaaatctacataattattctgaaaagaatggatgacaagaaaaataggacttcacagagggaaggatgatcaaaaaattacgatattgggacagaacaaaaaggtgcactattggggctcaaacgcagatggcttacaaagaaagtctgaatttgaaggatgttgagaaataaaagtatctcaaagacagtcccttggtgacagtaaaaattgagaccacttggaatgaattaaagtggagcaatagtaagagaagctggagaacaggactgacatagaaatagtatttaaaagctgtgaaagcacttcagccaagcctttaacaaaaaagaaaatatttattatgtagcctctatgtatcctgcctttttttggacattttaaatgtactatgtattgaagccactaacagcaatttaagctaagtattgtagtcccattttcaaaataattttaatatatattaaaaacagtaactttcaaggtctagggtttaccctgggttatatagtccatgatggctcaccaacaacctgtctgtattctagctagtcagaaaggaaaaggtaaatggttaaagatatattcttttctttttaagggaacttcccccaaagttatacatatatttttgctctagacttgagtcacatagccatgacttgctgcaaggtaagcccaggatgcactctcttctttctgctatgtcaaaaagtaaatttatagtatcttctgtgtatgttctacatatatatcttctatatgcattatagagagcatcttctataaaggaattgttttgttagaaagaatccatttgctcttactgaacagatattcagtacggacttcctcatttactcaaatcttaatagtctcctaaatagattctatagttatatttacataaaatttaaacatctctccttaactgctacgtgccttaaatatgtagttgattgtgagaatgagatttgtttttcattaaaacaaatctttccttcccatttccacagctgccattcagggacattccttcaacatatcttctgggtccaataacacattcagtcattcagtaaacatgttcattctctcatatgtgtttcagacactgtaccagattctagaattatatcaatgatgaaagcacactattggccttcaaggagccattttaatagaaacaataggttaattgttgatgtatagggaagtttaatttatgtaatacttatctagccgtattttatttttttactatgcattatctgattatggatttcctaaatatatagttatatcatctattaattgcatcaggtacttttagtagcatgctttctaattgtatcagtaaaaagactttttttttattttggaaaattaatagaataaaccaaaaataaaaatcaactgtaatcttattgttagattgatcacttgtgctgttttagtctcctgtgtactttttcttatacttttttccacatacacataagttgttaagcatatcttttaattaattttgttttatcaaatattataagcatgttattttacaagccaaagagtgctgcaagtcttataacaaaatgtttatgcccctatatcagctactgtaacccttttacctatttattctgctatattgccctgtatttctaaataatagggaaatattactatctgttaattcatcaagtttatctttggagttcctcatatttaaataatgattttaactctcttacagcttccctgttctttcattcatcttctcagtatagtattatcatatttgggggcaaatccacatctaggaattttactgtttttactactacaatattatttacagttcaaccaaatagtatgctatgattacgtttgttttcctgcattacttttctattggaattaagactttttttttcattttaaagcacccatcactgtttataccaaattttaaaaggaactgtaaatactacctcataacatagtgaaatatgagtaatttataaattttttccctgggtgacatccttttgtatatgtctgcccttctcattccacagctgccattcagggacattccttcaccatatcttctgggtccaataacacattcagtcattcagtaaacatgtttattctctcatatgtgtttcagacactataccagattctagaattatatcaatgatgacaatatactattggccttcaatgagtcattttaatagaaaaaatattcatataatagataactggaatataatgtgacgggtatgataatagaggaaatgctaagccagtaacatattggatgctgtctctcctcagtgccatgttcttatgtggtttgaaggaatataaataatcaggaggctaaagacttttccttgttcagaattattgtttaaatatatgtggtcaaaatctgttgttgctttttaaagtaatgtaaaacgattgaccactattcacctttatttacaataaaggaatcaatatacaattggataacattctgattactaccaagttattgttttccctggtttctgctgaaccagaaaatcgaatattgaaaagactgagtctacctgtaaggaatgagttaaggtaaagaaaaaatatgcaagtcaatacattacaaaagttgttcatccatttatggcagcagattctaaactgccaaatctccaaccatctgattgggttcctaaagccaagtcttagacatcccatgaatcattaccttttagtcagtatagcacagggatttcaactttttgtaaaggaatggcctgctagaggaatcgttaaatgtccattaaattaagtcttgtttagataattaaaacacagcaggatctgtctagttccctcatctggttggggaggttgttggtagtaataaaattattccttttaggaattttacaaactgttcatttatatgactaaaggtgtagatagggattcttatatggctactattaaatgatacatttaaattgtccaactaattatagaatcatctgttttatttgaaatgtatggcttcaggaaaattttgaatttaatttgatgtgatttatttcttaggttgctcagtatgatggcatctcaaaaacatgggcttacccatgatttttgtttggtgaatgtttaaaaacaacacaaaaagccatttatgtacacattttatgcatacacacacacacacacacacacacacacacacacaacccagaatggtccttaggataaacgcaagttctgattgagtaatgactatggaaattttccccgacatttagaaatgctgttctctaatgcagaggaaataatacatcattttatgaatacgttcatagaagaataagatatcaaatgttcttttatgataaaggaagcaactacagaaagcttttatttgttcaaagtaacaagtggtattgatgaaaaaaaaacacacacaccaaaaaaacccaactctcccaatactacttttaaaatgaacatatcaaaactgattttcattagaatgtagttatttttccacactagttaattaaaagccaagacccagatatatatatcacaatgcaaacaattaagcttcatcatctggacaagaatgccaacttagtctctctttgtaaaaaacaattacaatttcaagacacttcatatttgccgcttttgccagcagcaagtcggcctgatgtgaatattcccatttcaggagaaacatccattctccactgctgcctgtggcaccaattattctttcaggatcaagatctctggtgaagcctcttggtttgtcggcagcatctcttttctttgatttgctgtcattagattcattgtcagataaagactttctttctttttgtaatttttttttaccaggttttttagaattaaggaatgtttcaattaactctggacaatctaaattttctgcgggttcccaagtactgtcaacatctgacgtcccttaaacttcaggaaatgctccaccttcccttttgctgtaattcgatccagtagtttttccacaaatgcttcaggctctgcctcttcgacttttttacccttttcattctgttttcttttttcctccctttttaaaattatttattattttttgcactgtagtttcatttcaggcttttggggtttttttgtttgtttgttttggttgttgttgtttgattttggcagacccgaagggctattattcttacatatatcggctcccctaagccccgcccctccaggctttactttcagagtcctgaggcctataaaggccaggcccctgccctccagcagggagtgcgtctctgaggagaaacaaaggcccagagtgcggacgctccagggtaccgcggcacagggcccactcctatgccactgcggcccggtaaccaagagcgcccccaacccccgaagccttaggacagagggacggtgcccatgcgccaaaatctgtttcaagatttaagactgtgacctctgtgaatacagagattgttcaaatgccctagggttcttgggaggctactaagattgctgagcatttgccaacattactattaatgtctgtcaaataattaaaagactggattagtgaatggttaatgatataacggtgttctattgataatcggaatagttacaacatcctttcacagaaaaagatggaaaaatcacagctaacatttaattgagtacacactatataccaggccctgaatcacttacggatgttatctataaaattcaaacgttccaacaagaggggtattattttcccatttttctgatgaagaaactgaggctttggagtattaggtgtaactttcccaagctcttacagttaataagtagtagagctggccttcaaacccaggtgtctactccaaaggactgtgaaaggatgaagatgatggtgatcgtaacaatggtggtaacaataaaaacaatgggatgtctttttatttcagacccagactcttttcaagactacattaagtcctatttggaacaagcgagtcggatctggtcatggctccttggggcggcgatggtaggggccgtcctcactgccctgctggcagggcttgtgagcttgctgtgtcgtcacaagagaaagcagcttcctgaagaaaagcagccactcctcatggagaaagaggattaccacagcttgtatcagagccatttataaaaggcttaggcaatagagtagggccaaaaagcctgacctcactctaactcaaagtaatgtccaggttcccagagaatatctgctggtatttttctgtaaagaccatttgcaaaattgtaacctaatacaaagtgtagccttcttccaactcaggtagaacacacctgtctttgtcttgctgttttcactcagcccttttaacattttcccctaagcccatatgtctaaggaaaggatgctatttggtaatgaggaactgttatttgtatgtgaattaaagtgctcttattttaaaaaattgaaataattttgatttttgccttctgattatttaaagatctatatatgttttattggccccttctttattttaataaaacagtgagaaatcta

SEQ ID NO: 1259 - DNA, 122963 bp, Homo sapiens
gccgccgccagggaaaagaaagggaggaaggaaggaacaagaaaaggaaataaagagaaaggggaggcggggaaaggcaacgagctgtccggcctccgtcaagggagttggagggaaaaagttctcaggcgccgcaggtccgagtgcctcgcagcccctcccgaggcgcagccgccagaccagtggagccggggcgcagggcgggggcggaggcgccggggcgggggatgcggggccgcggcgcagccccccggccctgagagcgaggacagcgccgcccggcccgcagccgtcgccgcttctccacctcggcccgtggagccggggcgtccgggcgtagccctcgctcgcctgggtcagggggtgcgcgtcgggggaggcagaagccatggatcccgggcagcagccgccgcctcaaccggccccccagggccaagggcagccgccttcgcagcccccgcaggggcagggcccgccgtccggacccgggcaaccggcacccgcggcgacccaggcggcgccgcaggcaccccccgccgggcatcagatcgtgcacgtccgcggggactcggagaccgacctggaggcgctcttcaacgccgtcatgaaccccaagacggccaacgtgccccagaccgtgcccatgaggctccggaagctgcccgactccttcttcaagccgccggagcccaaatcccactcccgacaggtaacctcgttgcccctctccccgtttccccgtcgggcgggcctcagaccgggggggcgctcgggagccgcggccgccagctctggtcaggggaggggggttgcgggaactctagctggggtgggggtcccgaggcgaagtggaactggagtcgtccactccgccgcggtgaccagctccccactcctcccagagtccggggctgagatttgtttttcccttctgagtttctctctgcggttgcagccccggggggcgtgctttccctccttcttcctttctttcttcccggggttcccgagaggttggcgggagtggaggaggggtggggaggaaggaagggggtggggaaaagtcgggcctgggccgcggtgggcttgcacaatgcgcgcgcctccgcgcgctccgcaccttcgctcccgccgggccgggctgggaaagggggaggggggcctctggcatttgtgtgtgggtgtgttgccagcggcggccgagtttgtgaagttgagccctgggcccctttcctttgcggcctctcggtccacttcagtctcctgggggagtcaaataattgttctcttgttttccagtgttgattagaggtgggggtagaaccggtccatttagttttttgctctttctttccttcccccctcccgtttcccctccccctcccgtaagcatttattttcctcgcggctcaggcgatttcggaatacaggtttcgggcttcccctgcccagactttcctggaagttgtttatggagttctttcacccctgctcttcccttgtgtgttggaacttgggccggcttgctcttatcaaacttagtaggtcgcgtgttggtttcccagttgtagactattatttacagtcggctgaaacgcttttgaattagccacatctgtacgttgcgcaggaactgagttgcgctttacagtaccgaggttttaacacaagcctttgataatacactgcaggttgactcataggccaagtcctgcctagttcaactgtgattaaaagttaatgtttgggaagcgatgactaattctaggatcgccattgctttttaattcttattgcggatatgaacatggctgctattccacatacacaatgttcgattattgtgccaacttgattcagcatagaagtgaaactgtttataatgagtgttaacattccaataggtcccagtggatttgttttgtgtagggttctctctttttctttcttttttatttcttcttctttttttttttttttttttttgagaacttgcttcaggctaaacttcagcataggaactttgcccaaaagttaataggttttccaaatactgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggtatgcttttttctcttacccctcgaagtgggtttatggactcattgtgggtaaatgtatgttggcatgcaccctacagactgcacggtatgttttcaaagtataatacacatagattggatcccccattttgtggcatcagccacaaagaattacaactgggaagtgtactttttcttctagtaaataatttttacaagaatttatatccagcagttctaaaattcataaactattatagttttgtttgttttaaataagtttttaactaagtgttttgcatctgtaaattcgacttttatttctcctaatgatttcctaaatcatacttattctgatgggaaactcaaaaaggtgtatcactttaaggcattaatgactctactgagtccttccagtttccttacctttgtgaatctaggaaattctaactttttgataatcaaactctaatgctaattaaaaatattttaaaaactatgcaagattatgaatagtacaaatctaggttgtaaatactattgttcacaacacaaactggtgactgtaagttctttcatatacatccatttttctatcatgaaaactattttataaaggagaaaacaggcatatggaagttaagatacttgttcagtgtcacactagccaacttagactggaactcagatctttggggtctgaatgcagaattttttctgcttgtatagagttgtggatgtgtgtgagttcttaagttaaaattggactgataacatctttatcttctacatacaaagatatagttgggtttttttcatcctgttcattgtagatggcttttaagaacatttgggcagttcaaatttgttgctctcattaaaatttgtgtaatttgttatgatttctttattgatggcattttatcatggttggaataaatgacgagggcttgatttttcttgagtttgacctagaaaaaaaattaattacttaaaacctagtaaaaaatacatattctttgtgttgtgtttatacttagaacattttagaacttggaaaagcacccataactgcactgacctcttaaaaattaggttttaaaattcactattatttttggaatgttttattcattcagtactagttgcccttacatgtctagtgtggaccaggggaaattcattagatggactgctcatcaatacaattacaaacatttataaaatttatattaaaattatataatattaaaagtatccatttgaaaacctgtgttctccagtgtcgaatattaaatgttgaaattttcctttggtacttagatattcggctgcaattaagcgctgactgggaaatttaaagggactcagttgtgttttttcttttttaatttttcatcttaatattccctaataggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaagtaagtgaaaataatggtgggagacagttatctaagacaaatatgtattggaaaacacagtaaagtggtgtcaagatacagaatatcatttatttttatgttttatttaatatttatgttaagctctgtagctctatcttccatatatatgtttcagtttggtatgacctaaatacctttgttagtatgggtaatattttgaaagctttactgagtcttggttctgagcctctttataatcttttcttttgtggaagtttggttattctcattttgagcttgtgccaaaccttttaattagcctagcacaaaacagaaagaataccatgaaaattttcaaattctgggaattacagggctagcagcgtcttacaaaatacgtatggtgctacttgtatctttttaaataaatattttattggtagagaactacaaaataagtagggcttttgggggagtctaattttacagtattttaaattgtgaaatgacaagcactacaactgaagcttgatgtgacttaccaatatttccccccaaaaatgtaaagggaaataaaaatttttaggtttcatatgcagtcgctcagtggcaaacttctttcaagctagtaggtcttcacaacagaaaccctcctctctgggaaaacaaaaacatgaccgttgggttgtttatttatttttattttttcagtccttttgtgtttaataaaatggcagaattacactaggctgaaaagacataaatagaattttctctcctctgattttgaaattacagataagacctcaatttttttctggcttgtttggatcaagtatatattgaaatgttgactaaaactaattatgatagactgaaattgatgtctttaaaaaagctcacttaatagtgtttaatcaggttgagataataaagtgaaaaacagtgtaagttttgattcggataggtcttgacagtctactcctaaggcaaatgtaacatttatttatcataccagataacaccattaaggatgttttgttgtgtgaatcctagtatgtgttttatattgattgtcttccagggtgggttgctactttgtaatgtaagatagaaagttttgtgacagacttacagaagagcaaaggaaaaggtttgatcatgaaaagttcgtacagtttttttttgccccctttcctgcaactttttcttttcttttcttctttttttttaaaaaaattcattttctggtgtcctggtatccatttcaaaggatcaggtttcaaccagaacagtaaagggcctgagactggaaagtacacacaagtctggcaaactcatctgcatgagcaagatcatttgttctcaagcagacatccaaagtaaatgattgaaagagctgctagctgtgaaggatgtgtcttgaaggggaagggagtggaaacaaaccaggttgttaggaagaaaaagaaaggctgcacttttttgaacctctccctgctgggtcacatgctgacctggggagattgttaaacagcttaatagcctgctttccttctttctttggttgatgctgtggctaaaagtataaggttaaagagcaacatttatgctcttcttcttagttctttgtatcttgtaataattgcttgtaggtgatacctgcctacgatttcattattttgaatgaatgatctttttttgagctgaaatcagtattctagatacagttggccttccgtatctgtgggttcagcattcatggattcaaccaacctctgattgaaaatatttggaaacaaattacatctgtattgactaatgtacaaacttttttccttgtcattatttcctaaataatgtaacaactatttagcctttacgttgtattaagtattataagtaatctagaggtgatataaagtatatgggagaatatgtataggttatatgcaaatattatgccaccttatatgaaagaccagagcctctgtggattttagtacatgtaggaggtcctggaaccaatccttgaccacagatgctaaggaatgactattcatttttcaaagtttccagtgattcttcctttgtgaagaaatgtttctcttaaaggtattgatatatgtagatggattaatgaagggtatataccttccaaccccagtcacctcaattcacccctgtcaactatgggcctgtaaggaagataaaccaggctaaaataaataaatctcaaattatgtcataggagaaaaggttgcaagggtagagagatatttacccggaaaagaaaaaactgggaggaggagagataagacatgattgttgtttcagtgtttctggggaacttttatgtgggagtaggattagtcttactatataagaaatgtgaggaattttgattccatggaagaattttcttatataaaacttttaagaactagaagagttttcctggacaggtaaatcttgctcaataaatgtaggtaaaatcatggttacttggtatctgtcagggattctatggaggcccctaaacattggatgtgggagaagaatgctgtgggcttataaaattttgtattttaaagagtatctgctttatgaacattatgcaatttggagaaaagttatgaaataagattatttcaccttctccagttagctacttccatgatgttatggaccgtatagttgttacaacttctttttgtgtactgaacagacaaatgagattaatatcctaaccattagtcaaagatgatgataaactaagcttttggtgccaagtttctgttgtcaaagttcatttttatcctagttttgatgttttaaaatagggctgtctttgtaatcaatatttatatactttcctcttgtatctaaagaggagtgttgttgtcatcagatgtagaatgaagatttaaattagttgccttacacttgtttccgcaatgaaacattttattttaatgcatctttttagatatttgttggaactgacttttaagttacaaagtctataacttattgagatttatatttggcatgaagaacctgactataaatggtccagacaggcaagacgatgtaatttgagaaaaaacttagaaatgttaagaaacaacccagttgttggccttgtgaccatagatgattgagtttttgaagttagttggcctatcatctagtttccaggcagcatgattactgaaagattataagcaggcaatcattcgttgttttaaagccctccttaggtcagtgagatcttgtggaggagactcataccttactttggcaagtgatacggtggaagtatggtgctagttacatttatcagtggcttgttttcaagctctgggatgaatgtgaagtatgtaaacaaggcttagccatataatatttgttctactacatttactattcaaaactattttctttaccatcgtattgagctttcattttaaaagaattcattctctttatgactctgagagttattaccttcttcagctgtcttacggttttcctacaggaaatagttcttcaagtagttggtcaacaacttcctatttctttataagctgctgaataacttcctgactcagtattctataatatctctggtttcaaggagtgttttacttgcaagtttattttattgactctgatgccttataactattaccatgttcaaagatatgtgttcttatatataatgtaccatgtaggaccttataatttgatttaaggaatctggatcagtgattttaaaagtttgtacatttgcattgttttaataatgttctaataatttttaaagcacagttttgtttcatttccattgtttatcattttctgaataactggccacaatgtttttagtctgcgaagattcaaggttttttgtggctgtgatttgattaagttatattgagtagcttggtatacaatttaaaaaggatatgtttttcagagatttttgacattgcatggcataaaactacccatattcctatattaatttgccttgtagatgtgattgatcgctatacataggctgattcttttttctttctttccttttttttttttttttgagacagagtcttgctctgttgaccaggctggagtgcagtggcacgatctcaactcactgcaacctctgcctcctgggttcgcgtgattctcctgccccatctctacaaaaatacaaaaattagccgggtgtgttggcgcacacctattgtcccagctaatcaggagactgaggcaggagaattgcttgaacctggcaggtggaggctgcagtgagttgagattgcaccactccacaccagcctgggcgacagagccagactctatctcaaaaaaaaaaaagactatgaacatatacagtgtatgttgttatcatatacagtgtacctggtatttatacattgtatacagaacatatacagtgtatcttcataataaagattatgcctctttaaaaggaagtttcatgaagaataaggctatactgtttctttctgtatcaagtataacccagagtttccctttaaaactgaaaagcttgtaattttgccattaaatgttaagttgcacacgtgcacatgtatacacaaacaaaaaaccagttcaaattgcaatcacgaagtatttccctatttgagggaaggccagtctctgcttgtttgtcttgctattgaggctgagtggagagagaagatgaaagtacgcccttagctctggggggtgggggagagcttacttctgctcagtgggtgggcatcccagggaagaatggcacacagtgccacagtgatttagggagagaaccctggagaaactgtattcaccagtggcagaagaaaaacagttggaagatagtagatgtgacagagtaaatagaacatagagattaacatattccctgggaaaaataatggaatttttttagtgtgaactaagaaagaagttcactagaacttctttgcattatttaattaatttgcagcatcattcaaagaacagactgtcacttggtgtgtttaaaaattatgattcttagttctagaaagaattctagaactatctctggaagtttaaatgtagcagactcaattgactgcaaggtggtaggctaattttctttttaaagtcacatttaaaaaaaaataccctttcctaaagctttatcttagccattaaaaaaaaacccaaacatctagatagcatttaaatagttgaaacttggaaaaaaaaaaaacccaggtttttacaaccctaaaataagtcctctttagttatgtagagaaatattttactttgtagttagaaaaataatgtgaattcacagcttaaaatactcagggtatcatgactctgcattgccttgtaccttaaggctttgaggggaggtaaactctaaactgttttattgccaaaatatatatagaaatttaagcttaggaccaatcaaagtgaagtcattttaaaaatcagttgctaagatttaagattattcaaacttaatgctaccctctgtaatagcataatttagccattaattgtggcttgaaagtttttaataatagctgagtagcattgtataaagggaggtcttaaagagctgtgtcgttctataactgtggttactaggtgatgcacttcttacaaaaagggcttctgattctaggattaatcagaactacaagccatgaaagggacattgccgtttctatgaagaagaattgcttcatggttctggttgctcaagtgctgtagcaccaagtttcctgggaacaagtactgccaccgtggaagcacttttatttacgtagggcttgaccccttctaaatgcaaacaaagaagtttggtttaaatcacagcagtcctccccacctcccctttaatattctagacaaggaaaatggtcagtatttaatcctcattttgctcctagcatgagaagaatcataatttttaaacacaccaaccaagtgatagtctgttgtttctttgaatgatgttgcaaattaataaaatagtgcaaatggcagtatctattatttgggttttcttctaccagatattttcagtgctttatttgtggttagtgccattacttcatgtgctgtcactttaatttgtctctctatctctttatgggatgttagtcactcgactatcaagttcttcagcaggattctcagttgggggtgggtgaggggacattttattaaaagctccttcctttgtcttcttccaattgattgcttaacctaaagggagaggagttctgtttgtttttaaagtaaggtatttatttggccagtaagtatgtttagagagttgatacttgcatgaaaattgctgcagatttgatttgggatttggagtaaagatagtgtgcttgttaaagtgttactgtgtgctttgacaaaatggaatgtagtatagaaagttgcttgaaattcaacttctcgtatatcctgaactgactaataaggagcaggcttttgggataaaaagtacatacgctgccacctaggaggtgaagcaagatgtggatttttttttcctgtatatggaaatagatgtgggggttcttttgttttatatttataaaacagtcctccctcactcttattccttcatgtgcggtagtccctccccaccatccatgagtttcctttccaaagtttcagttacctgccatcactgtggtgtaaaaatattaaaatggagaattccagaaataattcatggccagccgtcgtagctcacgtctgtaatcccagcactttgagaggctgaggtgggcatatcctttgagcccaggagttgaagaccagcctgggcaatgtagcaagatctcatctctattaaaaatacaaaaaaattagccgagcatggtggcacctgcctgtagtcccagctacttgggaggctgaagtgggagaatcacctgagcctgggaagtcgaggctgcagtgattgtgccactgcacttcagcccagcctgggcaatgggagtgagaccttgtctcaaaaaaaaaaaaaactaaaaacagaaaaccagttcataagttttaaattgcagtgttctgagtagcgtgatgcaatcctgcaatcttgtgctgtccagtctggaatgtgaatcctctctttggtcaatgcatccatactgtctatgctacctcccatgccaccaccccattggtcacttagtagccacctcagttgtcagatccaaagactgtagtatatatataggatatagggttgggtactatctgctgtttcaagcatccactgtggggcttggatcatttcccctgaggataagtgggggactgctgcctctgattttaggcatttcttttaataaggtatattatttttttgtatttgtttggtttattttgagacagtcttaactctgtcacccagacttggagtgcagttgcatgatcactgctcacagcagcttctacatcccaggcttgtgtgatcctcccacctgagcctcctgagtagctgggactacaggcatccaccaccatgcctggctaatttttaaattttttgtagagaccaggttttaccatgttgcccaggctggtctcaaactcctggactcaggtgaaccttaggcatgaaccaccacacctggccaggcatatggtttttgttataaaactaacatttattagagagaatcagaaaattcaggaaaagagaaagggggcctggcgcagtggctcatgcctgtaatcctagccttttgggaggctaaggcaggcagataacttgagggtaggagttcaagaccagcctggccaacagtgaaaaccgatctctactaaaaatagaaggaaaaaaaatgggcgtggtagcccatgcctgtaatcccagctactccttttgggaggctgaggcatgagaatcgtttgagctcaggaggcagaggttgcagtgagccaacatcacgccactgcactacagcctgggcaacagagccagactctgtctcaaaaaaaaaaaagaaggaaagaaaacggaaggaagcaccagattctaccagtgagaggtgtttgaagaaccttgttttcatagcctgtgtgtaaacgtatattttgaaatttaatttttagggaagtaacctgtgcattgatttagaaaatcccttaatactgtaaggtttataaagaaaaagagcaggctgggtatggtggctcacgcctgtaatcccagcacttcggaaggccaaggcgggcggatcacctgaggtcaggagtttgagaccagcctggccaacatggtgaaaccccatctctactaaaaaatagaaaaattaggcaggcgtggtggcaggcgccttaatcccagctacttgggaggcagaggcaggataatcgtttgaacctgggaggtggaggttgcagcagtgaatcgagatcgagcattgcactctagcctgggggacaagagcgagacttctctcaaaaaaaaaaaaaaaaaaaaagcaaagaaaagagcaatgaccctcttttctttatctctggcttgcagcttgcattcttcagaggcaagcactttccactccttctaggtgttttttccgctggtacttttaaaaattccatatttataaaatgtgttacattgctatttcttgaattttcatcacccctcaaaatccttttctttaatcctcccattataatgactataattgttttgttaaatatttttacgttatgacaattcatgttgtgcctacagcagagtcatataatgtactatgattttctggaaaattctgtatttccttgcctggccaactgtgattttgtttttgccgtgattttttgtttttatttctgttgctttttgcccaccttggagctatccttagagtcttttgttttcctgctctgtgctagacttgttgcttcagagttgtcatgttaggatgtgccttggctttcatcctggggagtttctgaatcactcttatgggttgggtacccaatttttctctttctttatttgctcactctttgagtttgttcatcccctagaaatttgcagaagaaaggggtacatgggaggtagctgtgttgagatctcttgtctctaaaactatctttctctgttaacatttagtgggcagtttggttgtagcatttaagcttattttctcgtgaaattttgatggcattactccgttttcttttctttttttttttttcttttttttttcgagacacagtcttgctctgtcacccaggttggagtgcagtggctcgatctcgtctcactgcaagctccacctcctgggttcatgccattctctggcctcagcctcccgagtagctgggactacaggcacccaccaccgcgcccagctaagtttttgtatttttagtagagacggagtttcaccgtggtctcgatctcctgacctcgtgatccgcccaccttggcctcccaaagtgctgggattacaggtgtgagccaccatgcccggccactccattttctttttcttttttttttgtttttttgtttttttgagatggagtcttgctttgtcacccaggctggagtgcaggggtgtgatctcggctcatcgcaatctctggctcccgggttcaagcgattctcctgccttagcctcctgagtagccgggattacaggcgtgtgccaccatgccccagctaatttttgtatttttagtagaggcggggtttcaccatgttggccaggttggtctcgaactcctgacctcaagtgatctgcctgcctcagcctcccaaagtgctgggattacaggcatgagctgctgcgcccggcactccattttcttctagcttccagtttgctaattgagtgtttgctttccttggggattttagtattttgttctttatattgggggtctgaaatttcatgatgtctgttgatatgctcttttaaaattcattgtcaacaatgcctagtcatgtatcagttcatgtaaagaaactcggtcttcaatatggatgatgcccctcaagattttgcagtacagttgccctaaagtacaatttccaggactgtcttttcaggcatggaatctttcagtcctggaaaacatttctttcattagttcccgggtaatttcttccagtctgttttatctgttattttttttctggaattcttgctagtcaggataactgttttaattttcttatcttatcccactattttctttcacttagcattttgttatgttttctgggagatcccttcaactttaacttttaatttttctgttgattttgttttcttttgtttctgagatgatgtgggaggggggcggtctcactctgctgcccaggttcgagtgcagtggcgccatctcagcttactgcaacctctgcccctggagctcaagcgatcctccctcctcagtgtcctaagtagctgggatcacagattgcgtatcaccatgcctggctaagtatttgtgtttttggtagaaatgggtttcaccatgtttcccatggttggtctcaaacttgtgagctcaagtgatctgcccgtgtccaccttcagaagtgctgggattacagggatgagccaccgtgcctagccagatttttttttttttttagacaaggtcttcctctgttgcccaggctggaatgcagtggcacgctcagggctcactgcagcctcaacttctgaacctcaggtgatcgtcctgccttagcctccccaagtagctgggaccggctaatttttgtgtgtgtatgttttgtagagacagggttttaccatgttgcccaggctggtgtcgaactcctgggctcaaatgatccacccaccttggcctcccaaagtgctgggattacaggtgtgagccagtgcgcctggcctgattttcttttttcccaaaaagctatttctcattcttttttttttcttttcttttcttttttttttttttttgagacagagcttcgcactgttgcccaggctggagtgcggtggcacaattttggctcactgcagcctccgcctcctgggttcaagtgattctcctgcttcagcctccagagtagctgggattacaggcatgcgtcatcatgcctggctaatttttttatatttttagtagagatggggattcaccatgttacccaggctggtcttgaactcctaacctcaagtgatccgcctacctcagcctcccaaagtgctgggattactgatgtcagccatatcacgcctggcctgtgtatcattcttaatttacagtgagtcttttctgagctcattgtttattatttttaataacatgctgttcttattttatggttgtagtaatataatatctcccttaggatattatactgtttctttttatattttgtgctgatgccttcattgtctaggtaggcttcattggagagtaatacaacaggagccaagcccggaagttgcagggacccctgaatgccactgtcttagtaatttcctcttttagcagccactatctctagctaagtctgccagtctggagagcaccagtggtgatgggagttaggactgaataccagtgttcttgggcttgacaatgtggggcctcatccctgctctcagctatgtcatgtgtttgaatccagagtctccaggtctgtttctctgaaatctgaataatcgatttcctccttgggccaagcagagaggtatgcagtaggtttttaagaagttgtatgtaagctgaatttttgtgaatccagtttataattacaggttgactataggaagttgccaattttctaagcccaaaacagtgactattagcaattttttatgatttggtttaaaccttacaaaatcactttttactgaatccttgatatggtttggctgtgttcccactgaaatctcaatgtgaattttatctcccagaattcctacatgttgtgggacaaacccagtgggaggtaattgaatcacaggggcctttctttcccgtgctattctcgtgatagtgaataagtctcatgagatctaatgggtttatcaggggtttccgcttttgcttcttcctcatttctctcttgcccccgccatgtaagaagtgcctctcacctcccgccatgattctgaggcctccttagccatgtggagttgtaagtccaattaaaccgctttttcttcccagtcttgggtatgtctttatcagtagcatgaaaatgaactaatacagtacattggtaccagtaaagtggggcgttgctgaaaaatacccaaaaatttggaagtgactttggaactgggtaacagaggttggaacagtttggaagactcagaagaagacaagaaaatgtgggaaagtttggaacttcctagagacttcttgaatggctttgacaaaaatgccgatagtgatgtgaacagtccaggctgaggtggtctcagatggaaatgaggaacttcttgggaactggaccagaggtgactcttgttacgttttagcaaagggactggtggcagtttgcccttgccctagagatttgtggaactttgaacttgaaagagatgatttaggtatctggccaaagaaatttctaagcagcaaagcattcaaaaggtgacttgggtgctgttaaaagcatttagttttataaaggaagcagagcataaaagttcagaaaatttgcagcctgacaatgcagtagaaaataaaaacccattttttgaggagaaattcaagccagttgcagaaatttgcataagtagcaaggagcctaatgttaatccccaagaccaaggggaagatgtctccaggccatgtcagagactttcacgtcagcccctcccatcacaggcctggaggcccaggaggatatggttttgtaggctgggcccagggtccctgtgctgtgtgcagtctagggacttggtgccctgtgtctcagccactccagctgtggctgaaaggggccaacgtatggctcaggctgtggcttcagaggttggaagccccaagccttggcagcttccacttggtgttgagagtgcagttgcacagaagtcaagaattcaggtttgggaacctctgcctagatttcagatgcatggaaatgcctggatgtgtgggcaaaagtttgctgcaggggcggggccctgatggagaacctctgctagggcagtgcagaagggaactgtggggttggagcccccacacagagtccccactggggcactgcctagtggagctgtgagaagagagccaccatcctccagaccccagaatggtagatccactgacaccttgcatcgtgctcctggaaaagctgcaggcactcagtgccagcctgtgagagcagccagaagggaggctgtaccctgtaaaaccacaggggcggagctgcccaagaccatgggaatccatctcttgtatcagtgagacctggagtcacaggagatcattttggagctttaaaatgtgactgtcccactggatttcggactcgcatgggccctgtaacccctttgttttggccaatttcttccattcagaatggctgtatttacccagtacctgtacccgcattgtatctaggaagtaactagcttgcttttagttttacaggcccataggtggaagggatttgccttgtctctgatgagactttggactgtggacttttgggttaatgctgaaatgagtaagactttgggggaactgttgggaaggcatgattggttttgaaatatgaggacatgagatttggaggggccaacggcagcatgatatgatttggctgtgtccccactgaaatctcaacttgagctgtatctcccagaattcccacgtgttgtgggagggactcggcggggggtaattgaattatggggtctagtctttcccgtgctattctcatgataatgaataagtctcacgagatctgatgggtttatcaggggtttccgcttttgcttcttcctcatttctctcttgccactgccatgtaagaagtgcctctcaccttccaccatgatcctgaggcctccccagccatgtggaactgtttaagtccaattaaacctctttttcttcccagtctcaggtatatctttatcagcgttgtgaaaatgaactaatacaatccttaagtgcttttaacaagcaaatgcttacttcatttatatttgtccttatcagtatcagttttgctagcttacctttttgcatgttagattttcttaaagggagaattacagctgtgacacgagagtggttagcattgaatggacagtctaagaattttgttcagaaggtttggattctggtcagagagcctggagatataatttctattcttatgtatgataagggaggtagtcctatctgttcgtttgccatttccaagttcttcatctagttaatatgaacagctttaaaaattagggctttaaagtaaaacagccttatataattattggcctctctctctcttcctttgtctctccctctcttccttttttacctccctccctccctctcgcttccctatccccaaaccctgtgtcccctccccagtctcctgacactgtctctttctttctctcatcagtatagatggtggtaggaaaaatgtttatatctaaattgatcagtaattgtaaatatgcagtatactgcataagttaaccctgagatgtgtttaactgagttttatctcagtttctccctggcaggtggtgctcatttaatagagaactcaaaaaagtagcctgtgttcagtccctaatagaccattgttgatgtcatagaataatttttttttctatatactatcatatggtcaggtaagcatttttagagaatgagttagaatttcatgaagactgggtttaggttaaaatacattcatctgggccaggtgcagtggctctcgcctgtaatcccagcactttgggaggctgaggtgggtggatcacgaggtcaggagttcaagactagcctgaccaacatcgtgaaaccccatctctacaaaaacacaaaaattagctgtgcatgatggtgggtgcctgtaatcccagctgctcgggaggctgaggcacgagaatctcttgaacccaggaagcagaggttgccgtgagccaagattgcgccattgcattccaggctgggcaacagagcgagactctgtctccaaaaaaaaaaaaaaaaaaaaaatttacccatagatgatggctgagatgtgttaggaccctttattgttttttatctcaagttgaatttctccaggttccatttttcagtagtcttgtccttgtttaggtaaaaagtgattacataggaaaatctgttgggtgaaaaggaagcaaaactttttttttttttttttttttcgaaatggggtcttgctctgtcacccaggctggagtgatgcagtggcactatctcagctcactgcaacctccgcctccgcctcctgggttcaagtgattctcctgcctcagcctccccagcagctgggattacaggcatgcaccaccacacctggctaatttttgtagagatggggttttgaactactgacctcaagtaatccacctgcctcagcttcccaaagtgctgggattataggcgtgagccactgtgcctggccagaaaccttttaaaactgcatacaagcaaaaccagaccagagcaccatatagcagtcagagaagagggttttctgagtcataaatattgactcagaaaaaaaattcaatatttttctgagtcaaaaatattgaatggtgtgaggaagagtggaacagaattggtacaccttagttcgtgtaaaataaggaagtgtgtcagaatagccaagtgctaagtttagaaatgagctaaataaatggagattcctgagaccctgcctggaaccaattcttaccagtgttaaggtcacagttaaaatttcccaagctctcccggataatgattgattgattgattgattgattgacaggctctcattccagttgcccaggctggagtgcaatagtatgatcttggctcactgtagcctcaatcctctggacttaggtgattctccacctcagcctcctgaatagctgggactacaagaatgtgccaccacacctggctaatttttgtgtctttagtagagatggagtcttgccgtgttgcccaggctggaatcaaactcctggactcaagcaatctgctcacttcagcctcccaaaatgctgggattacaggcatgagccaccacacctgacctctcctggataactactcttttttttttttttttttttttttaagatttaaaaaaactggtaaagagttgtccaaatacagatgtttctatttttcctctacacatgttcagactgatacaggttatgtttccaaaatcatgtagtttggatgggttcacttttaacccctcccagctggagggtatgcaggctttcctgttaggactagtacagatctcttcttatgggtgagaaaatagtcactgtttctttgcaatgatatgtaagtgtcattgtcctctgtgtttgaggataaaccatgccctctttgtacctgtctgtcttctttgagttggtgcccatcatactgcagataagaatttgcacagcttatcaataagccagttctctctcttccctcaaatactgggtggttttctcaaaaaagacccacatggttcgggataaagtgtttggttacttgctttgatgtagttatagtttctaaaactgtagcccaaaagagtagccaatgcttagtctttagtaggccattgtcgatgttgctcttcctgccattcttttctgtgaactcactataagtgcttttgatctcttgattttataaacacctatgtagtggttttatgtagcaggcgttgttctggatcccactctgtgtaatagggacaaaattaataacatgccagtcttgatggactggataggtctcaaaacttcattgtaagtcatgtgtcttgtttgccttttcattggtaactgtccctcacgattgaggctatgagttcaataaagagagatcttgctgtctttgttcagcattatgtgtgtagctcttgatacatttattggcagatgacatgctatagagtgctcatttatttcagagtccattggtcgacagtcttcctgattgatgactgtagtttctgcataattatgattgcccttttcactcttgaaagtatcccacaatggctgataaattacatatgcgaactagagtatttactatgtgtattctaaagttaattttatgagtttgagattatttttaagctttaacaggaactattaaaaaagggtattgtttgtcttctggatataaagtgacagtagttcactttgtggtattataaattttgttccatgggcagtgaatatctgatttctttaggattaaatgagtaagaaattctgttgtaaaagtgataccaagcctggccaacatgatgaaaccctgtctctactaaaaatagaaaaattagctgggcacagtggtgtgcgcctgttgtcccagctactcgggaggctgaggcaggagaatcgcttgaatttaggaggtggaggttgcagtgagctgagatctcaccactgcatcccagcctgggcaacagagcgagaccctgtgtcaaaaaaaataaaaaaaaagagtgataccggtgagcagacaactctggaaggctgagagaaaagtcatgaggtagtagcatgggtcagatactactcaagtcacgcttaagggagttagcattttcagctagtgattgtgtggacattggaggagtcaaagacagagctgccaaaaggttttctggtaaaaccaaaggtcttttccctccccaccttgaatgacattgcatctcaagagagtcctcgcttgatgctgttaattaattaatctcagtttactttgcattctgactttgggtatttttttcattttttgaaaaacagttcttctgatatcaaaacacttgaaaagccatttaatgacttggttttattcactgtttgagacagattgtttcaaagtgaggactatgcattacacaaacattgttaactataattgtatcctgtatacattttttaaaggtttgttttgatgttggcacctgtttaagattttccttttttgcttctttttgacaccatttgtcagaaaatgctggttgaaagggattgtttgcatttcattttttggtaaattcagcttcatgttcatttgtttaccaataaatttattagaattgtgcaaagtgaatataaaccgtttacacacattggttactcttgtttcagttagtaattatccctgcaaattgaattaatagtaaaatgtgtaaaacattacaattttttactttttttattttttactggcataggggcccggcatagtggttcatgcctgtaatcccagcgctttgggaggccgaggcaggagatcacctgaggtcaggagatggagaccagcctggccaacatggtgaaaccccgtctctactaaaaatacaaaaattatctgggagtggtggtgcttgcctgtaatcccagctactctggaggctgaggcaggagaatcacttgaaccagagagttagaggttgcagtgagccaagatggcgccactgcactccagcctggcaacagagtgagactccgtctcaaaaataaataaataaacaaacaaacaaacaatttggtttaaaaaatactaggattttacttaaaaagatttttaaactcgacaattcttactaagctctaggattttaagtttattaataaaactcttgtggcacacagaatttttgggtttttttgggacagagtctcactctgctaccccagggatggagtacagtggcgatgtcagctcactgcagcctccacctcctgggttcaagcaattctcctgcctcagcctcccgagtagctgggactacaggcacgttgctaccatgctcggctaatttttgtattttttgtagagatggggtttcaacatgttgccaaggctggtttcaaactccaaggcccaagtgatctgcctgtcttggcctcccacagggctgggattacaggcataagccaccacgcctggcctagaattgtttatctaatgtcaaagtttaatatggttttggaaggaagttatgagtttcacacaaatgcttataattaagaaataagtttagatgacaatagcatattaggctgttaagatttcaactctgctgttttgtaggaagccacatggaggtcatttacggttactagttatcttagtcagcttgggcagccattaaaaaataatactgtagacggagtggcccaaacgagagaaatttatttcttatagttttggcatggtagatttcatcctgaggtctcttctcttggtttgtagttggctgtcaatctccctgcatgctcacacgaccgctttttgtacatacagtaagaaaatacacactgtcatgtcatttttttgtaagggaactgatttcatcatgaggaccctgccactctcatgacctgatctaatcgtaattaactccaaagaccctatctccaaatgtcagcacattgagggattagcacttcagcgatgacttttgggaggacacggatatttagtccaaaacactgttttaactgaaaagagtttgcattatggacgtttatgtttgaaaaatcagctatttaggtagtggtggtctctcactttatttgccattgacttgttagggaaaccttttgctttctcatttcaagatgctagattagtaccttattatcatacttaatctgttaactgtgatttagaaatatcaggatgctataaacaacatggaattatgtgcagatatacgattgagagttggattttttttacatctcagtattgttctgcatattattcagaggtatgtactttgtcctaatatgctatgttatggctctttttttaatctatgaaaaattatatatatttatttatatatgtataatatatatattaaatatatatatatttaagaatgcataaaacacacttattctaaatagtgattttgatggaaatacgcttccaggttaaccactctccaggttaataaagagaatattgctagttccttagaagtcttccacgtacctctcacagatcacatccctttccctctatccagaggtaacttctggccttttattttacctttttttaaatttgagagatagggtctcactctgttgcccaggttggagtatagtggcctgattactgctcactgcagccttgacctcctgggctgaagcgatcctctggcctcagcctcctgagtagctgggattgcaggtacatgccaccatgccagctaatttgttttctagtgtttttttgagatggagtttcactatttttgcccaggttggagtgcagtggcgcagcctcagctcactgcaacctctgcctccttggttcaagtgattctcctgcctcagcctcctgagtagctgggattaaaggtgcatgctggctaattttgtatttttagtagattcgggatttcactatgttggccaggctggtcttgaactcctgacctcaggtggtctgcccacgttagcctcccaaagtactgggattacagcctgaccataatttttaatttttaattttttgtagagatggtgtctcactatgttgcctaggctggattattttttagttttaccatctacatgtgtatttctttcagttacctactactgcataacaaactaccctaaaacttacggcttaaaacaaccattttattgtatcttacaaatttgtgaattagggattcagtcaaggcacagcagggtgattcttttccatgcagcattgatggaggtcactcagtgccattcagctggcagactggatccaaagatagcttcactcataggtcttgcttgcactttgatgtggatggctggaaggctgggcttagctggaactgtgtaccagagtgtgtgtacatggcctttctagcattgcggtctgaaggcagttggatttcttaaatggcagctgagatttcctagagaggcagcctcaagaggcttgggcagaagtttcaagcttcttcaaatctaaccttggacatcccattgtattggtcaggccaatcaccaagaccagaatggattcaagccaaaggaattagacttcatttttcaatgggaggaatagtaaaaaaattggtggtcatttttaatttgccacagttcttataatagttctaatttttaaaattttatataaatgaagtgatatctgcaaatatttttgcagtttgcatcttttgatcaattttgtgggactcgtgaatgttagtatagttcatttttattgctgtatattttcatagctgtgtggctctattgtatagctagaccacagtttatccattctgtcattaaagaacatttgtgttatataaagatgctgcagtgaacattcatgtgtatgtcttctgtgcaaggatttctctgtgtacatacataagaacttttctaggctgtgtaagagtggaattgctgggtcacagggtatgtccagtgcatggtacttttgctggtcttctgtgtttatattagtataccactgtggttttaacttacattgcttgatcaccattggatctgagcatattttcatatacattttggtcatttattttactttctaaagcacttgctcaaatgttttgcccagtgttcttttgaatttttgcccctttttcctgtatgataactgcttgcttttaatccttccatgtgcctaggacagggagccatttttcctttttttttttttttaaaacagggtctccgtcgcctaggctggagtgcagtggcacaatctcggctcactgcaacctccatctcccaggcccaagtgatcctctcacctcagcctcctaagtagctgggactacaggtgggtactgctaccgtgcctgggtaattttgtttttgtttgtttttttggtagagatggagtttcaccatgttgcccaagctggtgtcgaacttctgggctaaagtgatccacctgcctcagcctcccaaagtactgggattacaggcatgagccactgcaccgggctcatttttctatattcgaaaagtttcatatatatgtctttaatcttctcagaattgactatgtatatatgagtgtaggagtttttttctcagatggatatccagttttcctaggacgatttactgaaaagttcactcctcactgattagtgattgcacttctgtccgtaatagttgcatagatctgttactgtattctgtttgttgtctgtcgctgtgtcagtagcactgtcttaattactaaaacattagaatatgtcttgatagtagaggaagtccttttatcttgtcttggctgttctttgttgtagtcagataaatttaagaattggcttgtaaagttccgcaaaggacctcttgaaattctgagattgcaatgaacctatagaaaaatttggagaattggtatctttacattaagtcttctagtctatgacaatggtaaaaacatctgtctcctttgccctttaatgtaaatgtttctataatctgaagatggaactaacaagatctgggttgaaacctcagttctgcttcttactgccttaggacctgaggcaagtcacataaactctctaaactttagttttcttatctataaaataagtggtaatacctactaagcagagttactaagagaatagggtatcatgttaaaaccctgagtgtagaaactagtgcataatatctcttagtgaatggaattaatatactacatctctctctccttaaagtttgtgggatattcagttttaaactgggtgccatataatgttttaatatccttgttaacaaatttatcaaaatcacatatatgggtagaatttaggtgatgggtatatgaatgttcgctgtacaagtcttccaattttgctgtatgtgaagaattttcataaacttttgagaaaaagacaacatatatgaaaaatatagaatgcttaaaagactttgctgcctctccctgctccatgtgaaatcacagtaaagccaagttaaatctgactttttaggttaaatgttttattgaaactattagcacacacatgctcttgtgggttgatttagttctaaatatttcacgttattagagtcattgactttttttttttttttttaaagtcatggagttccttttctcaatatcattaaccttgtaagatcttctaaaagtgtttacaacacagcttataattaactgatttttggagaggtggaagggaactaagttcttttttttttctttttttaaatttccgagatggagtcttgctctgtcgcccaggctggcgtgttgtggtgctatctcagctcactgcagcctccgcctcccgagttcaagcaattctcttgcctcagcctcctgagtatctgggattacaggcgcgtgccaccacgcctggctaatttttgtattttagtagagacagggtttcgccatgttggccaggctggtctcaaactcctgaccctgtgatccgcctgccttggcctcccaaagtgctggaattataggcatgagccactgtgcccagctgatagggaactaagttctttggtgcattggttatcttttgctgcattaactgactatggaaaaaattagtggcctaaaataataattctgtcattcgagttgggctcagctgagcagttcttctgctgatactgcctgaagtcactcatgcatctgtatctgggagctatactggggctggagggtctaggaaggtctctcactcaaatgtctggtgccagctcatctgggcctttcttttcacgttttcaccattcatctgtttagtccaggcttccttaggtgttgctgggaacattccaaaagggggaaggtggaagctttaaggcctcctgaggccattgtacaatttcacttctaccacattctgttgtagattagtttaggcatgaactgaaatggaaaatttagcagaaatggatcctggattttctggtacccgtgtttcgtttaattactttgttgctttctctccctccctgagttcaattaagttgagaaaagtgttcattgttattactgatggattagactttatttgctcttcattgaatgtttcagttaatttacagactagtaaattatctgagtcatcaagttatgtacgtgtatgtgggtatctatatacataaatatagataaaataatgcaggaggcgaatacttgcagtggctttaggatgattgttatattcctgtggttcctgcttcccagaaatgttttctgtgattacatcacacgtgtccaggtttcttatgaatgaacacttaaggagcactgcttcactggagggtaattaacacattctcagacatttaatttcaaaagcaaagcatatatgtctttctctaaaggcccatgaaaacaagttttttttttttctcttcatgaaattgagtgattataaaaactgatttaatccattgtaattttttgttatccaaaagttgattttaaacagtgaatcagatttcggcactgtgattcatactcccaaaatgagtaacatgattagcaggatattcctagttgttctcttgacttaaaaaaaaaaaaagtccatggtgactcctccatttttggtagtggagttgtattgggtctatgaagaggctttgcgagaaaaaagagcagctatttatggagcatttcctcaggcctgcaatttgaagctattatagcaaagttgctgagcaagtccgtgattgcaggccaacagtcattcaagcccccatcctgcagtctgtgtggagtgagttcaaaactactgctgtgcaaagttttccctctgcagtgtttatcagttgcctactttgtaaagagcaagggtttcaggcattctaaacccgctttgttaactggtagattattaagcagttacaggatataagctagtttttgggtgttcgggagattgttcagcatttaagaatacaatgattcccccatcccctactcccttttagttacttaaaatcaaaccatcttatcataaaatgcagattttatgcagatttttccagcagttttacttacgcttataaaaacagatgttgggttgtctgtcaaaggaattatatcctgtagacctggaatctgtgtttgaggggaatttgattttagattgtagattgctttgttgcctacctatgaaaacatcatttatttttgtgtagggttttgtgagctttttttttaaatggtgacagaaaatgaaaatagcctaattgtgttttttatcatcaaaggatgaaattggcttatctgaatttggctggaaaatttgatttggtatcagcaaatgatgaactgaaaatcaatgagctttaatctgctctggataatattaacaggggtttatcctaaataggactcttctaacctgtgaatcttagaacctttccactttttggtgtcaaagttttaaagcatagtagcttttctgtatatatagtctgatagtgtaaaaaaaattgggtgttgttgcatgttattctctgtccctgtaaaaaaaaaaatctgtatttttccattgttctggaaaaaattcaatttcaaggaaaattttatatagctactagaaaattagtttttagcaatatctatgattttcatttcaagaaagcaacaattgataggaattatgttttgaggattgaaatctactctaaattgaaagtgttcacatttaatataataatctaggatatttaaaagtcatatgggcattctataaaagagaagtatttcttaatctgtttcagtaccccccatgccaacaaaactacgcatgatagcaacacacactaaaaagagaaagaacagtgtcattaaaggatgtcccccagattactaggccttttaaaaatgacatcttaggcctggcgtggtggctcacacctgtaatcccagcactttgggaggccaaagcggacggatcacgaggtcaggagtttgagaccagcctggccaacatggtgaaaccctgtctctactaaaaatacaaaaattagccgggcgtggttgtgcgcacctgtaatcctagctacttgggagggtgaggcaggagaatcacttgaacctgggaggtggaggttgcagtgagctgagatcgtgctgtttcactccagcgtgggcaatagagtgagattccatttcccaaaaaaaaaaagacatcttaatccctacgttctcttgggtttcagtaagattgggtgaaatagtgagtttcttaactgtggcagttacaactgagagaaattttctagttctgttacataaattgaaattgaggacatttctatttcactgaatggtggcttttgggaagtggtccttagatgttgttgcctcacctttgtgcctcacccccatcttttccggaacgatttaaatgaaatatacattcccttaagattcagctcaggtgttaattcctctagagagtctacctagatttttcctgtccaaagtctgccttgggagtccctcatggcctttcacaactacactgcattgggaatatgagttttcactttggacttgatattgtgtcttgtgtgcctagcatagagatgcagcacaatatgaatgctcaccaaaaagaagttgagaactattttcgtgttcccagtcatttcagaagcattgacttatttttacctgttttggtgtctttataaagcttcagcaccatgctcagaggtatgggacaaggattgagagcaatgcagtccctgtcctcggttaggaggcaaggtgggtgcaatggtaagaagtggtatgaaaaaatatccagttggcgctaaacaatgtggtaagccctaagtaatgtagcttaggaactcaggaaaaaaagagagacttacttctgtgttggaattcttggagaagtttggtctttggttgtatttgaaagatggataagaatagacagaataggattttattctgtattgaatccttttgttgactttgctttatctgtcatggttttataacaacatgtaattttagtatttctgcatttggttaaaaaaatttcctctcatttgaattttaggtgcctgattgcttattctcctccactagatgtggtaaggcccattggacccaccattgtgtcttatgcacttagcatagtttgtctggtatgcaatagatatttgagaatgtggtgtgccagctgatttactgactgaattctggagcattgttttcctcatttgtaaaattcggggattggaatatgtgattcgtaagaacttttgcagctctaaaatgctgtgaaattcaatagatttcctgtgaattctcaagtctatatatattttctagtgtgataacattgtatttgcagtgtttttcatgtagaataaagtataagtttaatatataaatgttatcattaatccagaagatttagtaatgttggcaataggaggagtattttcagaaggatttttcttactgttacttaactgatattttggaggaaaatgaagaataaaagctctaacagtgacattatagaatttaggtagaaattaagagggagttgatatttagggctgaaaaagagagggccaacctttctagagaaagatcgatgattagtttttggttgtagttttggtaagaatgcaaagtaattttaagcaatatttgtcctgtttgagaaaatgctaacatatcacaaattgtttattatctgtcaaactgtggaaaagaaattaaagaagtttgagattttaacttgcagctgtttctgatttgtacttttctcttagcatgaagactgaggcagtcaccattcctgagagccaaaaaagggccgtcttcagccttctgagggaagagctattcattgatgtcagagccatggcatagccagacactttccatagctttgagaatctattcttgacagtcagttttagttttagactgttttgattgtcaagtacaactcagaagttttgtatgtgtcactttccatagctttcagaatttattctttacaatcagttttagttttagattgtttggattgtcaagtaaaacttagaatttttttttattttatgagtagggtaataatttatacttagatttaatttcaaagaaccgtttgtggctaataagatattttcaaacttttttagtaattgataggaacttcgttttgagcatataacatttgttttatgtcctgcatttgatattactgctttgaagtgagagcaactgtatcttaaatacttaggtgtagtctcttaacgtgtgttacctcttttaatcctcttcatagttaactgttttataaattgggggcctgctttgaagagattaagtaacttaaacaggttcacccgtccaggtatgtgtcactccaaagcaggagcagtttctgtgaccctatggctgcctctctgcaaccattaaaaggttttttttgtttttttgtttttgcccttcaacaagttttggcataggttaagagaaatatagactatattgcgttttctgtagtatctcatatggcatacttattcatttggtgatcagtaaatacttgttgaattaaactggggcacttgctatgttccttaaaagaagtggcatcaataaggaagaattaagtactgttgcagaagctcaccagatgattctgatgtatccatccacttaccaaatagttgttgaatgaactggaaaattttcagatttaagatatgattggcatatactttttcatatcatcaaatacatccatcaagccatgagatgggtagaccctcattgtacagatgtggaaatgttcaccaacattagccagcacaccccccatatctgccccaaccctcaagtttccttgattattttatgtatgtgcgataatgtgtgatactactactacataaactgtaaagggccatatatatgttcccctttattacctgactattgctaacagcagaacacatagtgtaggcatgaaaggaaggctacatagccatcttgttttatctgaaaaccagtgttttaatcgaacaggttacttgttagtacttacatattgacttagaagttgataaagatttcatttatgcttgtgttgctcagtttttgtatgataactgtgaaaacagtagcaaattcaaattgacagtcatttgtcataacctccttaatggaactgtcctgcttggaatttcccacttctgggaatgataagcaataggaatgatttctttcatagtacctgattaagataaagtggccttcatcataaagacgtgtaaagaaaactaagcaaatgtagaggctgacagatatttgtagagggcatcccagcattggcagtccagcctgagaagagacaggatgacctccagggtgctttctggctccagacctgtgatcaagagtccataagcatagctgattgagcactgaaagtagtgattaccagagaaaccaatgtttaatgaaaagtgaaaattcttgacattgtagaaatgattatttatgcctatatacatagagaaatcccagtaatattttctcaactatgtacagaattagttcaggttatatagttcttgtcatgatcttagggccaaattattcccataggagtaaagtacatattcaattgtattatttaaattggagaaaaaaatttatgtaaagaaagttaccttatgccattttagaacctctgctatttaaagtaagtcacctgttgtatgaatttgtaatgtggcttattgatttttctaggatgcatatttttaaagagcagaataagcttctgctttcaggaattcagcctagtatttcaaatgagagctcatgtattgcaacattatttatctatttttgtaaagggctgttaatcacttggtgccaccctgtctgagttgtgtgcttgtagattgttcacatgaaatcacttgatatggcatctcatttctgcaagaattttttctgtatttttagcccaccagcctagcatgaagttaaattatttaatagaaatatttagagaccagaagcttacttttaattttgcgaatgttgccttaccctttttggaataggttactgtttaaaaacgtgtcgatgtagttatgcaatataattcatttatcctacctttggccaaaacacacacacacacacacacacatacacacactcatgctcacacactcatgctcacacacacttattctgtctctctctctccttctccttccctccctctcagctatttctgagcacagagtcttttgtttaaaagagggattagtatgtcaaatttgtttctatattgtatttctgggtttgaagttttactggatacttggtttttggtaaggctgtcatttaatgcctcttgaattattctgcaggagtattagcaagagttgtaaaccggagttcatatgtgaaatgtgagactgtgacctcttgatccagaggccaggactgttgccaactgaaccaaacccttccttttcctaagaatagaagtgctctgcctaatgattggagttcagctcagtgtttttggtgttctccagtaattggttagaatctcaccaattgtgttttgagtggccaagcaagtatttctttgtagggataaagagaggtacaatgtgaataatttctttaaagagttcatgaaggaattctggtatatcagaaataccactgatatgtatgacctgcctctgctcctgccccatagaagttgctatcaaatgtggaaagacactgtggaaagaagtgtccatttttaatgttaaatgtaaccaatttgataagaaacctataataattgtatcatctaggtctctaatacttgaaaacttaagttctataaattataaatattgaactgagaaaaaaattgaaggtaaaagacgttattaggacaaagaattaggttatttgtgaggcagtaaatgtaaaatgttgactgtattttataacctattagtttgaactgttcaaaatcagaacatagtgagcttcacaagttttcatcttatggacaggattaataatacttcataaattcactattcccattctcagatccaagatgccttatatatatttctactttccttactcctttgctcactcattttgctcattggactttccagtatttgcagtgttttgattcctgactgtcttgaagtctttcaggacaaaagtggctatgaagctgctgtctgccagagagactaaaagagaagccctcttctttgacccagatagtaaagatagatcatttgatcaaaattcagttaggtcaagttagttaagtcagaatgtcaaggaatcagtttagttagttaagttagttaaattacatataagtaatgtacttggacaagtcatagaacgatgacctacagattaaggtccatagcctggccccatatcacctttctagcctcatctctccctccctcttttttaattaataaaagacaaatagagacagggtctcactatgttggctaggttagtcttgaactcttggccccaagcaatcctcacacctagacctcccaaagtgcgagggttacaggcgtgagccaccacacccggcctctagcctcatctgcatctgccatctctcctcctcactcctctctcctgcctgtgagacaccaccaattggatgtactgaagagatgcacctcttttacatgttgtatattcatgcatgcattggtagcattgtaaatgctctttactacttcagctacttaccctgagaaggtcttacacacccctcatttttactttatcgtttaaggctctcagatctaactcaaatgtgtcaccatctttttcctgtagctcgtactaataacatttgaacccctcccttatcccaacttctgtagcattactttactcatttttattcctatagcatttcctcaactctaatatgtctattttttacattttaacctctgaaattagggtacttcttacaattcatgggatcttagttttgattaaacaaggtacttccattctggtggagaattgagattctgtgcttgccttgcttctggaactttcattcttgggtccatatctctaattcctcttccagcacgacaactaataatttgtgctcaaatgttgctaaatggaattaaaatactgtgtctggcttttactatattcaggggaatttcaagggcatgatttgttctgaaatctatcaataataacaataatgattagcatttagagagtctttattttgtgctaggcactgctttaattcctttatctggagtaactcagtgagtcttcacagtaactctgttatctctattttatttttgagaaagctagggtacagttcagccaaaatcgtagaactaataagtggcacacttaggattctagctctgttaatctggcaccaaagtccacgtaaccactgttatatactaaaatgtatttgaatgtttatttaaccagctctgcgctttgtgctttagctgcattttttaatgtaatcctcattatagccacatgaggatttatagtgtagtatgccagaacactccagtagtcatctttagatgtaaattctagtctctattctgatactatgaagagataaacatattatagtaaatttctacatgtacatgcgggagtttgagggctaataagatgatctttctagtcttttctaccttttgaaatcattaaatttaattgctgaaataaatccagactctggtggaaatgaactaacattgagcaccttttatgcttaaggcaggtgcgcattatccctatttacagatgaggaaaagaagttcaaagatgaaataatatgaccaacttattgaacaagaagtacaggcagaatctgtttcagcattgaatctccacccctgaggatggcttctacacaggcagagcctctgtgatattatttttatttttggggtttttaggaaatcttttttctccaccatttttttatttcaccattaagttatcttaaaaccaggtcattagctgtcttttgcttacgtattttagttattttcaacagcttttactaaacatttcgtaaccatgtacatattacttaatattaaccacaccatttctctgtcatctataccacaggctttaaaaactggcatattagagatattagaatgatagtcatgtgaaaggagaagaaaatgtctactatgtagattttagaaattattggagtatattgtggaagttaaagttatagaaaggattttgaaagcatctttgaattttctagcattgtgttagctttatgactatccttggttatttagaataattaacacagagtagtctatattagacacttaagaattttgaatgcttttactctgttttaaaattctagccagtttcataacatgaaattaatagagcatgcttaaaattgggaaactttggtgtttcttagttgacttgtaagagattgcagctttgatctctaagctgcaagtaaacatctgacttgtctataaacacatggtttcaaggctttgggggagcctaagaagatcattggtttgaaagctgaaataagtgtacatttatgacacttgtgtttctgcaaaaagagaagctttggattaagtttatctgagaaatgttgtgtgatagacaagaactgaaaaaaacaagagctatgacaaagacttaggtggtttagtggtggttcactcagttcaataaatcccgtgtacttaacgtgtgctacacactgatggtttttggatggcattaatgtgcctagtttaaggattccatgagagttcatgatactcagtattggtgtcaacttgggggtaaccatacagcactagaatcattataaagtatttattcaatatatttttaagatattatttctcttactgttctctggacaagacatcagtatctgaaatgcctttcctcaccttctgtctgttcttggtcattatatcaatctacttttaagaacatatacaaattatgctttttattgcacatgtagagatttaatataggaggaaatgtttgaaagtatataaaagccaaaagaacaaataaatgatctcataaccgattgataacttattggctgtatattttcagactgtttaactataatcttttaatattgccaaacagttctctagtacagttataactatttgttgttccactagctgcaaatgatagatagagcctattaaaatattacttttttactgctttgtgtggtattctgatatcttttacctcttcatgtgttgctatgtagtttttgttggttacagtttgaaatatgagttccttttgcttattaaagtgacatttctgggcaaaacaccatactggaggatttggaggaaatcttgaaattgttcctaaaggcaacaaattgaagatatattaatgctatgtaacctgagcacatttagataggagatcaccagccattggagtcaatctgcaacttcctgaacaggcatgttttggagccaggctttgaagaagctgtaggataagagaaggaagagacatggtttgtacagggagatggaataagatgggtatgatatgtatgctggattagaaattgataggataccttcaagagagaaaagaagctagtgagataaagggttcaaaatgaatgttaagccaggagatggatgaaagaggaaggcagatttattgtcaagggaggggaaagactaacatcagttatgtttaagggaagctggcctagcaatttacatggaagtggcttgtgatacagggagtatagtttaagtcttttaaggtatatgtgaaatgattggccaaacttgttattgctgagtatagaaagtaaaaacagaaatggtatgtaaataacttaatattgcttttgtgatcatggaaaagtaggaaggatttgtttgggaaaggaacgatgaatacctttgttttcagttacataaaagattaaattaattttcctcctctttcttgttctgttgcaactttggactccagttggagactggatctcccttattctgtacctgacatcacctggcatgatgactttgctcatagttgttgctcaggaacattcattaactaattgcgtatatgaagaaatatagattactggagtatgtctttccactgctctactgatatttgctaaaaaagagattttgagtagtgtgctttttttttttttttttttttttttttgagacagtcttgctctgtggcccaggctggaatgtagtggcgctatctcggctccttgcaacttccgtctagtggattcaagcgattctcctgcctcagcctcctgattagctgggattacaggcatgtgccaccatgcctggctaattttgtatttttactagagacgaggtttcaccatgttggccaggctggtcttgaactcctgagctcaggtgatcctcccgcctcggcttcccaaagtgctgggattacaggtgtgagccactgcgcccagcctgcttactactttgcacagaaattagaagtatcattttagcatcccttgtcttttgtctgccaatcaagaagtttcagaatgttttgatctttggccaagtaaagtattgccagtcagtgtcttgggagattttaaagtgatgacgtagtgcttagttatcttacatagcaaattgttgagatataaaatatattatcaaatagttcagttaccaattaagcctgcattatataatgtatgtgattatctaatggtttcacccaaatctttttctccctttaaatgacatcctcgagtgtagggattctatcttgtactactcattttttagcccccacatgtctatagcattgtgtatggcttacagtaacttaaaaaaatgtgtgttggcttaatttatgctttaaaccttaaaacatgttaaaaatatattgtcatattaagaatattaatagaaccttgtcaaaaaatttttacacatgcaaatcttttttcagtgaaaacatacatacaaatggtttttttttttttttttggagacagtcttgctctgtcactcatactggagtgcattggcataatcttggctcactgcagtctctgcctcctaggttcaagtgattctcctgcctcaccttcctgagtagctaggattacaggtgtgcaccaccatgccgaactaatttttgtatttttagtagagacagggtttcaccatgttggccaggctggtctcaaatgcctgaccccgtggttgctggtctcgaatgcctgaccccgtgatttgcccacctcagcctcccaaagtgctgggattacaggcgtcagccaccacgcctggctgaacatggtctttattcttaagactagaatagtacttctcaacaagggatgattttgtccctttccttcctgggtacatttggctatgtctgaagacatatttggttgctagaatcatgttaagccctttttcagccagtggggtttagctgaaatgtacttgggttctctcatttaagtggtacagaaatcatacctctgtaatttagcccatggtttccccttgcctctctttcaagaatgcttctccagtctctccagctggctaattttatagattattcagcattgccttcagaggctgtcacctttatgtgtcctcctctgtatcactaggttgtaccaagaacctttccataaacaccctaaacctttttctatcctctatcattttatattcatttatagatcattttatattcatttctaacctctgtcattttatattcaagttgtatctttatggatctttcccactagaagataagctcctccaagtcagggattatgtgttattcattttgatgtcagcagtacttggcacttagtaggtgttcagtaagtgctttagacaaactgtagctcagataatattgtttggcttaggtttagtgcggtttttttggtggtatggagagggttgggattgtggagagagaagctgattgacaggagacttgagttctagttctgcctctacgacccattagtgccatcacctcaggcatggttgagtgaccattatgagttttaattatgtacagagtgagggaggattgggctacaaggttaagaggagcactcatcccataagctgtgtatcacagctcacttaactgaggccagacaaccttattgaacacagctgtgtgtccaggaataaacagaagaggcttcagtgtaactgccagatattttccccataacttaagacagcagattagaaacagtagttaataggaaatgcccaacacctgggagtccaaatgaagaggtcctttcacttatctgtgaaggaacttttggcctatactgtctttattgatggcctggataagtgaactattattgtattcaatctggttcacatatagtcttcagtaaccatttctcaccgctaatgaaaagctatctgtaagatgctgatgaaacagctttgtagtgacttgtttctcaacctctgaggcattgacctgaaagtaatcatagatgctcttctaccagtgaccccgatgttagcagttgttggggaggtgacacataaggcagtggccatgcgactttcactctggcctctgtagattcgcctcgatttgagaggtaagtctgggttttgtctagggaaagccaggctactctgtaagtctgaaaatatgtgttttagtcttattgtgggcccttaattaaatgtccatttctttgtgtataaaatgaaacagttggtcaggtggtctccaagtttctttctgacattgtattcttctgtgtgagtttgcccttcgatttcagcaattctgttatttttatttgcttaatcaccaaatgaagccattcaaaaggttaaactattaagtgtttcaaaagattcagattatgcctggaacatagctgagtaatctgaatatattttagtgtttgcctcaattagtagaagtaagttgtgctgtccttgggtaattaaagggaaacttaacagcctttcttggaaatatatgtattctgggtttttcctcaaaaatgcaggagaggaccattggttctgttagctgctgtgtggaggctgagagagcttagggaaaccttcccaagagcggacatttgagctgtcctcaaagacttgacaggagaggagtggggatgggaaaggaattgaaggcggagatactgtgtgaacaagggcatggagacatgacgtagtgatctacggctgaagtttcctttcaggtgtgaagtgttttttatattttgagaactttgaaattttccttttctcttagattttaatcacatctccatgtggacttcatctttatagactgaggtgttccaattccagttaggcctagtctttgttccatcccttaagccattttcatagttcatcttttgtgtagcagttacatatgtcagttttgagcaatagtgaccaaaattttccacagtatcacagatatgagtgattcacagatggttaaagtcactgcgcactcttccactgctcctccccaccacagttgtagtggacaaaacattttatgaaaactcttacatgtatagaactttgtcttctttttaaaaaggatagcagagaaatcatctttcttttataattcttaggtatgtcagtcttctcaccttaaaatgcaagagtgttttctgatacagcattgaagtatcagttattttctatgtgtttattatatgtgaattagaaattcaatgaagtgagttctgtggataaccaaattgagttcctgcttcaggaacctttctcagtaattattaatctttttagttattggaagaattttgaaaagaatttcaatgaaactcctaatatatttgctgtactcaattatctttcttccaatttagtaaacagcctttttactaactttttagattccgagagcttgagtttgttcttagtgagctgctaggcaattgacatctgacatcttaatgggagactagaataatattcctctccatacagaggaactcttaaaaaaaaaaaaatctgtaagacctagaaacctgtgaacccaccttctgtgtaatcctcatgtaacactaaagatccagcctgctagcatgggtctcatagattgaggcagtctctaagtgatcatgttacttaatatttacagtataacctttttattaatttctttttaatgaccatgactgtgactattagtaacattttctaccagtagccataaaaatccccctcaaaaaggtgataatatatttcatagtataatggaatttcatagtcatttaacttgagaggttcaaagaagaaagctgtattttcactgacaggatcacatttcaattgcaacttaacagaaagcaagttgaatcctagttttcagcctgaacaaatgttctgattctggtgaactagggaatttaaaatatctttatatgattataccacaactgtgttctcttgctttctctctgtaaacatgttaaatccagaggagacagaagggaagacatttaatctgtatttgtaatttggtattgaaagactactgactcttctaagtaagccagtcctgtaagcatgatttgtatgagtgtctagcatttattttctttaaaaaaaaattacacatgcatgtgtatatatatatgtgtgtatatacatacatacagagaaaaacacagcatgttataatcatacaaagagatattaatggatggaagaatgatgggtgactattgcaagaatttttggccatgattgaaagaatcccaccactcttttgccacatacgaaatccacagatctggtaagccaccttaatatctgtcatagtcctacgtgtaaaacttattcactaatttattattatcaccagtaacctttatttagccaagggttcccttacttactttaaattactttgttacttattggtaatttaacacccaatgtgttactaacagttgaaaacttgaatgttgccataaatacgcaatggatatggtttcaggtttgtagctaagtatgattccctcacagcagacatgtgagccaaaagactgaacagtgttgacatcagatattattttatttactttaaaactggttatatggataacatactttgttttgcacaacacagtaggcagtcaataggtgaagtatttgttcctgtttaatggtggcctgttatatatcacagctgctgaagcagaggttcagaaaagtcaaattacttcactgagattgggtaacctaactcccaacttaaataaatctaatgcctttctaccactgtcctgccctcttttctgattgtggaaggccctgaaagcattaccaaagtttcaaagttacctaaataacatttcctaaaaatgacatctaacgaataatgaaacatcaaagtaaaatagattttttatatcatttaatgagtagttaagactaggtaagactctgtgcttagtatctatttgtatggaaaccatctcattatttgacatacattacgtatagaatatgtaacagttaaattgttttatgttttggggcccctccccaagttattttgctaacttacaatatgaatctttgtagatgattgaagacattctgtagtgttaccaaacttgttaaaagtaagtggtaaagaacacagaaggttccttgactgtttgtattattttcatcaaaatggctggaggaggagtgggtggtgtcagcagtttacgttacaagttccatatacactttattttgatgaagaccatttgcccactttgctaagaagcgtttagtgtggattttcctgactcttttcctggtgatttaccctttgggaaatgtttccctcgctgttagacttgtgttgtaataatattttgggtggccgaagccctgttatgttgttaacagttgaaaatttgaatgtcaccataaatatacagtgaatgtggttccagatttgtaactagattccctcactgtagtcgtatgagccagccgactgaacagatccttatttggaagccactggtgtctgatgtggccacagaacactgattataactttgtttgactgcctaaacctgtcttccttcctggtccttggttgagggcattactcctaagtcatgtcatgacaaatgaggtcagagttggtacccatcacatttgtttcatcttcacagttttttttttattctgtgcctagactgacaattataaaatgaaaagataatactgccaatgtctgtaacctatataagaaagttcacttctttttgacatctgacatgtagtagttccatttaaaatagtatttgttcaggaatgtcagtttaagcaaaacagtagaatatgagaaaaccaccaaccatcttttgaagaggttgaattgctattttggctcttttgggtaaataaatgtcttactgtatgtaaagatctgagattatgaaagaacatgtaaaattgctaggtcaattattttcctgaaataactgttgttattcataaaaatacccaggtgctaataagtctgccctgctaattttgatgcaggttgtttgggaaccacattttgaaaaacacttacagcagactttctgtaactaaaatttctcagggctgttttaaaatatttctttatttttagttctgccatttctctttttttgccttttccctgtaaggtgattattacgaaaagagctaggtggaccttatcattggaattctagtctttgttttcagttcatactctaatgacatctgttgttttctatatcatgaaatcaggacaaatacaatttttgaacttttgggaggaatattctcagtcactatggcattaggaaaagatgttcaattttgctgaacgtaacttcaggtacacgccatttgggatcaagattgagagaactgtgcttgcttcaggaagcctccacttgagctttggcattattctcatggctggtccatcctcaccctttccttagggaataatcatttcccaggggagatgtattatatataaacatgtcagcatgtcactttttttgtcaacatgtttaagttgtgtttaaattggtttcatgcttgcgggcaaatgttaattttatcaaacctaaagctatagggtcagattatagtgtggtgtacagtttgtagacttataataaatggtcatgtttgcttttatgtatttctgctcatacttgttcataattttaactcattaacagccttcagtgatagcttaattatttaaatttcaatttaagattctgatatcctgtagtgcagaaaccatattatcatagaggcaaaatgtttacgtcttctcatgcatgtcaaggaaatatagtatatgcataatcactgaatttttgaggttctagaaatagtccaccatggacatatacaaatataaaaagcctatagttgtggtttaggaactgtggctcatggaaggattagattgaacaatgtatcattgttcctagagtcagttaagcgtgtaggtttagctagtttgggaacagcctctagcatgtgactctataacacttgcacaacaaacatgggcctgataagtgagcagtaaatctgggctgactgcccactcccagtactgccatcatagtattttgagggcctgacaacaatattaaaagcttaaaacattcttcacaccgttttgtattattcctggttttccagttttattgtttactaaaagtcaatttttcttaataaaaaaagattgtttagttggtcatttgatttctcattagatactaggctttgtgaggtcttacatatatttaagttcaagttttctcacttttcttcagggaagtgggtgacttggttgtcctgatgtctcttttgggcacataaagcacatttttgtcatgttatctttgttcacttttatcagaaaaaattcagtgtctgagcaggtcactatcatcaaaagtgcatgtttgggtttttttctcttttccccttacaacacaatgaagacagtcttaaaggtgtgttaggggcttaaacacttgacagctgcatttttaaaaaagtttctaattatggtatttggagtgtccataaaaagcttctatttataacgtttgtagattatattaaattcctaacgcctaatttgtgccatctgacatcacgaaatcttagcagacttggaaggaaccagtttgttaggtagctgtgcacaggtacaaacgatttaagattacactcctgggattttgtgaaaaatcggttttacaagttttttagtttagaagaaacatattttcaaaaatggattaagaaaagaggacaaaagatacaatatagttaggtttaagtttaaaaacagtttcattctactgatactagttctagattttaaccaagatggaatcattttacaaattgagagtttcagaggttgcttaactcctcagattagtggtttttgctttatcatggacacaaaatatttaccctccaggcatatgtcgttcttaaaacaatgttgtaggtgatcaaatctcaaagtagtatctaaggcagtgcttctcaaacttcaacgaacatacagaggatctcattaaactatagattcttcatcagtgggttgggtggagcctgagtttctgcagttttaactagctcctgggtgtgctcagtgctgctggcccaaggcccacactcttgaatagcaggggtatgaaagaattgatagtatccattctttgaagtttccaaaccttatcacagtaccagtatcaatgttaatctctttcttagtatattatttttagttatttattttactaacctacatgagcactaacctcctactagtgctttcacaaattagcattataaaattataatcctaaactttgaagataggtataagaaagtcatcagtgttttcattactataaagcccattttgattatgttgttcagtgttccttaaataagggttatagattcagcatttgaaaataaaacacacaatcaagaatttgaagtgtgttttagaatttattaggatgagctttggctaatgcttaagaaatattgtttattctttgctttggtttatattgacagaaccgactatcttatggcttaagtaaaaattgattgtatggaaaggtttttagcaattaatattttgcggcatttggttatagggatgagatttttattttatttccaaattattatgttgttccccttcccctaggagccaatatagtctacacttgctgagttccttttctagttcattctctgtctctctctgtttgtttgtttgtgtttgtttttgctggcgaggtgtttattgacaggttgtggtgccgcacaggtcctcaaagcccagccagccagcaggtacccagggcgcagtgctcagcctgcagcaggagggtctccgttcacatgtccaggcttctggttaattctttccctaagctgatagctctctgcaggttgaagtaacggtccagaaacatttttatcatttctgttccttgccttcaaacctgtggcatctacctactgcatctcttcattacttattggtgaaaaccaaactcctattaaagctcttaaactagacctgtcatcttcacttaactgaactcttatctcatttttaacaaaacatattcttggcccattcaccatgaagtttttcctattttaaatattggggtagcaacagaatgaaatttttgagggctttttgcgtaccaggagtcacagtcctggttgcttttatatatgttactgaatttaattacctcaaccctggaaagtaagtaaataaatcagtcccactttattgaaggtagagcagattgataaaaattgcccacacaatccagattgtcattggcagagctgggattgtaatatacatctgcttgacttttcttttccacagaggagtcttccaaaaggaggaggcttctgggtctttaaaaggttggatagaaattaggtgctttgtgggccagttggggaaaagattacccctggaggaagagtagcgtcaagaaatgtatcagacatttcaaaagaatcaaaaatctatattaaatttgtatagctgacaaaacctgatttacataaaggattttttttttttttttttttttgagccagagttttgttcttgttgcccaggctggagtgcaatggcgtgatcttggctcatcgcaacctctgccccctgggtttaagcgattctcctgccttagcctcccgagtagctgggattacaggcgtgtgccaccatgcctggctaattctgtgtttttagtaaagacagggttcttccatgttggtcaggctggtcttgaactcccaacttcaggtggtccgcccgccttggcctcccaaagagctgggattacaggcgtgagccactgcgcctggcccagcatatttttttaagcttcaaaccaccaacttaaaggtgtagaaatagtaagcataataccgccataaccagtttatctctttaccagtgctatcagttaacaaatcatgaacattgtgtattatgtatattacatgtagctttctgttctgacagcagagtttatgtgctagttctggattcgtcttaatagatgatttgaaaaagaaagcatttaaaaggattctctgtaaaaattctactcggctagtagcaaacttatcattttagaaaaaccgttttttactttgagaccagtaagatggagtgacaagaactcccaagccagaagctaaaagacgtgtttttattcctggtaatgccacataactggaattggcagttgccagtagtacgagaatttgcttaactttcaccagccaatgaagttatttgcttgctttcttacctcctattacagtggaagcaatgcttgtatcctattccttcctgctctctgaaggatgactgtgccccatcaataatccctttgcacatcttcagctactctgtgttcacatttaaacacttgtatcccttcctcttgaaaaaacaagaactcataaccacctatttagctttttatttcctgtgcacaactaaatttgtctgcttctttacttcctactcactgtactctcactgtccctctaaaatggctcttggccagtgtcaccaataatttctttctttttttttttttttttttttttttgagatggaatctggctctgttgcccaggctggagtgcagtggtgccatctcggctcactgcaagttccgcctcccaggttctcgccattctcctgcctcagcctccctgaggagctgggactacaggcgcccgccaccacgcctggctaattttttggtatttttagtagagatggggtttcaccgtgttagccaggatggtctcgatctcctgaccttgtgatctgcccgcctcggcctcccagagtctttctgtgtactttcactacacacacacacacacacacacacacacacacacacacacactaaacaattagccttgtccaatacatactgttttataacctatttttaaaaactgtattattaatattttttcatattatatgttcttctaaaacattttcagcagctgcatacagtccatcatatatatccatgtttaaccaattccctatcattaaatgttaactggctttcaaatgcttgctgtaataaatgatactgaagagatgtttatatataagggttttattacttctggctattaatgcaggatactttttaaggtagttttatttgtataatatatctagtttttctttcattgaaacaatgaaactttgctacaagaaaacttagtacttattgcaagtttgtatgtcagataacgtgctagatgccttgcagtcttacatttcatggtatttagctgttttaattcccaactttatagattaagaaatctatatgtatacatgtatttctcagtaagttaacaattatgtagaaaatgttcagcaaacatcaaagggctttgtgtaagaacatgttattcaggagccacaggggaaaatgaaaacttacagatgaagtttaaagttctgctttggctttggagtatgtaagaagatgacttttggggttttgtggtgttttaccttaaaaaggcgttttaggcctaaaaattatgttatttggcattcttatctctaggagaaaataagtgtatgaatttcttatgaatcttgggttttagtcatatggttactcttttagtttacaaactacattgtatctttgcattagaaggggtaataattatcttaatagttgaagatgatttcctttcacttaaaattccaggcataactttttcagatgttgcacttgtaagatctaagagttgaaagttgagtgatttaagggtgaaaaatgtctgttgcagagggaggctggtgggagcagtgagatgctgtgacttaatgcttttacagagctcgcttggcaccctttgattatgagcccacaagataagaattgtttttggaacctggtatttgtttcctaatgcagtggtttgttttgtcttagtcacatcgatcagacaacaacatggcaggaccccaggaaggccatgctgtcccagatgaacgtcacagcccccaccagtccaccagtgcagcagaatatgatgaactcggcttcaggtgagtgagacactgtaattacagcacatggagtaatgcttacgcattggtaaaagttgatgtggaaaatagtcattactcgtttacagaaactgggacatggtgatgtttattgtctctccagtttcatacagaagacatagtctattttaaaataacgtaagctatattattgccttgtatagttgttaacgcataagggggccgataactgaaagccagtggttctttaagatttggttctgaagcgggtatctcaaatttgtagttctgttaattttgacgtatttggttttattctgctgctttcttgtgtctcaggtatttgagttgaatttaccctcttccctttgtggtttggatggaaagccaagctatagtgttcttattttttattattattattttttttttcattttttttttttgctatggtgttcttaacccaacttttaatgtggtgttattcattctactctgaaaatatctggaaggcagtaacttttgtaaacccaaaagaatatttcttattcccagggcaagcatggattattaaacgcatcttcaccttttttactagaagataaacctgagtataaatctttttctacctcttatttggcaatttacttgaatatgcagtttttctcatctacataatggggagtaacagtgccccttatgatagaagggaagatatgaaaggaaataatacaatttatatgaagcctctagtaattacagagtaggtactaagtgaaagtttagccccttcatcttccttatcacatactgtctggcgtctttctcctttgttaggtgggttcaaggccacagttagcccattatgtacctttgtacatattaggaaaaggtgcccttcctctgggaagatgtaacattgtgcctggcatcagagattggagcatttgggctggatttctgaccactcccctggcccccacgctttaccccgctgctcagtgcccaggttcaggacacagatggcaacaatagtatgtggcagctctagtagacttgatggctttctccaccgcccatgcattttccctagataacaagcatatttagtagctacacagtagatttcttaaacagcagtctttggcaagggactgttgtggttgggtgggaagggtggtaccattagttgacaggagggttccttgactaggcgaattcacagaacttgaaatgtccttctgcccctcgtgctggaatgtttctgctgttacatacctctgctcttgcttttggtgggttgaacatttgagttctaaagagttaagagtggaaaacaaagaaaatggcaacatttgtgattgggcttttcttgacatagactttaaattctgaagaaaaattccttaaatctaaatttaactcattatactacgaatacattctcagaatctcttttatatgtgacacttaagtaaaaattttttttttttttttttattgagacggagtctcactctgtcacccaggctggagtgcaatggcatggtctcagctcactgcaacctctgcctcccaggttcaagtgattctcgcgcctcagcctcccgagctggtactacaggcgcctgcctccacacccagctaatttttgtatttgtagtagagacggggtttcactatgttggccaggctggtctcaaactcctgaccttgtgatctgcccaccttggcctcccaaagtgctgggataacaggcgtgagccaccatgcctggcccctaattaaaaaaattttaagacaaaaattgtacaaatattaatatttttacttggcaactattatgtttttttattaccaaattttcaaataaagttgtgaaatctgccctgtatttatggttaaacaagatgattcacattattcattttgtcatgctccatctaaaaattatctcggcagttaatgacagataacattaatttaaactttattttggaagagtaagtatttcgcgtctaacaaggttgattgtaattcttttagaacattgctttggttgtgtcctattatgttttctgatggtgatggtctagagaaatgagagtatttcggctgaaatttatgctttaagtcaaaggtatgtatcaacttggttttagtgggtttttttgttttttttcttttggatggagttttgctcttgtagcccaggctggagtgcaatggcacgatctcagctcaccacaacctccgcctccctggttcaagtgattctcttgcctcagcctcctgagtagctgggattataggaatgcgccaccacgcatggctaattttgtatttttagtagagaagggttttctccatgttggtcaggctggtcttgaactcccaacctcaggtgatccgcctgtcttcggcctcccaaagtgttgggattacaggcatgagccaccatgtccagccggttttagtgggtttgaaaataattgtggatgttttatttcagctgtatgtcctgggcaggtacagtggctcacacctataatttcagcactttgggagaccaaggtgggaggatcagttgagcccaggagtttgagacccgcctgggaaacatggtgaaaccttgtctctacaaaaaaaaaaaaatagtctgtcatggtggtgcataagtgaagtctcacccagttctcaggaggctgaggtgggaggatggcttgagcctgggaaattgaggctacagtgacctgtgattgcaccaccatactccagcctaggtgatagagtgggaccccatcttaacaacaacaacaaaaatttttgtcttgtttgtaaaatatgaaatgttttaatatattacataaaaattagtatgcatatacatgtctaaataatagagctatatgtagtaaagaggtgactttgacacagtttcagtggagtggcaaaaagcgtgactggagggttaggagtgagggggagaaggcataaaggagagggttgtgaggagagagttggaagaaggaactgaaatgagaaaagccacctctgaagaggcttgagcatgtttacagcgtgctagaaggtatttaacaataataatagtataataataattcttatttatataccaggcattcagtgaaggtccattttgcactgtctcatttaagatcccatgttcttcactgtatgttaaccagggataggataactgacagataggataactgacagagcgaagcctccgataaagcagaagcgacaaggaaccactaacgaacgtcctggaggcgctatttttaaatactattaatagtagataatattggggaactgcttctccagaaggtgatgggtgtggagatgatgtttgtttaaggaggccttgtttcaaataaaatactgttcactcaagagaagagaatattcaaagagagcactcgaggttattgccttttatggggacggtcagacagtatgatggggaagggaagagactagctgatgggtccaaaaccaaaggctttttaaaacatccgcaacacatcgattctaggagtcagtcaaaactttccaaattagagtgaagtgttatcttaaatatatatgaattcccagaatcagacaagtttatatctggattattctgaatttggtcatatggagacctgctgatcaagtgctgagggtactgataatatctttacagcacatgcctctttttcctctaaattacatacacttgtctgttgtcttttcttccatttcagtggaagcccatggttttgacatgttttggaatgaatgtcactgtaatcttgatatacctcatgttcacataaaatagccgtaacgtcatgttgacatgttaataaggtttcagtaagcaaaaggatgctcttctctacttggaaaaatgatcttttaaggagtttttaaaatgttagagacagtgaacaaggacaactgtgagagcatgtaagtaaattttgagggtatttaatgtaacaaagcagaaaatggcttccgtgaagcagggtatctacagaaaagtttcaccctgaagggagtgtcttctgagtctgctaacccgaagccttcacataaaagagaaagctacaccgtgcttttgaagcactctactgggttaatcatgctaaatgcaacttgatttacatttttattactcattatttaataaggacttcctcgctttgcttttttttgaaaaagaattcccatcattcataattgagtccagcttcatgttctgctctgagatcttgttcctcatccaactgctttccttaagatactgtaatttcctctagactccccaaacctgttttctgcataattttcatggttgactaggatgaaagatcttttaagattctttccaattcttaagattttatgaaactctattttgttttctaattggctttagcaaaaatgatcagtataattatgcttttataagtcctttttcaaaatatgaggttgaaatggtagatactacatatagcctagagaccagtggtttgtgattgggcaaatttccaaatatctataactgagaatcacccaaaacaaagatgcacctggaaaaggttctagaggcaacactcaatacatccttggaagaagattaatttatattctttaactgtgccatttaagtggcagggtaaatgacagcaagctttgtgaaagaatttgaaaggtgaagaagaggaaaatggaaaaataagaggaaatggaataatgtattaagataatggttgtactttactttatattaaaatattcaatgtataaatatatgtataaataagtctagtctattaaattacttgaggtgaatgtcctttgaaagttaaaatttatagctgggtgcagtggctcatgcctgtaatcccagaactttgggaggccaaggtgggtggatcatgaggtcaagagattgagaccaccctggccaacatggtgaaaccccgtctccactaaagatttaaaaattagctgagcattggtggtgcacgcctgtagtctcagtgactccggaggctgaggcaggagaatcacttgaacccaggaggcggaggttgcaatgagctgagattgtgccactgcactccagcctggtgacagagcaagactccatctcaaaaaaaaagtcataatttataaggctgggtgtggtcgttcatgcctataatccgagcactttgagaagccaaggtgggaggattgcttgagcctaggagttcaagaccagcctgggcaacatagggagaccccatctgtattaaaaataaaaataaaaattagccaggcatggtggccacacacctgtggtgctagcaacttgggtgactgagattggaaggatagcttgagcccacgaggtcaaggctgcagtgagccatatttgcaccactgcattccagcctggacaacagagtgagaccctgtctcaaaaaaaaagttataatataaattagttattatatataatagccttttgatgcctgcttaggatccgtagtttttctccccatattgagagttaggtaaacatttcatgatttttgtgttcagcattagaaaagaaagccctggggagtgaaaagtgatacttccttagctctatgtgtatgatatatattaaatttttaaatagtgtacttgttaacactgatccacaagattgctgaatcttcaagggacagtaaagtcaaagtatattctgtgataatccagaaataactgtatgacaaatgactaggatcaataaaagttatgtcttgatttatattaagcagaatcaacccatttatctgcttttgagaaatgtacatttgataacaacccaaagcctaaatgtcttattacaggtacattttagagaattcattatttatatgctttaaagttagaaattgttgggatttatttgacagttcccaactctaccaatgtagcactttcagatttctctattatgaaaaactgtgaggatttcctaggaaatacctcaagatgggtggagaaaatgccctcttgatcatgaaaggtgatacgtgttagaggaatgtgctaagcaccttccttgaagtggggaaaaatgttcagaagcaagcaaagtgagtagtatagagctgccttaaggtttgcctcttgtgttctcctgcctgcctgtgtaatatctctcagcactgaagatcaaatgagagattgttaccaagaaaaatgagagagctagaaaatagatgtgaaatataaaaatgatgggtaaattacacattgatttaggttttaactttaaaaagcacagagagggtaaagatgtgagaagttgcagaaccaacagggttgaggtgttggtaattcctgctttatgtgctgtaattcagaaactttaaagttttacttttcacctttgaaactgagagacagtttacattaagggttaagaccaagggctctggaaatcccatggacctgatttgaatcccaggcgtcatctattgtccatgaaatcttggacaagttactgtatctacctgtattcttcacttagaaaaatgagataataactcatagggctgttgtgagcattaaatgacagaatccatatcacatagttaaaatgtattattaatagtgtacagtgcctggtataaatgtgataaaataaatgtgatctgatattttagaatttaatcagtttgtaatacctggtagccactgttactttgttaaaaatctgttaccacactatctttgaagttatgtttatctctgtaggctttttatcatcaaattgaggtcattggctcttccaagtagttggttcctgattcttctaaaagttctggattattataagatggaaattgtcagtctgaagtcacaatatatgggaaaagactatactaacgggaaacctaatagcagtgaactataacaaagcccaaagtcagagcaatgaagagatagtgtatttgactagttactctcgggcttgtattccaaataccttttttaaaaacttttaaaataaaaacacttattttttttgaacaaaattgctgttttctttttcccatctagaagttcaggtaaattaagagaaatggccctataaaatggaaaaatagtataaggaaaagcataataatctggaatcaatatagccaatccttaagaagcttggtttgttttatatagcttgtggcttgatttatttgatgattaagttcctgaaaaatgataatatggaaacaaccaccatttttcttacttaaaactatggccaatccatttcattttaataaaatatgccaatatggaatatgatgacttaaattttttctttttgaaataaaaaaagtaattcagttataatatccagcttgcaaatggcattagcttgtaattattgtatctactctagtatgggagttcttctgaagtctttgttaaacccagtgatggctgataaaggcactttctaatcatcgctcttgacttagctgcataatgaagatgccactcgtgtcagggcaactaatggctttgattttactctgatggtgagagcctttcacttcgtctccactgggaatcactctgatgttgtttaattccagtcatgatttttacagtattaatttcttcattctttgtttaaagaaacccacattcattatgctgagatgtgggtatataattactttgtttttcagtagctgcagatcagtattttttttaatagtgccacatatttttaaaagattatttcagtttgagtatcatgattatccacagtaactatctaaatctcaaatgtgttgaggagtactgtgttttgtatgcttagttacatgcttgattattccagataaggtaattctttcctgtcctctttgctttactttagagattatcttctaaaaagggggaaacatatagaaactcaagactgttgagtgctcttgacctgatcttagagcacagatatcaaatattttaaaaaatttactagaagcctttgaagtaatcatttgggatagtaaagttcatttacattttgaatgttattaagattttaaggtaggccgggtgtggtggctcacacctataatcccagcactttggaaggccgaggtgggcacatcacctgaggtcaggagttcaagaccagcttggccaacatggtgaaaccccgtctctactaaaaatacaaaaattagccaggtatgatggtgggtgcctgtaatcccagctactcaggaggctgagacaggagaatcgtttgaactcgggaggcagaggttgcagagagctgagattgtaccactgcacttcagcctgggatacagccagactctgtctcaaaaaaaaaaaaaagaaaaaaaaaatttagatccatgagtatcatttctaccagctctcttaataaatgacttattacatattggggcataaaaatagaagtatttgtgttcaacttttcttcagtgattatttgtagatttttggaaactttgctcagctttggagtagagagaatgagaaagagattaaattatttccatttaagaaccagctcaaatgcctgttttattctcttgataagtgttggaatattatttttgtctttcccactgatttctaaatccttctggttactctattgctacaataattttatgactcataggaggaatatttgtgtgaaagattaagatgctaattctttaaaaatgatattcatagactaccatatatagtcagcataagtgaaacagaataaatcttgcaacagtactcacagttttccaaaataaggttttcttttgatgttagtaaggtaaggaagtggtaaaactttctttaggttaaaatcttaatgaaaggtattaatttgagcagtctgaagtctaagtgtgctatttgtttttccttcggcaaaactttacagaaagctaatctttaataaataaacttagtaaactaactctaagccatttcattgagttaaaatctaaaggacttaagtggcactgaagaaagtctgaagagttgcatattagtaggctcactgagcttgtacttgaccttttcttctagaaagttcttacagctataacctgacaaacaggaaaatgattttttaagcagtttcatagttttaccttgagataatagtatttttcccttcttaaatcattcattctacaaatatcaaatgccctgctttatactatgccctgtgattgcagaatcaagctaagacagactttttttatattaccataaaaaatgttatggcaggaccaggcgtggtggctcacacttgtaatcccagcactttgggaggccgaggcaggtggatcacctgaggttaggagttcgagaccagcttggccaacatggtgaaaccccgtctctactaaaaatacaaaaagttacctgggtgtttggtgccgtttgcctgtaatcccagctgcttgggaggctgacacaggagaattgcttgaacctgggaggcagaagttgcagtgagctgagattgtgtcactgtaccccagcctgggtgacaagagcagaacttcttctcaaaaaaaaataaaagaaaaagttgtggcagatgtatgcactgagtgctgagaaagtagagagagaggaacacatgagtcagtagtggaaaggaagaacagtgaagaattttttttttttttttttttttttttttggacacagggtgttgctccaccacccaggctggagtgcagtggcacgatcacagctcattgcagcttcaacttcacgggctcaagtgattctcatgcctcagcctcccaagtagctgggactacaggcatacggcaccatgcacagcgtttttttttttttttttttggtagagacaaaaggtgggcatggtagtgtatgcctatagtcccagctttttggcagcttttctggggattacatgtgtgagccaccacactctgccaagacttctttagggaggttcattgatttctttatccaaatattgaatacaaactatgtgccaggcatggttctaagttatgagaacggatatacaatgagtcagatattaaaagtggaagaaagaaaaatagaccagttatggtcagagtgataggctggggatggagggagatgatagcttagattaccttctccagtgcaggtctctgtaattgacgtcttttgagcagagatctgaatgaactgagagtgagagccatgtgaatatctggggaagggagagaatgcttcatgcataacacaacagcccgttcagaggccctgagacatgtttggggaacagcaaaaaggccactgcagcatgaacagagtctgtgaaaggcagaatggggctgcattacagtggtgcttgtaggttttgaacagaggagtgacatggtatcagtaactttttaaaaaatagggagattacttggagggcagttgcagtaacccagggagaggatgaccaaagtggtggtgatgaaagtgattgggttgaggacttgagtactagtggacgagtgggaagttaagttagaagaaaagggaagataaaagtagctagtagatgggcaattactaagccctggaacctctaataccatattgctagtggtaagatgatgagcaatgagactgaagaccacctcagaatggctttgtgtcataagctaagaagtttgagccttgtcctgaaaatgttgggataccattaaaaatcttctttaggggtcttctgctatggttttccctatttttattatctgatcatttgaattttgaaatccaaatatctcattttcttatatttaaagctacttccttaggtatagtatacatgaatttttaatgtttaatatatcattggaccaaaatggtagaactattctaagaaagagtagggaactgacatttaagcacctactgggagccatgacctgtgtcaaacacgtgttttaattctctcaatgatctattgagtgttcatctctgttttatagataaagaaagtgagcatcaagcaggtaaaggaatttgcccaaggttagaaggctaataaatattggatcgatccaagatttgagcccaggtctgtctgaatctaaaccctttatagtctctaaactatactgtctttctggagttgaatatgaaactaaagtcatatgaattttatttataatgtatcaaagattttttaatcaagtaagccactgaatagtacttttgctatattgttaaagtttgagttaatggtacctctagaaaaggttgaatcatacaagcggtccttgttagtctttggtattctagagtagtgcttcttaatttgtaatgtgtcaaggaattacctcgggatttgttcaaatgcagttcttattcagtgggtctgatttagtaggattgggacctgagattctgcatttctaacaattttctggtgatgctgatactgctggttaaaggagtgcacaaatagaatactgttgaatggcttaaacttaaatccatagaaatatccttagagatcattttagcattcctattttaggctggaatgaaacctttactgagtacctaaatacaaatgagtggttccatcatttcatgagctcttatttaatataaaaaccctgcaaaatatatgttacctactttttcttaaatctattatttacaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaatctattatttgtaagggcacaaaacaagtctctgagagatggcaacttcacaaagaccgatcatacttttccacagataggctcttaatcatgtcagctcagcaaactttggttgtatttggtggcagtgctaagtcctagggatacaaagacaaaaaagtcagcgtctctacttcttgagtctgttgagaagagaaggatgcaggcaaatgattggggtacagggaggcatctgctataaagaggacatgaacatagtagttggggcaccagtatgctggtgcatagaatgcaggtaagtagtagtgccagaattccaatctaagccttcatatgtatggtccacagtttcatcttattctaccacactgcccattgtaatccagaaggggcttggattcatcagcgtgttctagtagtttggcagaagaatcttctaagtacctataggacatgggtgaacctgaactcaggatggggtgggcaggatggattagccaccaaccactctttgtttgcccaaagcttattttcatcagtatgtttatagtatcattagtttgggaggccaaggcgggcagatcacctgaggtcaggagtttgagaccagcctgaccaacatggtgaaaccccgtctctactaaaaatacaaaaattagccgggcatggtggtacacccctgtaatcccagctactcgggaggctgaggtgggagaattgcttgaacctgggaggtggaggctgcagtgagccaagatcgcgccactgcactccagcctgggtgacagagcgagacctcgtctcaaaaaaaaacttatttcttttaccaaaacttgatgtatagactgccttttcttcagtaaatgtttattttcccatattcggcttatcaaagccacaaaataagttagtgataataatatagtcatgtattgcttaatgactgggataagttctgagaaatgggttgctgggtgatttcataattgtataaatatcatagagtaggcttacacaaacctagatggtatagcctattatacacatagactcaatgatacagcttatcgctcttaggctacaaacctggacagcatgttaccgtactgaagactgtaggcagttgtaacacaatggtaagtatatgtgtatctaaatatatctaaacatagaagaggtaatgcattgcactataacattaccttatgacagccacgacatctctaggtgacaggaattttttagctctattataagtttctgggatcaccattctatatgtgatccatcattgactgaaatgtcattatgcagcaaatttgtatataactatttccattgcgtctgcctaaaaatcttagtagtgtgggcagaacttgattagggattgtttaaggcatatatggtcaagcatatgaatttcagatatttatgtttatggaagactcctttgtaaaaaaaaactgaagaagaatcagaggtgatacattttagttcctgtttattttgaaagccaaaagtctgcacaaattgcagaccaaagtatcacaaactactaacaaggcagtggtttctaataaatgttgctatctttgtcctgagcaaccttgcaaaactgtacattcccactcataaaaaatggagaactttttccctatagtctagggcagagtgataagtttttctcataattccacatagcttatagttaaactcagtgtagaagagtgatgaacacaaaacaatacatactgtattcaagaaatcagaacaggtgcaatttaaatttataggtggggaagagtcttactagtgggacagattggagaaaagcttcacaaagatatggcataagaatagagtagaattgggtcaggcacggtggctcacgcctgtaatcccagcactttgggaggcaatgtgggtggatcttgaggtcaggagtttgagaccagcctggccaacatggtgaaacctcatctctactaaaaataacaaaagttagccgggtgtggtggtgcacccctgtaatcccagctactcaggaggctgaggcaggagaatcacttgaacccaggaggcggaggttgcagtgagctgagatcacaccattgcactccaggctgggcaacagagtaagactccgtctcaaaaaaaaaaaaaaaaaaaaaaaaaaaaaaagagtagaatttcagtgggttgaaaacaatggaggctgggaggacacaggctttggggtggacatactgagaatgtagggaggtggaaagtgcatgacacttctgggtactggaaagacaggagtgaacaagccatgcggctgggaggactgaatgaattactaaagtgatagaatcatcttaccagagagaaagcagctgatgaagtaggagaagaaactatatgtagacaagttattaggaagaagtgacattcagagtgggaagggatgagagggagttagctaagcaaagaaggtagagagaagagttcctgcagggagcaactgcagttgtgaaggtcctggagctgggagaggagatgtttgaggaactgagagaagattgaatgaggagggatgtgaaatgatgtggaggaatagatagagcctggcatgttggatgctttcagtaccgaagcagtgctatataatgcctgactatagaggataacccactaaaaatttgagaattttcctttagggagctgagccttgagtcagaggacttcctccttagaggaggtgaggtaagatgatcatgtggctgtggtacatacaaagtttaatgttggagttgaataagaccaatttggaagttactgctaaaactttgtcatggaaatgtgaaagtttatgtgaaagtttcaaggtcaaaagatcgagaccagcctggccaacacagtgaaaccccatctttactaaatacaaaaattagctgggcgtggtggtgagggcctgtaatcccagctactcaggaggctgaggcaggagaatcgcttgaacccagcaggtggaggttgcagtgaaccaagattgcgccatggcactctagcctggcgacagagtgagactcggtctcaaaaaaaaaaaaaaaaaaaagtttatgtgaaagttttgagggacaaatggaaatggcattttgaagaaaccccactcaaaatatgggaacatatcttgtgaagtgtcaaatgtccagttggaggagaaagactagtattgaccctgtgagaggcattaaagatatgggagtcatttatgtgaatatggcaagccatgggatttcatgaaagttccaagaaaagaggattaaaaaaatatgattactgtttgtcataattgtggtgtagtattcaagagcatgatttctggagagctcaactgtcaaggtttgaatctcactctgccacttactaggttgggctgaatgatcctggacaagctaacttttctttgccttagattcctcatctgtaaagtgggtataataatagtacctccatcgtagggttgttaagtgacttaacatttgcttgcaaagaacttaggaaaagtgccgtgtacatagtaagaacagtttgtgaatcatcataaatacacgagaccagaatttcaaaacaagcagcaggcagaatgttcctttaaaaggtcattgaatgtacttttccagctactcttgttactttctaaggaaactacttgataatcctgtactttgtaggactcatcagggtgtgtttagtaaacttcagtgtcctaggtgacttctttattcccaaattgtggggcaggtgacaaggggaggttggtcctctaactcgtggtgtagttaatcaggattttcctgtttgaatagacatggcaaatggttttagttagtcattactaatgcaagagggtccttaggcaagagcaggaagttaatggtgagtcaccttcagtgttatgacatggagtatttctttttaaaatatcacagggagttggtttttgctatagtagctaagttgtcaatcaagtaatactagtagtaaatcttacataaaaactcgcttccctcaagtttaagtagttctaatttatgcattattttatatattgcctactactctctttttgcttatcctgaatcaaatttctcaccctctgtcaatctaattttgtgttgctataaaggaataactgaaactgagtaatttataaagaaaggtttaatttggctcacagttctgcaggctgtacaggaagcatggtgccagcgtctgcttctggtgaggacctcaggaagcttacaatcctagcaaaaggcaagtgggaaccagtgtgatacatggtgcaagaaagtgagtgggagaagtcccaggcttttaaacaaccagatctcaggtgaactgaatgagaactcacttatgaccaaggggatggtgcgaagccattcatgaggtaccccaccccccaccccgtgacccagtcaccccccaccaggccccacctccaactttgggaatcccatttcactatgaaatttggaggggacaaacatccaaaccatgtcaccctctttacgtctcattaaaatgctggcctgtttctctcttcctttttgctatagggcctacttttaatcttttcttcgaaagaagactttggtattggtggtcaggcatgatagcccagccttgaaaagcttccacatctttttcacgtctaagggcccagctttcgagtgtgtaaaagttatttggggtgaaaatgtgtattatccattctcaccaatctagaggttgtcatgagtttgggggattggaattactgtttaataatggtaatcccctttaagtatttactggttgaaataattaaagtttttctggtagattcttaaccataaaaacgaagcgaactgcttattctgccccatccacaggtagcagcctcttcatgcttgcccctgcctggaatgcccatgcccggaatgtcacatgtttggctaggagtgcatttaggtcagagcttacaggtcacttcctgcccttgatctgcttttctaaaaaactgtttcccatttttctttttctttcccatttttcatttttctttctttcatgcatgctgctttatttttgctgcacgtatcattagccaacattgtactgtcttctatctggaacataaattccatcagatagggactatgttgtttattgctccatctccagggcctgaatatagtaggaactcaataaatacttgttgagtaaaagtatttgctatatccctgtcccttcagtttaaatgatacataaaaataatgcagaaattgagcttacatagaaagaatgaaacaatattttgttttacaagcataaacaaaggattttaattacattcatttcagccaacatttattctattttttttttttttttttttgagatggagtctcgcatccgtcgtccaggctggagtgcaatggcacaatcttggctcactgcaacctccaactcccgggtacgagagattctcctgcctcagcctcccaagtagctgggactacaggtgtgcgccaccacacccggctaattttgtagttttagtagagatggggtttcaccatgtcaccatgttggccaggctggtctcgaactcctgacctcatgatcctccctccttggcctcctaatctatttctaattagtagatcctatactggacaaaaatggaaaatgcaaaatatatactcctgtgttcaggaatttcacagtctagccaggaagaaaacatgcataatgaaataatactgaatgagccaggcgtggtggctcacgcctgtaatcccagcactttgggaggccgaggcaggtggatcacaaggtcaggagatcgagaccatcctggctaacacagtgaaaccccgtctctactaaaagtacaaaaaattagccaggcatggtggcgggcgcctgtagtcccagctacttgggatgctgaggcaggagaatggcatgaacctgggaggtggagcttgcagtgagccgagatcatgccactgcactccagcctgggcgactgagcaagactccatctcaaaaaaaaaaaaaaaaaaaaagaagatcaaaacaaaaataataatactgaatgataaatgctatgacatagatataaagaaatttttttactagcacagagaaagaactcttcatctgtattgaggaagtgaaaagttctcaactaaaaatgtttcgaagctaaatggccagtagtaattctcggtcgggcatggtagctcgcacctgtaatcccaccactttgggaggtcgaggtgggaggatctcttgagctcaggatttcgagaccagcctgggcaacataatgagaccccatctctacagaaaaatttaaaaaatagctgagcgtggtggtgtgcacctgtagtcctagctccccaggaagctgaggcaggaggtcacttgagcccaggagtccaaggctgcagtgagccgggattgcaccactgcactccatcctgggtgacagaatgagaccctgcctcaaaaaaataaaataataggccaggctcggtggctcacgcctgtaatcccagcactttgggaggttgaggtgggcggatcacgaggtcaggagatcgcgacaatcctggctaacacggtgaaaccccgtctctactaaaaatacaaaaaaattagccgagcgtggtggtgggcccctgtagtcccagctacttgggaggctgaggcaggagaatggcgtgaacccgggaggcggagcttgcagtgagccgagattgcgccactgcactccagcctgggtggcagagcgagactccgtctcaaaaataaataaataaataaataaaataaaataataactcctatgggtcacatccattctttttacttcctgccacctactccttatttctatctggtcattaaggacaaatgtgaaatgaattttggagacggagaaagactctctcaaaataaataaataaaatttaaaaaaaaacgtactgcccttgtggtgcctgttttgtcatggtagatttgcctaatcctagcagacgtgactgtgtactattcccagacctgcatagattgatctccaaactgcctaaaatgaatagatgtggttgtgtataactcagataaatttgagaaatacttctgtactagctgaagaattctaagtggttgtgttttgtttgtttttgttgttgttttttgagacggagtctcaccctgttgcccaggctggagtgcagtggcgtgatctggctcactgcaacctccacctcccagattcaagtgattctcctgcctcagtctcctgagtagctgggattacaggccctcaccaccacacccggctaattttttgtatttttagtagagacggggtttcaccatgttagtcaggctggcctcaaactcctgacctcgtgatcccctgcctcagcctcccaaagtgctgggattacaggcgtgagccaccatgcctggccctaagtggttgttttaaatcagtggttccttagaccggcatcagcaccacctgggaattttcaggcctgctgaatcaaaaagtataggggtaaggctcagcaacatgtgttttaacaaaccttccaggtgattctgatgaatatttatagcacattataatcagaatataaattgaacataaaggcatcctaaattgattttgatcgagccactgtggtctcctcttacatttatttttgtggtaatcctacatttccccccttggacttaaccttcctgcatcctaaccctagcccaaacagatgattgaaacacattttcactaagtgtaatttgtttcactttcagaaaacatatcactttttgctttctctccttttcatggttattcaacagttagtttaagagaatgacttggaatcctgcattgagaatcaagtcactgaatttcttctaaggaccactggactaaaaattctttttttgtgaataaagcctttatctgtattgttccattaacactggaagaattgtttcttttcagttttctctatcttaattctatgacaaagatagtgtggtgaaaagttatttaaaggtgatcttttctaatctattccttgcctttggtgcgcagctttctttcagtacaaagaaagtatcctattttgggccatctctttccatataacattatattttacccagagagtattaaatgaaagataaaatgaatataaagtattattttgtatttggtatatatgtgttggtataaatgttaattgcaaataatataggttctacatgattttaagcttacagaaagttcaaagtattacttaaaaggcaagacattgattcttccatcaaacatttattgagcagctattcaggtattagcctacaagcttgtaaagaagaatgacttgatcattgccaggagaacagatatgtaatcaagtaattacaattctacctgttaaatgtgcatggagaatggaagaggaaactaatttctgtctgaggtagtatggaaaggctgaattaaagaagtgacatctgagctgtctcttgcaggatgactaagagtttaggaggtaggggatgcagagtatttgtgataatgggaacggcatatacaaggagatggcatgattttatggaaagttggtgggaaaactgggtatctgaagaagacttcagaaatgaatccagctagtaaagaatttaggcattttcctcttgatggagagcaataggaatgttctttagtaagaatgaatgacatgtttaaaagatgaatcgaaaatattttaagaagagaaacccctggtgactgatagaggaccttggagtgagaagagatgacaagccagttactgaggaagtggtcaaaaaagagagctggtaagtattgatggctgagttctctgagatggactgtggcagacccatcggagagaatataagtggaatttacaaaatgaagtgagtggagcaggtagggaaggttggtttgtatcctaggtatctcttgtggctctcattcagacagctaaggtggggaataatgctgtttctgtgtgtgtgtgtgtgtgtgtgtgtgtgtgtgtgtgtttaaaccacatatatgaaacccatatattcaagcaggcttgaaagctacaatgagggccgggcgcggtggctcacgcctgtaatcccagcactttgggaggccgaggcgggcggatcacgaggtcaggagatcgagaccatcccggctaaaatggtgaaaccccgtctctactaaaaatacaaaaaaattagccgggcgtagtggcgggcgcctgtagtcccagctacttgggaggcggaggcaggagaatggcgtgaacccgggaggcggagcttgcagtgagccgagatcccgccactgcactccagcctgggcgacagagcgagactccgtctcaaaaaaaaaaaaaaaaaaagaaagctacaatgagatcttggggttgttgagttgaggctcccaaaggcattcagtgattgctattgacttgttcatcaccatgtatagtcacatggtattttcagtgcctaaaaattttaaatacagttagttgttttgcaaaagctttttataattcagccattttacagttaaagatagtagcaaaccattaatattcagttttggagttctgtctttctggggaggaaatagagcccaaaatgacagtgaaagctggtgagaaaaggtttgatatacatgtgataaacaggtttgcttctcattcagcctctggtaaacttgggatgtgtacaacaaattctacctctggacttggttagtagtgtgtactacacatccaggactgaaggggagccttcctaaggattctaggcatggagaaaactaattccacacgtctgcatttcctaacaggattttaccccatcaaagtagacctttgaaaatgcagctgcaaattgatctgttcctaatacgaatgaaactggcctaaaaataggactttgggtcccatgggccttgtgtgagtggtcagtttaaccaaagttacttattcagcatcacccatgagactggtgtggactgccaatacaggaagaagggaattgttctatttgtgcataggagggatacttaggctctggtcatctgtgggagatgagtgaaaagaagtatagttgtgaagagcagtcagtgggttaggaatcacgctgcctggctttgagtaccattcctggtactaactagctttgggatcttgtaccagactgatcaacctggcactttgtgcctcagtttcctcattagaataagtagtactactgcttatgtcatttgtttactgtaagaattaaatgaattaatgtacataatatataagaacaatgactagcacaagataagtgttcaattcatgttagtccacagaagaaaagattttagccatgtactgaccatcccagtttgtatctcctgccctgcctcttttgattcctgttggaaatgggaactgggggagttgggagggacaaggaaatcaggaagaattatgtttgaatactttagttatttattctgggcctctcttttcattgctgttacctcccaagagcaattgtcttgacttctctattcctataaagataggaaaatccttttagagttaactgtattctttagtcctatctctcaaatgatgttccttaaagtttgccttccaacaactttagcacttatcttgcctcctcccaagcctccaacaagcttaaacttcaaattgcaaccccaacccattagcaatttctggtctgctgaaaaataagctttgtttggactgtagctttctgtcttacagttttcttggtgtgagccactcacataaaacatggaaataaatagagcttggctgtcttagctaaaatgtgctttatattaaatagaatgtttatgatattttcaacgttctaaaaatacttgcatgtatttcttattaatgaaccttggtgttcctaggaaggtattgtcacaaaactgattggattgggtggtagtttctgagctgcaagctcttccgtgtcttatgttaacagtaatagtaattatttgggccatgacttccaaaaggattttttggaaaaaaattttttttcttcatctctgtgttgaggaatattcattttattatttggtggtttctttttagtggagaagaagcaggtatataggtttacctttcttctctgaacacagccttaaatatgtttcaatgaattgttttatgttaagatgtgttttctttttaaattagtaccccctcccacttttttttaggtgcaccaaataaaaaccatgatttttttttttttttctgtattataggtcctcttcctgatggatgggaacaagccatgactcaggatggagaaatttactatataaaccataagaacaagaccacctcttggctagacccaaggcttgaccctcgttttggtaaaggttcatctcaaaacctttttagatgcttttggttgctaattttttttgtaaatatacttcggaaagcacatttaaataaaatcgcattgctttatagtattaaaaaatgaccctgcccacccaatgtttaccagtagtgtttttatccttctcattgtaaacttgagaaatttagatctgaatcagatttttagggctcctcaggttggggtgggggaatgtcataatggccgactaaccagaatcacttgttcctttcacattttgggagaaacacagtgattgtttttaaaatgttttttttttttagctgcaataataatcaggctgtcatgcaacacctcagaccaggagtaccagcttttgtcagtgacctgatgtctgcttgtgcttaggttctgagagtgatgagtaccatcttatgcctgggtgttgtagtgtttcccatcctaaggaggaacatgtcaccccagaaatggcccagtgaaagcattttgccccctcttctgtctctctcgaaaaataaatgtttttttttcttcattcagaaaacaaagaaagccatattcccctccagatctcatgaataaatcacatttgcacaaaggaacccctccccttccaaatgtgtacattttgataagggtgtaaccagttcttcagtgctttttaaaaaatgtgtgtgtgtgtgtgtgtgtgtgtgtgtgtgttttaaactgttttcagtttttcatttgggtttctgagatatttttccaaggccatggaatatgcatctaaaaaagagcagataattgtggttttgaagcttcatcttggactagatgcagctaaatgaaaacaatgtgcagatcactgaataggtcagactgaggggactcggaacctttgaagctttacagggtttgacctaacaacaactgcggggccctcacgggaaagaggaattaactctgtgaatgccatgaaaacacaaccctgcggggggaaaaaagaaaaaactgtatctggagctggttggataaaataacttctccatcgggaatattatgagcagttattttgtgtcttatatatacctttaaaaaaataaattcaagtttgccccaaactgactgaaccccctgttcaagttaagtcaatggcaggatcagggcagtgatgtcattttgacagataaccggtttggcttaaatactgtccttttaagcttcaagacctgtttgggtgttaaaaaaagtaatgaggtatgttaataatttgcaacttcagattctgtttactatttgaattagcccttgtgattggaacaggaaaccaagtaagatagagaatttaataaatgcggccaattgtttggactggaacaataacagccatgtttccttaaattatctctaatgaaatgaatgaattcagtttctccacattttggaaattctgaagaatggtgttgcggaatttttttccctgacataaggttatgaaagatgatgacgaacgctttaccaactgcagagatcaggaagaacaaagctttttaaagaaaaaaattttttcctttaaaacagtgaaataaaacaacttttctgtaagcttaagtagactattgattacacacacagcttggtcttttgttttaagaggaggaggtactttaaaaaaacactaccaccctccagcacgttatgtacacacaggcatacagttagatgtgcccagaaaaagtttcataaaattctcttattgcatttagtttccctttttgggcccaccgtgtgtgtattccagacaggcttgacaatatgccagagctttttattttgtggcccgacttttaatctgttccagaccttttcactcagagagctcaagtgtaactgaaggggggcaggaaagaaaaaaacgtgtgggtttctctgatctagagtgacagcaaatagagacaagctgttagctgctggatttgaagttttccttgaaatcagaagttctgcatagtggattatgttttatctctgccaaagaaatataaactatccccttgtttctgaccctttgggccatacaaacacaaacaaatggtgtaggatattgctttcatgattgtggagtttgcttttcgatattcttcaaatctatattaaaatatttatcaatttttggcttaagtcaagtagatgtgtgtctttcagtgtcttagaatgggagctaagcccctagagaagcttaattttagctccttcaaacaaccccttttatatgtttatttatcagatgctttcagattaattatagttagaatatagccatttgctttaagattaaacatatttagtaattacacttcatttgctgcataataacgtttcagtcagcggcagaccacatatacagtcgtggtcctatatgattctaatactgtgtttttactgtaacttttctatgtttagatacacaaatactacccgttgtgctacagttgcctacagtgttcagcacactaacaggctgtacagttctgtagcttggggcgataggctataccttacagcctaggcatgtagtaggctataccatctaggtttgtgtaagtactctctaagatgtttgcacagtgacagaattgccaatgatccatttcacaaagcatatcctggttattaagtgacacatgactatatttatagtatcaatccttcacatctcacatgaaattaatgttatttatgtaattttagggaataaaagagtaatttgttgtggattgggttttttaatgatttttttctttaacatttaaaagctatttctttaatattttaattttagagaattcattagtaatttataacaaatcatgaagtgacatcagatggcaataaggatgccctgatgtttattgagttttaagaaaaatagggctttttttgtttgtttttttaaggagtcatattaggagtgtttttactctttgttcaagaaaatggttccttgagtattatgcaagccattaaattatttcatataaacacataggaggtgattttttttccctggagattttgtactggcaaacatgagtctcaggtttaaacatcaccttgtatgttgtagatctattactgtatataatacagtcatggacattttccagtaaaaggcctaatgaaaacacaatgaaattataattgctgttcagaatgaaaaaagatctttaaaacactaatagttgataaactgatctttaatgttattttcgctattgtttatattataaaaagatgtattaaaatattgttaccaatctgtgttttaggaaataagtgctgatggcaccactgggataaaaatatttggtgtaaacaaaatattggagcaagagatttggggaaaaaattatacttctgaattttaaagcaagtaatgaacagtccagagtgacaaaaacagaatatttaattcctaactacagttctgtgcacagaaattctatgtgtagaaatgtcagaggtattaaacctcataggttgattttggttcctttgtttcagtttcccaaaacttgctttctgtgcatttacatacacgtgtgtatgtgttactataatgtcttgaaataagaaataaaaggataagtaaaatacaaatacctatatgcaatttattaaaataagactaaagccgaaggttgttgagacttctttttcatcagagttaaatatttggcattaataattaaatatctataaaaattttgagacattcattaacattttttcttttttaagccaaatatttctgttgttaaaaataatattttccttttgatgaaaatgcacctaacaaccaactaaataactaagaatccatcctattagtgttgggggaaaaccactgaagtctctagaaaccaaattggtaactttattaatggagtcttgagcaaagagaatgtcagcatctaattatttaaattttatcaaagcaagtctcttgatagctgtatgctaaaagtgaggttttttttgttctgttttgttttgttttgaggtttgaggctttttttccccttatcaactcaagtctttcctggttatcctgggctgtcagtatttggttatggactacattaattacttagcgtacagaggaaaagatgtgtgttttagataaaaagagctattgcgagctaaaaattattaacagatggccaggtgcggtggctcatgcctgtaatcccagcactttgggaggtcaaggtggatggatcacttgaggccaggagttcctgaccagcctggccaacatagtgaaaccccatctctactaaaaatagaaaaaaatagctgggagtggtggtgcacgcttgtagtcactcaggaggctgaggcatgagaatcacttgaatccaggcggcagaggttgcagtgagtgaatatcatgccactctactccagcctgggcaacagagactctgtctcaaaaaattaagaataaaaataaaaattagtaacaggctggatgcagtggctcacgcctgtaatcccagcactttgggaggccctggtgggcagatcactttaggtaaggagttcaagaccagcctggccaacatggtcaaaccccgtctactaaaaatgcaaaaattagccaggtgtgatggcacacgcctataatcccagctgcttgggaggctgaggcactgagaatcacttgaacccggtaggcagaggttgcagtgagctaagatggtgcactgcattctagcctgggagacagagcgaaactccatctcaaaagccgaggctgatggatcatgaggttagagatcaagaccatcctggccaacatggtgacaccccatctctgctaaaaatacaaaaattagctgggctggtggcacgcacctatagtcccaactactcaggaggctgaggcaggagaatcgcttgaacctgggaggcagaggttgcagtgagcccaagatcgcaccactgcactccagcctgggcaacagagcgagactccatctcaaaaaaaaaaaaaattattaactgataaaactcacaaaatttggccctcataatgagtcctctaatcatcattttttcagtggggagaatgctactcttctgatcactgcagaacattcaacatccctggcccgctaagtgccatagcaccacacagccattacgattcctcggaccaccaacacttttttttttttttttaaatgctgggagagttagggaatatggtctaaaatctgagcccctctgagatcagggaaattatacccaaggttatatagttaaatggcaaaactgaaatttgaatttgatcttttgatacctagaatttaaaagaaatttagattcaatgcagttaatctttcagaaatacctactaatgctgatacatgaaaatttgagagggagaaaaatagtggttaatgcacttgcatcttgtattgtgactcatcttgaataagttacccaaagataatgagtttttctttttttcttttcttcctttattgtttctttcttttttggagagagggtctcactctcatcgcccaggctagagtgcagcatggctcaatctcagttcactgcagccttaattcctgggctcatacaagcctcccgcctgtagctgggactacaggcatgtgccaccataccctgctaatttttttgtgtttttagtagacatggggttttgccgtgttgcccaggctggtctcaaacccctggggctcaagcagtctacctgcctctacctcccaaagtgctgagtttacaggtgtgagccatagggcctggccaagtttctaattacgtaagagaatttaagatctctgattggaacagactttaaaggcatctagttgaattatttacccaattcttgcctcaccgatctcagctttgacctttccctttactagtttacttcattatagtgtagcccattctacttaaggaaaattctaatgaccacaaagtttatatttcttgattacccaaaaatttacttcctttcacatgtgtgaatacagctctaatcccagcagtgttctcttctaactgtggtttctctggtttttcatgtgttcagagttctctgttctttatcaatttactcacttctctggatgtccttcattttgctagtgcttctttaagtgttatattctatagtgtttcatatgtacattatcctgtgagaaaaatagttatgtcattgctctgacctgtcattttcaatctcctccaaaaatctttcttcaatctgcagtagaggctagcatctcttttccacatgatagttacaacaatgtacttgattcaactgaattaaattgggatgtagaaaaatttaccttctcagttggaaatcaagagacccaagttctgctatcacaatataaccaactggatcagaaagatacctaacttctcttgactcatctgtaaaatgtgactggattagactggatgctcttaagaatatttccactctttaactgaatacaatatgctcagtaactgctttggactcttgcttaaggttacttctcaatagcctttttgatttgagtgcattgaggtttcagagatacttttgaactatttattgcaccatttaagtttaactttggtcctctggtcacagtgtggaattacttttgaagaggagacagggaaatcttccagcctttaatctaaagataagccttatcacatggtgagtatgtccaggcaaacaaatctgatggggggtgtgggaagtgctgggctgaatagttaagctttgtccacactctcaaactcttggaagcatatgggagtttaaacatgttcatgttagcaaagttcagctttattgccttaaagatgatgccttgttggtacactttgtttctaaaatttaaaactcccataaagttgccatgacagaaagtctaatgtaagcagatttgaagcctagttccaggccatgtgcttagcaaaacctgatttaagacataccaatagagattgttagtaattattgctctcactacattttctttttccttcaaaagcaagcatttgcttaaatgaatattttaatacataagattatagaatagatttcaaaattagttccacacttgagctctgcagtttttaaaattttatgttaaattcagtaggatatattctaaaaagtaaacaactttagttgtattcctctgtccagtatgtctcaactatgttttgtgaaatttcgctgttcctttttaaaatgttttattttttatctaaaaataaatactttggttagctagggaaaatatccagtaaggtagttccaaaatagtttatcagttatggtaagcaatctctcctgtactaaccaaggctgagtagacatatgttacggaggataaactaataggtaatttctacttgatcagtatttcattgatgcaattagttaattatacagtgaagaaacatttttatctttctttacataatgagtacattgttcatacaggattttttaaacatgaaagtttaagaccagcaacgtcaattagatgatagtttaaactaatgccttattcgtgttactaaagccgctatcaaacacacttaaaaagaccttacatagttttttgggggtttttttttgtttgatttttgtttttttttttttgagacggagtctcgctctgtcgcccaggctggagtgcagtggcgcaatcttggctcactgcaacctccgcctcccgagtagctgggactacaggtgcctgccaccgtgcccggctaattttttgtattttagtagagacagggtttcaccatgttagccaggatggtctcgatctcctgaactcgtgatccgcccacctcggcctcccgaagtgctgggattacaggcgtgagccaccgtgccaagccttttacatagttttttaaaaggaaactttttcaagttatatttgtattaactctgtattaacagcaaacatcttatatgctggaaaagaggaaccatttggtgttgcttgctactttttgtaccaacccaaagattcagatgtaagaaaaagaaagagattatagaattattggaaaggtcaaatttctgttgaaagtaattggtgtgatttagaaggagagtggttcagattctgttttgttttgttttatactcattttgttctgctaccctagttgctaaggtcattttagaactcattctggacttgcttcaacttggagattctcctgtgcattactaatagcatcctcctaactagggagagaaactattttaggatttatttatttatgcaacaaaagtttgggtgccagttacatgccaggcactatgctagccatgggttgggaggaacaagctactaaacaagtaaataaatcattacaaatgtattaagtatggtaaaaggtactaaacaatgtggggtgaaaggaactagggtggtgggaacctgcttgcacctgggtggtcaagggaggtttttcaaaaaggcacataggaagccaccagtcaaatttcagaccagtttttgtgtttttcagtaaaaactctgaggtatgcatcacttctaaattataaattatcctctgtgaaagagctttactagtaataaatgaaattagaaataaagtgttataattgacctgtttattcattaatctaacatgaattaatagtgacaagtatattttaaaagataatgcccctttatttttttaatttttagttttttagagacggtgtatctctgtgttgctcagtctggtcttgaactcctgtcctgaagcagtcctcctgcctcagcctcccaagtagctggtattacaggtgcaaatcaccatgtctggctgcttctctacagtctcattatctgaactttctttcctaactagaccttaaagtttattttcatagtggggaaaaacatctagctgtgctctggggacaaagagagctgaaagctaattagaacacgttctcccttttctgcctcacctcatttagcaacccttgtgtcctgccctaaactgcttgatgaggtgatgaggagaaaatgttctgctggatttctttttgttttcttttagctccattcatgattgtattgtttgaaaaataacattataatgaatttttatggttggaggagggggaagttgaattgactaaagtattgatatttgttaccagtatttttgaacagctaaagatgtgaaaactttaatccagtttggggaggctgggagttggtgctggggaaaaggtttggctgtgtccccacccaaatctcatcttgaattgtagctcccattatccccacatgttgtgggagggaccaggtgggaataattgaatcatgggggcaatttctcccatcctgttctcagatagtgagtgctcgcaagatcttatggttttataaggggcttcccccttccctgagcactgattcttctctctcctgctgccatgtgaaggagtacatgtttgcttccccttttgcaatgattgtaagttttctgagacctccccagccatgctgaactgtaaatctgttaaacctcttttctttataaattacccagtcttgggtatgtctttattaacagcgcaagaacaaactaatacagtaaattggtaccagaagtggggaaagaagtgcagagtgtgggatggagaggttacttagcctgtgacaaaacctagagtaggatgttagagcaggtgaactgtccccacatattgatcattagagaaatgcaaaccaaaaccacaatgagataacacttaactcccattaggatggctaaagttttttttgaaaagataacaaatgttgtccagaatgtggagaaattggaatcctcatacattgctgttgggattgaaaaatgatgtaaccactttggaaaatagaatgacagttcctcaaaacattaaccataacattcccatatgaccgagcaattccattcctcggtatagaggctaaagaattgggaacgtatgtctccacgttgtgggaacgtatgtctccacaaaaacctgtacccaggtttacagcagtattattttataataaatagccaaaaagtgaaaataacccaaatgtccattagttgatgaatgggctaacaaaatgtggtatattcatataatggaatattatttggcaattaaagggaatgcagtgcttgatacatattaaaacatgaataaatctggaaaacattataaatgagaatagccaggcacaaaaggccatatattgcttaattccatttttagaaatgtccagaatgggaaaattcatagagacagaagtagattagtggttgccagggactgggaggaagggcagtaggtagtgaactgctaatggatacagggcttttttgtttgtttttgtttttgtgactttttttttttttttttgaagtgatgaaaatgttctgaaattagatcgtggcaatgggtgtacaattctgtgaatttgtaagaactaccagacagtacatgtaacaagggtgaattatcccagtaaagagaaaaaattatttctaggcatgatgtcatttaggtatatagtgtattgagaaataccttttgtatattgatcataaaaagatgtattcagtcattaggttaggacactcgtcttttccttttcttttgtaaaagatagcttttcagtgtgaattaaaataagcaatttttactgaaaaactacattttatgtttaagtagataaattattatgccactttatagcgactctctattgatgattcagtccccttaggtcatgcagtaaacacttagagccaggagtgagtgttttgtgttttgtttttactgctttaagacccacagatggcctattagtttgtgtttttagaagaacattaatttcttttaaaaagtctactgttttgtagttttgagtacactcgtaggtatgaggaaaacccaaatatttcttctaaatgttttgaacaagttaatatagctatgctaatatggaaatattcagtgtctgagatttgaaaaaatactagacaaaagcttttgttgtgggagatttgatgtaatgttttaatagcttaagaatcgtttattattgtaaatgtatacccagtaagattactagaattaaatttattattccaaagtttatgactaacagatctgtaatacattgttataatccaagttttgaggttacaaatcatgtaaatttttagacaatctaaaaattgtctgaagtttggaaattcacatgtttagaatgaaacttggggaaaaaaaacctatggtgatgacccctttcttttatttttgagaaagtagtcccttatttttcagtaattgctcagtcattggttttctaccataaagctgtcagggctgatttgttaagcaaaacttgaaacagttactatttcgtagtgcaagaagcacagactctaaattttaaaatattgcataatttttaaaattctgacattttgtggggtttttgttttgtttttaccttttggaaattttattaaaactggaaacattgggatttcaatagttgatagccagaggaagaagttggtaatgctattcttttcttttcttgctgccctgccccctttccccaggaaacaaagccggttttgtttcttgcctgcttgtgaggtctctgctgcaccccatgtgggtgcaccgctctgtgctttgttgaaagacttaagatactcagaaggtaaagaacaggatgcttctggagaggaataaatcccagcttcagtagataaacaaggttgtttgaattggtcatttaagtgagttctttctatggaaaccttgtagtgctgcttgtatccataggtaacaacatttaggtaaagccaaaagtactcacaatagtcatcagagtatttctcttacataattttgtgcaagtttctgtttaattctgtggactggttcttccttcatcttttgatatcctaactaatttttcctgttccgtggttttgaatagtcagataagcttagatttgaaaaagaccttaccaaccaattcagtttgttgtcagcattggctattgtcattaatgattactgcttttggtatctaattctgggaaactggtgagaagcaaaggatatttaccactttatttttgtgtaattttattgctattcagtgtttttcaccaagaatgtatgttatttcataaataacttaatgttatgttacataatgaaaatataatggggaaagctcaaaagcttatccaaatgtttcttaatagatgaagtatttaacagtgtatatagctctagaatctgttttgaaatcaatcatgttttataattccaacactcctcagcttactaatgggctattttctagcaggtttttggtgttttgcttttttattgcttggaaccaaaaacacttttccccaatagttgtttgccttgggcctcaatttacgacatgttcattgtatgtgatgaatctcagatcagttccccaattcatatttaactcatgctatcaaacctggcacagcacactgtataaaatgtttctgtgtggaaatatgttgagtgttgtattgaaacaccgagaagatgtttcaccgaaagagaaggatcctcttatatcgttggctcaatctccactaccttttttctatttagaccttgtaggaaagagaaacatgcatatttttgtaaatcataggaatatttggaaacagtaaatggtatgataaaataggaggagggagagagagaatgtatgtgtatgtctatgtgtttgtggaggagaaggagagaggtataggaatcatcaaaatatggaattcgtctgtaggagtcagagtctttaggtttagaaagaagttctgcagaagagagaggactaaggtttatggagcacccactattccaggtgtgtgagagaataatcagtcctcataataactcaaatggagatgtcagtattgatggtacggatgagaaaaccaaggattaagtgaattaccaaattagtatgcccaactctaatccaagttcatttgactctaaaggctgtgttttttatgatacctgtcaattatgtaactatgtttgttggtaacagataagagcaattttattacatgaggttgttggtgcctggcaaatcttaggtcccaaaaattgttggcttttttcgtatccattgccctataaaataataaactataacctataaggatgaaagttttagccatttactttttataaagccatttcataagtcttcgtgagttaataaatatgttttttttccatatgagattaataaggctttgaacaagctggagcagtatgtcatgttttgacatcccttctctcttcttccagacaaaatattaaaacaagataaccaaaaagacacaactagggtaggaattttttaaaaatctctataggtcagaaaataaaaccacatgaagcattgagggtagtgctagaggcctgccagttttaggggccatttggctcctgagaagaactgttaataaaagtattaataaggaagaggacacacaaaacacgctcaatgggaaaagccaggcgtgcagctgacctggccctggcctaggacaatgtttacaaggattgaccactgtcaagtcacagagtcacaaattgtctagaatcaatattatgtagactatgttttttaaacctcaatgcaactaaatttaaacttataataaaaaagttagtttcaaaaaacatgtcttgccctaccagctattaaaacatactactaaagttgtacttttgtacatattgtacatactaaataatgtttatatacacatatatacatgtatataacttacacgtttacatagtataaacataaaggcagtactgccgtactagtataagaatagttagattaataaaataaaaaatctggaaataacaaaatgtcagaatttattctatgataaagatgaggggaaagatacacagttagcatatggaagaagataaaattagatccattcatcccatacaacagaaaaaattgcagtggatcagatttgagttgccaagtaaatgagaactatagttttttaattaaaatgggtgaatttctctgtagtttgaaagtgaggaaatgtaattcagatttttaaaaagattgacaaatttgagtaaagaataagctttttttttttttttttagacaagagtcttgcactttttgcccaggctggagtgcaatgatgcaatctcagcgtgctgcaacctctgccccccgtgttcaagtgattatcgtgcctcagcctctggagtagctggcattacaggtgcctgccaccacgcccagctaatttttatatttttagtagagatagggtttcaccattttggtcaggctggtctcaaacttctgacctctagtgatccgtctgccttggcctcccaaagtgctgggattacaggcatgagccaccatgcctggctaagaataagttcttatgaaaaacaagcaaaaagatgacaatctgaggaaaattattggtaacttatatcacagacacagatttcttatccttagtgtatagattgtataataagacatagcaaaaataaaatcatactgagatactactcatctttcagatgggcagaaacccaaaattggcaagtccttgggggcaaaaaagcactcttacattactagtgaggatacatcaaagtacaactcctggggtggggcggtggtgtaaatttggcgatatctagcaaaattatttatgctttcaacattcaactaagcaatctcccgtatagacatctacccaaagatatagtagcagaaatacaaaattatgtatgagcatattctgtacagtactctttactaataatgaaaacctaataggaaattggttgaatagaatattaaccagctatgtcaataggaaaatgagggaaaatctctatatactgctttagagttatctcaggatatattgttacaaaggcaaaagcaaagtggaaggaagtatgcatagtatgctaccatatatcaaagaagaagggatgtgtgatgtgtatgtgtttgcttacatttttaagggtagaataaaggaaatactgatacagtttacctgttacctattggaggtaggaggaagcgggtgggaaataaagcaaatctctgaaattcaaagacagaatgtcataagtacacctgtatttcaggtggttggctaattatagaagaataatttcaggtgactttaaagcacagtgattttactttatgtacttaatggaatatcttaaggagataaaattgcaaagaaatctgaaacttgaatcattttagtgatcataatgttatttttagatgattgcgtatgtatagaggacaatacatattaatgttgttagaacccagtttttcagcatgagaaaaaacagttgttacaaaatcaaagtaaaaaccatgcatcctaaatctgaattggaaatatgcattttctgaaggagagtaccacctagaaacagttacaaaaaagcaacagaataataataggtaccccctagtacgcagagtaatgtctctaaataccatttcccactcaaagaaatcagggcttcttcaaaaaaggctgagtaaaatttggggcagggaatatactagatgaccttggaacatctttttgtgcctaaaagcaaacaaggaagtagaacaagcccattgtagccatagcaaaaagatccagcttgacctggtcaaatatggcacactttgaacattgatcagaataactgtgctggattaaaacacatcataaacatattttcaaatctgtgatttcataatgattttttttcccttcgctccaggtagcagagtatcagaattattattattttttttttttgagatggagtctcattctttcgcccaggctggagtgcagtggcgcggtcttggctcagtgcaacctctgtctgcctcctgggttcaagccattctcctgcctcagcctcctgagtagctggtaggtactacagtcacccgccaccacacctggctaatttttttttttttttttggtatttttagtagagatggggtttcaccatgttagcccggatggtcgtgatcttctgacctcgtgatccgcctgtctcggcctccccaagtgctgggattacaggcgtgagccactgcacctggccgatttttttttttttaaaccctcattggctaccttttggaggactctgggaccaactcatcatcctgaaagtgtacacaaaaagggaatgaatcaaacatttattctgtatcttacctgtacaaattatgtttcagagtaaccaaatacttaatatgggaaaattcttatttatagaacttcaaataatacatgggaaggaatgataccatcattttgtaacctctaatgaaataatgggtttaggtttaaaaaaatcagtggttgctaaaaaccattgggtgaaaataacctaaaatggatataataagtttaccacatctgcaccactgattcatccttatcatgaagacagtcatcttgtgccttctctcctcatgtagtgccaccaatgaagtattcttgccaaaaattgtgatcaggcctctatattcgaacttgtttacagcaaaccaagaaatggaaaagcatgctgcatagtactatggggatgcaatgagcaaagtccaggttgtagaagattctttgaggcaaatgacacagtttctttgacaaataaatgacaaagaaaaaaccaagggggaacctgtgtattaaaacagtggtcctcagagcgctggcatgaatcaaaagtcactgggagggcttgtcaaaacacagattgctggcttcatcccgtagtttctcattcattagccctgggttagggcccatgaatttgcatttctaaaacgctgctaggtgctcttcctcctgatgatccagaaaccacagaaccatgttattaaagaagtcttggattatgaatcaaatacaatgtatggaccttgtttggattctgttttgaacaagccaattgtaaaaataacaataattcccttgataatagggaaatgtagacatgggatggacttttgataatattaaggaattggtaaattttgatagtgtaatcatggtattgtaattatatttttctttttttaaagaaggccctgtctttttagaaatacatgttaaaattatgggtaaaatgctatattgtttgcttgaaaataattggcgctgaaaagtagttgaggatagaggtaaaagagattggccatgtattaacaattgggaagaaagcgagtgatgagtacacaaggattcattatctgtattaatttttctacttttctatgtttatggaaattaccttcaaaatgtaaaatatatgtttggaaacataaaaatatattccaaaatagctcatgaattaaatgtaagtcaccatagaaattacacgttttttggaatagaacagtcatgaattatactatttcaaaacatgtgggatgcaggtaaagcaggacttaagggtaagtttattgacttaagtcttccaaaaaaagatgtaaatgaattaagttcaattcaaaagttagaaaatgaaacacagaaaagctggagggaaaaagaacagaaaaaatagaaataagttaataatgcagtcatcttttattaacaggtagctgagaagattggattgaactaaggcattattctgagggaggttggtctgtaatattcctctctttaatatccttggttctgtctcggtgctgtgctagcctgatagaagaattgggcagtcttgagccaggtatgatgctcgcctgcagtctcagctgcttgagagacagacagtaggattgtttgaagccaggcatttgagaccagcctaggcaacatagtaagacagaaaaggggaaaaaaaaaaaaaaaggtgtgctaatgtaaagagaaattaaaagtaggacttctgttgtcttaaatagtttctgcctcagtgagtaactactcaacttatgtagaaatggctcagtattttttcagcgcacactttgtgccagatgctgtgctaggtattgaggacacatagatgactacgatatgacccatactcctgtggcactcagtctgagggagcatataaatttgtaagtaaaaaattagaatcaggcaataaatgtcagtagacaatatggaaaagttcccaggcaattccttgagagaagaaaattcttaatgtataggatgggcccagccttgtgaggttttgctcaagtagtctccaagaagaaatggcatttaccaagcagccagtctgttataatgggacacattaaaaatcacaaggagtttgctgtgtgactgggagaccattaagttataagagctgtcagtgtatgttatttaggatttttgtagcaaggtttatatgagagattggcctgtaattttcctttcttttaatatccttgtatggtatcaaggttatgctggccttataagtgttggaaagtattctttccttgttatgctctggaagaggctgtgtaagactggtattatttcttccttgaatgactgcaaagccattgggacctggggttttctttagtcaatgtgtactaaacatttagtagaaacagtgacccaaaatttcaacttaagttgaatatgtatctgaaaaggtttattattcttactaacattttcacataaaacttccctctgctcactgaggttaattcacagtttgatcagtgttgtatcagtgacagaaattcactagtataaaaacccagtccatttctaaccaccaaatggtgtattacagcttcaaaaaaaaatttttttttttttactacctaggctttgtgctgggggttaccatggtgtcaaatgagacaaatccatgtcatccagatacttgtggactcaatttgatatgagcaagcatcagatcattttaatctacttgctttattgggatgtgtatgtggatatattaagggctgattattttgatgggctttgctgtttggaatgctttgtcttaatttttgtggatgaatttttaatttatatatttcataagaagtaatgaatttgcatcattcacacttcagaagttataaataaggttctccacctttgtcctttagtcacccagtttcccatctctggagccaaaagatgttagttgcttcttagctattcatcaatttttatatcctctgaatatgcaatatattcacccccgctcccttcccccaccccgttttttttaaacactttctcttctgcaccttgcttttaatttagtaagtccttagaaactgttccttattgcatgttaaaactacgtcttgtttcttttctcttatgacttccttgtatcttgtgacaacagtaataataaattaatgtagtcattgtgatattgatggatttttaggttatttccagtcttcctgcccaaaaaagttacatcgaatatcccaaattgcttttgaataattaaatcatcattttatcttccttcactagttttttaggacagattttttttttcttttcatttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggttagaaaccagccttccacttttgggggtttgttttcttaaagttgggcagatttcattttaacatttattagttacagaggaatgttgtctttgtaaaactgagtgacacagaagcattctatccagccctgtccttgtcttagttttgtgactgtgaatggcctttgatcaagttacaagggatgtgacttggaaacctgtatcatgaagagctgttttggtcatggtcattgcaattgagcaaaaattgaaggaagcaaggatgctttctctaatgtacatggaattgtggattgctgtttttctgaggatttcactaaaggggaaattctagaacatcactcaggagaaaacatcctttattaataacttacgtggcgggatacaccaatatgacatttctcaaatgacaaatatacttcggtattaccgaatctaagaattttcattgaaaacaaaataaatgttacctttggccaggtgcggtggctcatgcctgtaatcccagcactttgggaggccagggtgggcagatcacttgaggccagttcaagacaagcctggccaacttagcgaaaccccatctctactaaaaataaaaaaattagccaagcgtggtggcacacacctgtaatctcaacttctcaggaggctgaggcacaagaatcacttgagcttcggaggcagaggttcggtgagccaagattgtgccaccgcactcaagcctgggtgacagagtgagattctgtctcaaaaacaaaaagttatcttcaagtttagaagatgccagtgtgctttaaaattacctgcttatggatgtttttttattttggggaaagtaggacatagtagagagctttgaagccctttaatcaccaattccatcagctttcttccagaaggtactgttggtttttatgttcctaatatatataattaatctcaacattaatttttactttatcttatttcagagtggttaaatctactaagttcagatattggagataaggtcttttgttaagtagcgtagatatttttaaatttccatataaaatttttttgaatagataatagaaaaatggtatactagtgatagatgtacagaggtgaaagtacactcaaaataagatcttttccctgtttttctagttctctcctatggggcctaaataactatgagtttcttaggttttttgttttttgttaatttttccagagatactctgtttacatacataaaatacatgtatctgtgccattttttccctagctaaatcacagcatgctaagtatagacatttaaaaatcgtcatactcggccaggcatggtggctcatgcctctaatcccaacactttgggaggccgaggcaggaggtttgcttgagcccaggagttcgaaaccagcctgggcaacatggcgagactctgtctcttaaaaaaaaaaaaagctctacatttctgttaccaggaaggaggcacctaaaggtctgttttttgttttttgggttttttttagggctgtattttaaaagtatctcttgagtgtcagtgaaaatatgtgaactcagtactacctgaactctgatttggggtttgaggaattggtacttcaggagttaaattaagccatggcatctgagacaggctcacgttgaaactgtgctttgtcggtaatctgtccatacaattctagtgtgattggcatcaaaggtaaaccctgatagaaggagtaagacagtatgtgccaacatacgatgtcaggaacttgttggggctcagaaaatgatactccaaaatatggttctttgacaaactaaggaagcagcctcaagttctatgccaaagcacaggatgaggctgttccttgaagttcctttatctgcctagaaaccagacccaccaaaaggaatacaattgcctttgatcccctcctcaaaatttcattaaccagagaagcctgaaacttgtatgacagaggaaaagactaaaaattaaatatcacacctagagagctcagaggaactttgcccagactattgtctgttctcagatcccattcagtttccaaagagaattatttactaaccattgtctgtgtactgggcccattcattcttcctaaaaatcatttactgcccttcaaaatggcgtcatttccctcatgtccccttcccctgtgaagaagggtattatatagtatctggaactcacttggttattgggtaataattgtcttgcaatttcccccatgcttatgcaccttaaataaatttgtttgccattttctcctgttaatttgtctattatcagttcattttcagcgaacctttagagggtagaggggaagttttccttttggcccctataaagtgatcttgaaagaaatgtttctttatctgacataaaaaaggatggagaaaggaagcattattgtacctctgactttctaacaaattaccataaaggaagaatatttttcgtctactattgttagaacaccttagaaccatcaaaaatataattacatggctaatagaaaaaaaaagagcagttttaaaatatgttttatgtaacctattttcattgtttttcattttgttgttgccgagtagtagttgttctaagtaaatacaggtctcaatttcactatgaataaaaactgtcaaaatcaagaaactaaaaaaaaagttctttaattactaatgtcaaaaccatactgtttttaagataatttgtaaagtctagaaatggggccattcgccattttgttttatgccatagatcatcctggggttttttggtgggcaaatgctgctatttgtaaaactcttccttccaaagattttcctaaatctttattctcaaacttactctgggtgatgggtcctggacagaatagcttcacttcctttaaaggtaacttctttgtttcatctttactgcctactgtgtcgtcttttcttatgttgaagttgacagacctgctctattctcatactaatagactatttttagatttttttaaagtaatcacaataaattcagtatatcttaagtcttttggcttcctgtgaacttcttcccttgacagtttatcttagcactgaaacatcaaatatattgtatctgctttatctaatactcagaaacaaagaacctacgtgaccaatatcaaattttattttttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaatttgtaagtcagcctacacagccagaccatgtggcttaaagtaatttttatccgtcttattttttactcttaggcaatgcggaatatcaatcccagcacagcaaattctccaaaatgtcaggtaggctcttatctgatgttttagcactggaaaaaaaaaaaaaaagatattaaattaggaaagagaaacttacattccagggtcctgtccttattggacattagcccagagaataactttgagccatctttctaccaagatactcaggttaacattgcccttccaagaaagtctacacagtctgctccctccctgctcctcctagggagtttctgtttattttgattccatggaggtcttttttattctatatttaaatgtattgtgtctcagttgtacatcctatcagctaggtatgcctaatttttatttgaatagcttaaaatagtatgtgtaatgatttaaaggaattaataaattgaacagtaacaaaagcagtatttacttggataggctactttaggaaattttagagtcatgatactatgaggaagagaaaaattctttctagtggacattccaaaggaaaaatatcaaaattatcaggagagtatctgcctggatagtgtttcaggttttcttgttggcttttatcagcattctctgatgaaccccagggagccctggttgtgaaggcatcttatttagaaggaaagattgtggccaatttttcttctaacacaggcacttgtctgactcgtgggaagaatctcgttcttaaaaccaaaaagattttaggtgtttgaggtccacaagattagaagaaattcggagccagaggatcattctacttctcttggggcagaagcaaccatataatgcctcaccttctatgtaacttactctgcactatgctaaataagtacattgttttagaatctgctgtagaagtaggagttggcaaaattctactcattttggatactgttaagttgtccgttggagcaccatgatgataaaagtcagatacagtcttcatagaaaccagttaattttgtgagagggaaaatctctattcttctttatctatctcataaatgccaccattaatcaaaagaccaagcaagggataactcaataataagccatcttcaccaaagttgagcatagacattcttatgatgagggggcactaatataccatttgactgtgaagtgcaggatagcattgggtctttataacgtgaagccatttttttctttgccatttctctgaagtgtttgttttgttttgtctttttgtttttgttttttgtttttgtttttgagatggagtttcgctctgttgccgaggctggagtgcagtggtgtgatctcggctcactgcaagctccgccttccgggttcacaccattctcctgcctcagcctcccaagtagctgggactacaggcgcccgccaccatgcccagctaattctttttgaattttttagtagagacggggtttcacagtgttagccaggatggtctcgatctcctgacctcgtgatccgcccacctcagcctcccaaattgctgggattacaggcgtgagccaccacgtctggcctgaagtgtttctgaaagaagaattttattcatgataaatgaaatagaaactaatataggagcagaaattaactcaaaggagatttggattcaggtaaaaagtcctccatgccaaaaaaatgttgaaattgtttccttttttcccaaggtcttataccctgaatctgataaataagtcaaattcttcttgatctttgtttcatacttgaatagaaaagtaaatctttactgttattaaaattatcaggaattcttagattttttaaaatagtaaagttttagaaaaggtgaggcttattagtagtaaagcttctaagatacgaagattagaggtaattactcagatttgcccagaccagagcaaaaaacttgaaagaggtttttaaaaatcttctttgcatatgctggagattaaaatattggtttgttatatatgctttagttgtcagtgtttaatatttacctggcataattgtggaaagttatcagtaaatgtatgaaattcaagtatagggttatatttgaaatagatcaagaaatctggtggtatttgtatcaagaaagcatgtgtatatttttctcatcctattattttctaaataaccttaaggtagatgtcaggaaatagatcacaaagaagagtcatgtcttttcttctttttttttttgagatggagtcttgctctgtcacccaggctggagtgcagtggcgcaatctcagctcactgcaacctccacctcccaggttcaagcaattctcctgcctcagcctcctgagtggctgtgattacaggtgcctgccactacgcccagctaattttttgtgtttttagtagagacggggtttcaccatgttatccaggatggtctccacctcctgacctcatgattcgcctgcctcggcctcccaaagcactggtattacaggcgtgagccaccgcgcccagccagaagagtcatatcttaagtgaagatggctttaaatagtgtttctcagaataatcaagaaagctagaaaggacttttcagccccaaagaacagagggtataaagacatcactcagtatctgaacactagacgctgttgtaaagttactgggtttttaacttatactttgtaatagatattaatgcagctgagttagcaagcaatagtgagatcagtgtcattttctaatcgtatacctcatatgctgtgggatgtggaaagccactaaacttcaaaatgcttatgaattactacagaagctgtctttaagtacttcctataggatttaacatatcatgtggctgttgtagggtgctgtgctcgtgtacactaacgtcagtatgggtgaggttaatgaaaaattccaagatccatggcccaagtgatattgaaatgtaaaattttgaaaaaactttaaaggcatttatatatcttcttagttaaatatggaaattatcaccttaatttattatactatgttggcaggattttggaaaaattcatccttacagagcttaactttttatttttatttttatttttatttttatttttattttgagacggagttttgcccttgtcgcccaggttggagtgcaatggcatgatctctgctcaccgcaacctctgcctcccgggttcaaatgattctgcctcagcctcccaagtagctgggattacaggcattcgccaccatgcccggctaattttgtgtttttggtagagacagggtttctccatgttggtcagcctggtcttgaactcccaacctcaggtgatctgcccacctcgtcctcccaaagttctgggattacaggcatgagccaccacaccctgccaaagagcttaacattttaatttcattttggttacttatgatttttatgtttcaaaagcaatttccattctcagaagaaactttctgaaactgtaaacatctttgctttgtgagattgagcagttaatgctattttctagtcatatctctgttacacatcagtgctcacttgtaaattggagagaccttttgagcaagtgggtttaggaatgcactctagcttctgttttaaggtcttttgagagaagaactttgaggaaagatagtcccccctgaggtgcgaacacttctaccttctcttgtgcttaagaatatggttcttggactgggggcggtggctcacgcttgtaatcccagcactttgggaggccaaggcgggtggatcacctgaagtcaggagtttgagaccagcctggtcaacatggtgaaacccgtctctactaaaaatacggaaattagctggatgtggtggggcgggcgcctttaatcccagctgctcaggaggctgaggagggagaatcgcctgaacctgggaggcagaggttgcagtgagccaagatcgtggcattgcactccagcctggcgaaaagagcaaaactccgtcttgaaaaaaagaaaaagaatttggttcttaatatctggggttccctagtacctatgagatcgagtttaaactctgcaactggctcatggtctgtggtcagtagccttttcactcactggttccagttaagccagtaactcttccattattagctaagtgtactccactgccttgttgctgttattctgctcacaagcttttccccatagtgagaaccttgcttatcccctttcttaccagtaaagattcttcatttctgttttaaggcttagggtgagattcattcccaagtgcccttatgagaattcttgaggcagggcacagtggctcacgcctgtaatcccagcactttgagaggccgaggcaggcaaatgacctgaggtcagaagtccgagacctgcctggccaatatggtgaaagtccatctctactaaaaacggaaaaattagctgggcttggtggcatgcacctgtagtcccagctactcaggaggctgaggtgggaggatggcctgagtctgggaggcagcggttcagtgagctgagatcatgccactacactccagcctgggtgacagagtgagactctgcctcaaaaaaagaaaattagagaattcttgaaactacccagaaataaaaacaacactgctgtataaagatgtcttaactcagtagccagtataattccaatttaggtggtcaaaagtatgatatggggttactttcatttctgggcaagtaattgcttcaatctgtatagaaattacagtataaatatttggcaactactgaataatgtgtagttgccattccttataggtggtaatgaatagacaccaaggtcagtccctggtttaatgaataataaagcccacagtattgctgatgaggatattatactgcaccattacctctcaacagtgaagaggttcagatgttcacagttgtagttaatgagaacaaaataataccattgttcagagctatatgaaaacaattgccaacaaccatttttttcctgaatttagtaaaagtaaagtatttggcttttttcccttcaaactgtctttcatgttagctgtttcaaaatcctgttaacacttgtctaacgttatctttctcttcgaagttctgatattaaataaatcatagatttatttgaaggttttccaatgaatatattatattttatttttaatgggtacattgaaaactttatataagagggaagatttagtctcacacctcacatacttttaactggttatttcatttgttttattaaacttgcctcttccttgttatttgaacagtgccataataactttgagaccatgattgagtaatacagattacaaaaggcctaattccagaagtctatcagaaagaatgtagaatcctaggataatgctagggaacaccaacctgccatcctgttttggatgtgatttttcagagtttaagattatcatctagttctcataactgtcccccaatccatgtgtatactttttttaatcaaaaaagttgttctaaagttaaaactgctttggtaaatggcataaacattaaaaaacataaagcattggctcagtgttttaatgactttagaaataataaaatgttttattacagtttaaagctgtgttggaaaatagggtatggcaagacctctatcttaaacagttggaagaaatggcatttttttctatttttagaattgttgacataaactgctatcactaaggcaaactacttacaagacatatatttttagagttattctccatttctaaatttggatttccagttcactaagttaatcttccttaaacaaattgattaccaccctccctgcaaaaaccccttgctcctgtgccatatattatcgaaaaaagacacacttttatataatgcagtatttactaaagacagaattgctttaagaaagtaacactgactaggtagttagctccccaaatcattaattcttatgttattttatttatttaagatggagtttcactcatcacccaggctggagtgcaatggcacgatctcggctcactgcaacctcctcctcgtgggttccaagagcttctcctgcctcaacctcccaagtagttgggattagaggcgcacaccaccacccccagctaattttttttgtatatttagtagagacagggtttcaccatgttggtcaggctggtctcgaactcctgacctcaggtgatccacctgccttggcctcccaaagtgttgggattacagtcatgagccactgcgcctggcctgttaatatttttatatgcaacgaacatagtatgtttcattgggttcagtaaggaagataaaatagtgttgctatttaagggaattagtagacatgggatagggaaattgcatatatttatataagaaaacaggccagcctttttctccctttcttaacaatatgatatgtctttgtggttcagtctagccaaaaaacaacaacctctgcctcccatacaagcgcgcgtgctagcgtgaacacactcagataacaaaggtttcaggaggcagaagtgaaatggaaatttcggaaagtatcctactccatgctttacctagtcagattatgaaggagaatgaccatgaagttagacaaatgaaagagttttctcctataaggtgtcctgcttctggggaggaacagttaaatcatgtgtttccatcgtgagtaagttttataattccttgtattcttagcaaaggattgtaaatgtgaaagtgaagttaccataggaaactaagaattttagatgtaaaatagtgaaaatttgtttcagggttatctagacattttgctactttaaaaaaaaatcttaatatgggtaagcatgaagtcaaattaatccgaatgtttaatcaaaaatatattttatataaattctccattatattacatttaaaaataagcctgtatatgtcttatacctgtgttaaaaaatgccaattatatttcaataatgtaattttatcaaaacacattttcagtgaatatcaacattatttcataattgggtaaatctggcatagctcttttgtagacagtccaattatgtcctgagccataagccttgggacataattggattgtctacaaaactgatttcagttgaaacatttcatgttgaaagttacgtctatctctaagaagtttttggattattttatcctgaacacaatgcctaaaattagaatactggactaaaaatacaagtttgttaaacttctgttttcccaaaggtaactaggataaatagtttgacagactttcaaaactggggaaataagttacaggaaatttagccaaaacataatcatgcttctgttctgtatttcaaaggtcaaatagtttttttctaactgaagcaagtatttttagccattttcttctgtaataatacaaaaatgtggtagcttttcccattgagcttgtaaatcttagctaatgtgggacacatttggagtcagagctatctacgctgtaagtaaaactaagggtcccagtttgttctggaggaaactttgcagggtggttcataaaagaaaacatgagtttgcctgctttatttagtggacttttatggaaccaagacctagccataagccattggcccttcttactacatttctctcctctcatgtaaatagcaatataatttcccagaagtcaaaaaagatgctaagattatgtagttttgaaagttaaggtatgttggccttacataaaatgatgccttagtccacatcatttagaaaaataatgagaaaggcagtaaaagtagtcagaagtctggaaacacttagaatatttttaaggtttttttaaatttttagagtatccaagagaaacgaaagcatgtttctacacaaagccaaaatgtagaaataacccaaatgcctatcaacagatgaataaacaaatgtaatatattcctacagtggaatactagttagcaataaaaaggaatgaactgtggatataacatgaatgaatcccaagattatcacactaagtgaaaaagtacatgctgtatgattttattttagaaaattctagaaaataccgaataatctacaatgacaaaaagcagatgattagcttctgaaggttgaagtaggggaggtgagaagtagtgggagaaaattttgaggatgattatcttttttttttgagatggaggttcgttcttattgcccaggttggagtgcaatggcgcaatctcagctaccagaacctctgcctcccgggttcaagcgattctcctgccccagcctcccaagtcctcccgagtagcttgaattacaggcacctgccatcacacccagctaattttttgtatttttagtagagacggggtttctccatgttggtcaggctggtctcgaactcccaacctcaggtgatctgcccacctcaccctcccaaagtgctgggattacaggtgtgagccactgcacccggctgaggatgattatcttgattgtagtggcagcttcacaggtgtacacacatgtcaaaactcatcaatttatgcactttataatttattgtatatccgttatatatcaaaaagcttttcaaaatttacttggaatatctaatcacctgtaactaaaagtttcaaaactcagctgagtatttatacctttagtatgctatccataatctgcatatatgttatttgtatcattggccttgttacattagagtcatcccttgggggattggttccagcaagtcccttatataaaatggcatgctatttgcatataacctacacacatcctcctgtataccttaaatcatttctagattacttataatacaatggaaatgctatgtaaagagctgttacactgttataactgtgttgtcattctgtattgggaataatggcaagaaaaatagtctatatatgttaagtacagacacagccttccatttttcttctcgaatatttcgatccatacttggttgccttacggatatgaaaggctaactatatttgttttcatgccaaattcttccctatttgattaataatacactcctgccaccagtaagtaaagtgtctttttttcattgattctttcaagtctaatttaggtgaatccttaggttagttactgttagtcatggctcaaatataggtttaatgagaagagtgtttccatagcccttcaaggggtcggatatctccttaggtaacttggaatgatttccctgcttactgacatctctaagttatctttctttataaatctgcatagttggttctgcagtgtctgctgacatagaaattcagttgttaaatgaagtaaaaagtaaaaatttcacggcttttaacaaacatagtggccaaattcaaagcagcaagaacatggagagtctagtctgcacatgatactagttttaacctaataaaaagtaggaattttatttaaaaggctaaaataaaaagttgtaaaaataatatgaaaattatagccaattcagttattttagttatgacttacagtttagtgttatatatttgttttgtgctacaaacaggagcataccttctttgataaaaagcaaatgagagtctttagaatattctccaatactcccatgtttgtcacagaaccctaggcatcagccttttctggagtctataattttattcattttaaagtttattgttaaatacatcctcatattttaagagcaaaataaattcttcaaggaattttaagttgttttatgctccagagtaattcattcactctggccttagggggtacagcaaaaataattacgatattttgtgataagtgctgtgttcaggatgttaaagacatgacatgtctgtgtctaatccaatctcaagatcgagatgggatcaccacggagagtttcttcaaaaaggtagtgccttcaccaggtcttaaataatacggaagaaaggcatggtattgagaggatgtgtcctcccacagacagactacaatgagtgtagtatcactgttttaaagtcacttctcactttgtaagatgagcatgggaggagtcaaaagtagaagatagaaaagaaataagagggatccccataagactgcaagaaaagttaaaaagatgatgagtataaatgaagttacttttgaggcaagcaggaagaggtggcaagaggggccagaaaaatcaaagattatacctgatgacctggttttttttgtttgttttgttttttgttttttgttttgagacagagtctcgctctgtcacctaggctggagtgcagtggcgcaatctcagctcactgcaacctcagcttcctgagtagctgggactacaggcatacgccaccacgcctggctaatttttttatattttcagtagagacggggtttcaccatgttggtcaggctggtctccaactcctgacctcaaatgatccgcccacctcagcctcccaaagtgctgggattacaggcgtgagccaccacacccagccaatggcctcagtgttctaatgtagatggaaaagaaatagacatggacttcactggctgggcatggtggctcacgcctgtaatcctaacactttgggaggccaatcgcttgagctcaggtgttaagaccagcctgggcgacatatagtgagaccttgtctctacaaaaaaatttggaggaagagaaaagaaaagaaatggacttccctgaataggggcttgagatagtatgccatatttggagtagtgaccatgaggatgtgaaaaacaactgaccaagaacaaaacaaaacaaaaaaaccaataagtggtactagggtccatccaaaaccaaagacctttaatttgtaatgataacattctggatagttatgtgatttcttttttttcttttcccttagcatttctcagcaatctcagaatgaaaatggaacaaatacactttggcattgctttggggttgggatttgctgggctgagataaaattatatgtacatcaggaatctaaaaggtgcttatgctgttttgaatgatcagtcatgaatttaagcttgtagggaaggagaaaaaaaaataagataccaaaagacagccaatagactagactagtaaggagagatgggtctggagtctctgaggttggagggctggtagagtggacatgagtctatgcaggaactggttagaaaaaaatgtgagaaagtaaaataagtgcatgtaagattttggggagagaagtttctaagccagttcttgggtatgactgagggaattaatgattgaaatacagtgatgaagtggtcagtatcatttcggtgtaaaggcgatcccggcatttcaacaatgggttattatatgggttttatgcatggaggtcataattccaatgtgatgaatgcagttggaatgaagagaaacactgatcatcgtctcaaaacatgacttaagattttagagttggtttggtttcaaataacaggatcttagtggctgtgcaatgggtgtttgagtggagtggagatgaaggtcactggaatccagaaggttcaggaagctgtcaggttaagtgaattgtccatttaatactgaagcatgttaagaggcatggagaatacttggagtggcaagaggctttgaccagactccagaattttcccgtatataagatggagtaacgaagagatcagtaaatttgagtacaagaagcagtttaccttgcagggaagacaggcaaacaattttggcatttggccaagtccctaggttccctctcaggacattggtgtttgtttttttttaaagtacaggattgaaaagaaaaggaatttcattgatacagttaagaaaatattaaatagaaacttgtgatataacgtgcttctttttaatgtataaataacaagatctaaggctgggtgcagtggcctatgcttgtaatgccagcactttgggcggccaaggagggtagatcatctgagcctgggagattgagaccagctgggcaacatggcaaaaccctgtctctacaaaaatacaaaaaattagctgggtatggtggtgtgcctctgtggctgcagctactcatgaggctgaggcaggaggatcacttgagcctagaaggtcaaggctgcagtgagctataattgcatcactgcattccagattgggtgacagagtgagaccctgtctcaaaaagattaaaaaaaaaaaaaatctagaagcacatcttataacgtaactactgtagcattgaaatagcaatgatcataaatggtattttaaaatatttgcaacaactacaatgtgatatgaaaacatttatatgttctattggtgaaaagttaggtacagtgaatactaatggtgcatactacattggagaaaatgttgacaaatttagcgaaagttaatgtgtaatttttttttttttaccccattgaagttcagagactctctgaattctgtcatggtccgctggttaagaaactctggtttaaaggatggtatatccagaaggcataaacctaaagaaaaataagtggtatttgcatgcaggagaattgtagtttagaagtggcagcgtagagctaggagaagctttccatacttcaggaccccatggcgattgtggaggtgagggctggagatggtggggccgtgcctcagtgagcagacttggctcagaaagctgtgtggaaggatgacggagtcaggccagtatcctttgtgataagaaactgtatgtatttcaaatcaaacccaaaaagtagagggaaagaaagctgatggtctagtagagatgatgtttacgataggtggagaggcacagtgaaaattcttaggagggtaagaaacagtgaacagataaaggagagaaaaaggacagagtagtaatgagtgtgctacggatgggtcacagtgagatgaactgtttttgaggtcctgggcaaatacaggctgaaacctgggaggtttggaagcccttgaaggcaggccttctgcaaccatcagagtagcaacctacagcctttgctcaggtttacagggagaatcctgctgagaaattgttggatgaccctgaagaaattttaccccattttaaatattatgtttgtggtggagaagccttgggtttgtgttttaacttctgatgtctttttttcattttcctcctctctccctgctagaggatggaacatattctatccagctcaggatagaaaaacctaaagtcaaaatgagacatttaatagcaaagtgtgaaatagtgttgggggttggggaaggattggtgtcttatagtaaaatcatcagatgctattcttcctacttctttttttttggcgggggagggggtcggggggttccaaacacacaaaaccatataagagttgtcgagtaaaagcaaactttaagaattatttttttagggccgggcgcggtggctcacgtctgtaatcccagcacttttggggggccaaggcgggtggatcacgaggtcaagagatcgagaccatcctgggtaacatggtgaaaccccgtctctactaaaaaaaatacaaaaaattagctgggcgtggtggtgcgtgcctgtagtcccagctactcgggaggctgaggcaggagaatcacttgaacccaggaggcggaggttgcagtgagccaagattgcaccactgcactccagcctggtgacagagtgagactccgtcttgaagaacaaaaaaaaaaaaaaaaaaagaagaatttttttttaaagaccagacttgccattctataataacccaaaggaggatttgggagtatcttccagagtaaggaaaataacaaaaagaaaacaaagtagcaaaatgtatatagggtggggggtggttaatatgactagacagactttaaatatatgtaacttaatttttagtcatttgaaatggatagaattaggtcattctgattgggaaatgtattaactttaaagtagatgtttttaatctatctgcacggttactctgatgaacgttttatttctttaaacctaacattaaatgtgttaatcagtagattgattctctttggctttatttttaattaggagttagccctgcgtagccagttaccaacactggagcaggatggtgggactcaaaatccagtgtcttctcccgggatgtctcaggaattgagaacaatgacgaccaatagctcagatcctttccttaacaggttggtgaaagttgctactggtgaatatctgaaaaggatcattgctttaaaatcattctgcttagtgcttgtaataggctatttggaacatctgtgtgggccaaaaaccatagctgtaaatgaatctctctgtaaatggcaagtacatgcagagttgaggattaaaagttgtctcctgtgagaggaagtgaactgttcagacttgtacaagggatacttattcaaagtcatgacgtgtttgcttctgcctatactgttgactaacagttacttaaaattacagaatcatgaaggaacatgtgaatgcctttctgtgaaagcaaatgaatttcatgttaaacctacttaggattgcattataaggatcactggaaggaattttccacatagctattcaagctaaaacgtttcacccagcagcactgtaaggcctcatgttcttaagggctatagtccaaggagataaaatgtaaggttgtgcctctttcaaaaatgcactaagattaacggcagtatttgaaaataacatagcttagggatgcttcttagtgagttaccacaaatcctgggtttcagacagattgcaatattacataaactgccattttgaagtctgtaagctgaaacaggtcatattctttgcctaggaagtcatttaagattaagatttaactaaaattccttcttctaggttgtggagtttcaaactttttaaaatatgggattagtttacgctttggattccttttctaactgatttaaataacacactttcttaaatactcaaaggtattttgcactaggaaaactattacaccaccttttcagttctcaccaattgaattggaaacttagtaattccaagagaaaatatcttatcctgctaaaagtatttagtgcaatagaattcaccatttactcagtttttaagattagtactggtggcctagttggaaggtttgattttgaagaccatctaaaatgtattttaagtttgtatttactcttctgacatacactttaaagttctaaaagtaagtgtatttatataagattatagttctagacttaaactgaggctaattaagagaggcatagcctcagaactttttttccaacaaggaaaatttcatatccatgtaattccagtacctgtcttgttgaaggggctatattaatcccagggataaaaattagaccattttaaaaatggataggctgcatatccttctgacagtcacttatgaagattttttttcttaaaacttttgatgagagctgggctacaatttgagattctattttctgggaagatcagagtggcagataatcagtgttactaatctaagggcagaattgtatatgcattctctgcagtacccccagtttctaataataacatacatctgactttgactttttttttctttaaaaaaaaaaacaactcttggctgggcatgatggctcatgcctgtaatcccagcactttgggaggccaaggcaagtggaccaccacctggggtaagagttcgagaccagcctgaccaacatggcgaaaccccatctttactaaaaatacaaaattagttgggcatggtcacgcatgcctataatcccagctactcgggaggctgaggcaggagaatcgcttgaacccgggaggcagaggttgcggtgagccgagatcatgccgttgcactccagcctgggcaacaagagtgaaacttggtctcaaaaaacaaaaagacaaacaaaaaaacctcttgatggtttttcccttgtttactatttgatttatgtatattccttaagctctaaatactttttgccccaacttgccttggcattgactcttagtagtaatgctgagttcccttagttcccttttacttttaccctcaaagctcactcagatgtccccctccatgaaacttttaccctttacttctaagctccctgtttgttctgaaagcactgtgcttacatctgagttcatatagcccctaaatatgattcattagtatatttgttcatttccctccttgaagttgtgagcctctcacaaaacattgtttgtaggtggtggtgattgttaacctctttatcctcaaagcctagtctaatgcctgtcatgtagtagcagatgctcagtgaatgtttactgaatgagtggggcctgtaggaagtggggttctgcagggagcagttcctcaccaggaaaatggccctgtaaactctgtcctcaggaatgcccatgtgcttcccctgtggtttggaatgaactctgcgcaactctgtaagttcagttattcagtaatagactaaaatgtctgatgtgtgtcccatgcttagcagccgaatagagtgatgactaggaccaggctcttgtcccagatcagggcaggcaaaatacaaacaaaccacatcctgaggccttctcatatatggctgcattgtataccaatggtctcagaggcaaatgtgtgttttcttggatctgtgtgaggcttttgagccttggcaaaatctggcagaagcattagagtaaaccagtgatggcagtatatagaatgaggggagagagagaacaaggcaaatgcattgcatcatttagggaaggcagttggggtattgactgagcttttagccttgagcaattgttaaacttgtttttattttttaacttttatgtaagttaaatagctgcttattaaatgtacaagccgtagagaaagttgaagttcacactcacacagaccattgaagaataacagctgccttgattttatgcgtttctctaagattttgtagagttagtagaactcagggaatgccagctgatgtctagatgctactagcttaggaaagtgttctatttctcagggtaatggatatttaccatacttttaatgtaaatctgggaaaccttacttagtctaaagtgaaaatctgtgttgggtcattttattttcaagggatgtgccttgcagttttttgttttgctcttttctttaactggagctatatgatttcccgtttcgtttcgtactgaagtgtttgaggctttttcctcccccgcccaaacacagaagcaaggagatcaagccacgagtattcttatcttattggcagtgactcacctattttggctcagtcctaaaaggaattctggtggtttatttggggttgatttttccttggcttatgttctctgcacaatagctaggaatttaacttgagtctagtgcagacctgtctcctcgcccacctggagtttgtgttgtgacgtctctgtgccaccaccacctggagaattgaggccttgggacaagtaagttgtatgggttcctccgcacccccagattcaaatgatattacagagaggagaatactgatgcagagaattttctgtcagccaggaaaactaactgggggtatctttttttgtcccttattgtcaccaagcacagaaccttaggagaaatcttggttccttagagctgccagcttcaattaggattaacttgtctatttcacttcatagcacaagccctgtctatggccctgagggagggtgcttgtttcagacattgcaggacaggaattttcactaatcctctttgagaattatgttgctgctcagcaggtgtttatttttaccttgaattgatttttaaaattttttgtgttggtctttaactgtcatgtttatgtagtggcacctatcactctcgagatgagagtacagacagtggactaagcatgagcagctacagtgtccctcgaaccccagatgacttcctgaacagtgtggatgagatggatacaggttggtattctttattcctcttagtaacctgacttaacagtgggatatgttatcaccaggtctcataaggtattgtaagcaaagatgattcagaagaaaaccaattaaaatcctgtaaatttgaattaaattgatcctgctttgtctctatacggtgatttgtaacttgtcttttcctagtttaaaaaaatatatatcatggattggccgggtgcagtggctcatgcctctaattccagcattttgggaggccaaagtgggtgtattgtttgagcccaggagttcaagaccagtctgggcaacatggtgaaaccccatctctataaaaaaacatacaaaaataagtcagctgtcatggtacatgcctgtagtcccagctactcaggaggctgaggtgggaggatggattgagccccggtgatcacaccactgcactccagtttgggtgacagaatgagacctcttctcaaaaaaaaaaaaaaaaaatcataaattggatatattagctctatttgaataaaactctgataacatgacttatgttagcatgttgatcttaattggcaggacaaactgacaaccctgttagaacatctctctccttatagattagtgtccttaattttgagagatgtctacatgtaattcagtgtttgtcttcatcttttctctaagagtttttggtccaccttaagtgttatggggctcaggaaaccaggtgggaaagactaggaggtggggctcacttactttgttagaatagttgcagaaggccaggtgcggtggcttaaacctgtaatcccagcactttgggaggccgaggtagccagatcacgtgaggtcataagttcaagaccagcctggccaacatggtgaaaccctgtctctactaaaaatataaaaattagccacatgtggtggtatgcacctgtaatcccagctactcgggagactgaggcaggagaatcatttgaacccgggaggcggaggttgcagtgagccaagatcacaccactgcactccagcctgggtgacagagcaagactccgtctcaaaaaaaaaaaaaaaaaaaaaaaaaaagaatagttgcaggggtcttgcaggagctaagaaatacctgcctcacaggggtaattacggaagcatttctcctgtggcttacctggcaaccattgccctagagttgacaactgccagagtgcatgaattggcagggaaatgaagctgttctttagctaccaactctttcactaactgcttctattctgaaagtgtttagcaaggcttttgtgcctgtattcatccagctcctggctttgatgctttctagaatccacactacccctcctctctgattatctagatgttaaatcatccttaggagccacttcaaacccatttcacacacaacacctttacttactcctctaatctgtattgctctcttctccagacccctgtagcacttaatggtttatgttagtttttctgaaagtatgttctattgaagctctgaggagtgttaatgttgtcatatgcaaaaaaggctctgtggccaagtaagtttgggaaacctagaagcaaggctaggaagatggatttattcaaagccctctgggaaggcttgttttgctgttaggaaggtgcatctcctaagggtagaataaagtattcttgcagtctttctattttagtgtttcccaaagtatatttaaggccaaggtaggtctataccactcatgtttatgtttagtcttattatggtggtgcttatctggaagacagggtagtgatgctgtcgtgttgtgtacttgttctttctcccgctgctgcatataatttttcaagggcttttttatttttttcatgactcctttagtgctcagcacataatagcaatcaagctgttattggatatctgaacaatgttgaagcaaaagtaaacttggcattgttattttgttatctgtgagttgtttgacctgatataaattctaggtatcagtttaggtcagtcaggagcgcttttctttccctgtgcatttctctgtgctcatatgatacagccctgatgttagcttttcaaaaaggactttgttatctctgtgtgtttccactaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 1260 - DNA, 122963 bp, Homo sapiens; identical to SEQ ID NO: 1259

SEQ ID NO: 1261 - DNA, 120984 bp, Homo sapiens
tttttttgagaacttgcttcaggctaaacttcagcataggaactttgcccaaaagttaataggttttccaaatactgcaatgtagttagcccactcgggatgtaacttgagtggaaagaagagttaccgcccccactcccattccctctcctatttgcaggcctgttgtatagtctcctgtcggagaccaaagggttttggaactcagaaaaaatcacttaacctgatgacaaaaacccgggttaaggaggaggaaagaaggaaaaacaatttagctgcttgcctaaacacttcaatttgtcttaggtatgcttttttctcttacccctcgaagtgggtttatggactcattgtgggtaaatgtatgttggcatgcaccctacagactgcacggtatgttttcaaagtataatacacatagattggatcccccattttgtggcatcagccacaaagaattacaactgggaagtgtactttttcttctagtaaataatttttacaagaatttatatccagcagttctaaaattcataaactattatagttttgtttgttttaaataagtttttaactaagtgttttgcatctgtaaattcgacttttatttctcctaatgatttcctaaatcatacttattctgatgggaaactcaaaaaggtgtatcactttaaggcattaatgactctactgagtccttccagtttccttacctttgtgaatctaggaaattctaactttttgataatcaaactctaatgctaattaaaaatattttaaaaactatgcaagattatgaatagtacaaatctaggttgtaaatactattgttcacaacacaaactggtgactgtaagttctttcatatacatccatttttctatcatgaaaactattttataaaggagaaaacaggcatatggaagttaagatacttgttcagtgtcacactagccaacttagactggaactcagatctttggggtctgaatgcagaattttttctgcttgtatagagttgtggatgtgtgtgagttcttaagttaaaattggactgataacatctttatcttctacatacaaagatatagttgggtttttttcatcctgttcattgtagatggcttttaagaacatttgggcagttcaaatttgttgctctcattaaaatttgtgtaatttgttatgatttctttattgatggcattttatcatggttggaataaatgacgagggcttgatttttcttgagtttgacctagaaaaaaaattaattacttaaaacctagtaaaaaatacatattctttgtgttgtgtttatacttagaacattttagaacttggaaaagcacccataactgcactgacctcttaaaaattaggttttaaaattcactattatttttggaatgttttattcattcagtactagttgcccttacatgtctagtgtggaccaggggaaattcattagatggactgctcatcaatacaattacaaacatttataaaatttatattaaaattatataatattaaaagtatccatttgaaaacctgtgttctccagtgtcgaatattaaatgttgaaattttcctttggtacttagatattcggctgcaattaagcgctgactgggaaatttaaagggactcagttgtgttttttcttttttaatttttcatcttaatattccctaataggccagtactgatgcaggcactgcaggagccctgactccacagcatgttcgagctcattcctctccagcttctctgcagttgggagctgtttctcctgggacactgacccccactggagtagtctctggcccagcagctacacccacagctcagcatcttcgacagtcttcttttgagatacctgatgatgtacctctgccagcaggttgggagatggcaaagacatcttctggtcagagatacttcttaaagtaagtgaaaataatggtgggagacagttatctaagacaaatatgtattggaaaacacagtaaagtggtgtcaagatacagaatatcatttatttttatgttttatttaatatttatgttaagctctgtagctctatcttccatatatatgtttcagtttggtatgacctaaatacctttgttagtatgggtaatattttgaaagctttactgagtcttggttctgagcctctttataatcttttcttttgtggaagtttggttattctcattttgagcttgtgccaaaccttttaattagcctagcacaaaacagaaagaataccatgaaaattttcaaattctgggaattacagggctagcagcgtcttacaaaatacgtatggtgctacttgtatctttttaaataaatattttattggtagagaactacaaaataagtagggcttttgggggagtctaattttacagtattttaaattgtgaaatgacaagcactacaactgaagcttgatgtgacttaccaatatttccccccaaaaatgtaaagggaaataaaaatttttaggtttcatatgcagtcgctcagtggcaaacttctttcaagctagtaggtcttcacaacagaaaccctcctctctgggaaaacaaaaacatgaccgttgggttgtttatttatttttattttttcagtccttttgtgtttaataaaatggcagaattacactaggctgaaaagacataaatagaattttctctcctctgattttgaaattacagataagacctcaatttttttctggcttgtttggatcaagtatatattgaaatgttgactaaaactaattatgatagactgaaattgatgtctttaaaaaagctcacttaatagtgtttaatcaggttgagataataaagtgaaaaacagtgtaagttttgattcggataggtcttgacagtctactcctaaggcaaatgtaacatttatttatcataccagataacaccattaaggatgttttgttgtgtgaatcctagtatgtgttttatattgattgtcttccagggtgggttgctactttgtaatgtaagatagaaagttttgtgacagacttacagaagagcaaaggaaaaggtttgatcatgaaaagttcgtacagtttttttttgccccctttcctgcaactttttcttttcttttcttctttttttttaaaaaaattcattttctggtgtcctggtatccatttcaaaggatcaggtttcaaccagaacagtaaagggcctgagactggaaagtacacacaagtctggcaaactcatctgcatgagcaagatcatttgttctcaagcagacatccaaagtaaatgattgaaagagctgctagctgtgaaggatgtgtcttgaaggggaagggagtggaaacaaaccaggttgttaggaagaaaaagaaaggctgcacttttttgaacctctccctgctgggtcacatgctgacctggggagattgttaaacagcttaatagcctgctttccttctttctttggttgatgctgtggctaaaagtataaggttaaagagcaacatttatgctcttcttcttagttctttgtatcttgtaataattgcttgtaggtgatacctgcctacgatttcattattttgaatgaatgatctttttttgagctgaaatcagtattctagatacagttggccttccgtatctgtgggttcagcattcatggattcaaccaacctctgattgaaaatatttggaaacaaattacatctgtattgactaatgtacaaacttttttccttgtcattatttcctaaataatgtaacaactatttagcctttacgttgtattaagtattataagtaatctagaggtgatataaagtatatgggagaatatgtataggttatatgcaaatattatgccaccttatatgaaagaccagagcctctgtggattttagtacatgtaggaggtcctggaaccaatccttgaccacagatgctaaggaatgactattcatttttcaaagtttccagtgattcttcctttgtgaagaaatgtttctcttaaaggtattgatatatgtagatggattaatgaagggtatataccttccaaccccagtcacctcaattcacccctgtcaactatgggcctgtaaggaagataaaccaggctaaaataaataaatctcaaattatgtcataggagaaaaggttgcaagggtagagagatatttacccggaaaagaaaaaactgggaggaggagagataagacatgattgttgtttcagtgtttctggggaacttttatgtgggagtaggattagtcttactatataagaaatgtgaggaattttgattccatggaagaattttcttatataaaacttttaagaactagaagagttttcctggacaggtaaatcttgctcaataaatgtaggtaaaatcatggttacttggtatctgtcagggattctatggaggcccctaaacattggatgtgggagaagaatgctgtgggcttataaaattttgtattttaaagagtatctgctttatgaacattatgcaatttggagaaaagttatgaaataagattatttcaccttctccagttagctacttccatgatgttatggaccgtatagttgttacaacttctttttgtgtactgaacagacaaatgagattaatatcctaaccattagtcaaagatgatgataaactaagcttttggtgccaagtttctgttgtcaaagttcatttttatcctagttttgatgttttaaaatagggctgtctttgtaatcaatatttatatactttcctcttgtatctaaagaggagtgttgttgtcatcagatgtagaatgaagatttaaattagttgccttacacttgtttccgcaatgaaacattttattttaatgcatctttttagatatttgttggaactgacttttaagttacaaagtctataacttattgagatttatatttggcatgaagaacctgactataaatggtccagacaggcaagacgatgtaatttgagaaaaaacttagaaatgttaagaaacaacccagttgttggccttgtgaccatagatgattgagtttttgaagttagttggcctatcatctagtttccaggcagcatgattactgaaagattataagcaggcaatcattcgttgttttaaagccctccttaggtcagtgagatcttgtggaggagactcataccttactttggcaagtgatacggtggaagtatggtgctagttacatttatcagtggcttgttttcaagctctgggatgaatgtgaagtatgtaaacaaggcttagccatataatatttgttctactacatttactattcaaaactattttctttaccatcgtattgagctttcattttaaaagaattcattctctttatgactctgagagttattaccttcttcagctgtcttacggttttcctacaggaaatagttcttcaagtagttggtcaacaacttcctatttctttataagctgctgaataacttcctgactcagtattctataatatctctggtttcaaggagtgttttacttgcaagtttattttattgactctgatgccttataactattaccatgttcaaagatatgtgttcttatatataatgtaccatgtaggaccttataatttgatttaaggaatctggatcagtgattttaaaagtttgtacatttgcattgttttaataatgttctaataatttttaaagcacagttttgtttcatttccattgtttatcattttctgaataactggccacaatgtttttagtctgcgaagattcaaggttttttgtggctgtgatttgattaagttatattgagtagcttggtatacaatttaaaaaggatatgtttttcagagatttttgacattgcatggcataaaactacccatattcctatattaatttgccttgtagatgtgattgatcgctatacataggctgattcttttttctttctttccttttttttttttttttgagacagagtcttgctctgttgaccaggctggagtgcagtggcacgatctcaactcactgcaacctctgcctcctgggttcgcgtgattctcctgccccatctctacaaaaatacaaaaattagccgggtgtgttggcgcacacctattgtcccagctaatcaggagactgaggcaggagaattgcttgaacctggcaggtggaggctgcagtgagttgagattgcaccactccacaccagcctgggcgacagagccagactctatctcaaaaaaaaaaaagactatgaacatatacagtgtatgttgttatcatatacagtgtacctggtatttatacattgtatacagaacatatacagtgtatcttcataataaagattatgcctctttaaaaggaagtttcatgaagaataaggctatactgtttctttctgtatcaagtataacccagagtttccctttaaaactgaaaagcttgtaattttgccattaaatgttaagttgcacacgtgcacatgtatacacaaacaaaaaaccagttcaaattgcaatcacgaagtatttccctatttgagggaaggccagtctctgcttgtttgtcttgctattgaggctgagtggagagagaagatgaaagtacgcccttagctctggggggtgggggagagcttacttctgctcagtgggtgggcatcccagggaagaatggcacacagtgccacagtgatttagggagagaaccctggagaaactgtattcaccagtggcagaagaaaaacagttggaagatagtagatgtgacagagtaaatagaacatagagattaacatattccctgggaaaaataatggaatttttttagtgtgaactaagaaagaagttcactagaacttctttgcattatttaattaatttgcagcatcattcaaagaacagactgtcacttggtgtgtttaaaaattatgattcttagttctagaaagaattctagaactatctctggaagtttaaatgtagcagactcaattgactgcaaggtggtaggctaattttctttttaaagtcacatttaaaaaaaaataccctttcctaaagctttatcttagccattaaaaaaaaacccaaacatctagatagcatttaaatagttgaaacttggaaaaaaaaaaaacccaggtttttacaaccctaaaataagtcctctttagttatgtagagaaatattttactttgtagttagaaaaataatgtgaattcacagcttaaaatactcagggtatcatgactctgcattgccttgtaccttaaggctttgaggggaggtaaactctaaactgttttattgccaaaatatatatagaaatttaagcttaggaccaatcaaagtgaagtcattttaaaaatcagttgctaagatttaagattattcaaacttaatgctaccctctgtaatagcataatttagccattaattgtggcttgaaagtttttaataatagctgagtagcattgtataaagggaggtcttaaagagctgtgtcgttctataactgtggttactaggtgatgcacttcttacaaaaagggcttctgattctaggattaatcagaactacaagccatgaaagggacattgccgtttctatgaagaagaattgcttcatggttctggttgctcaagtgctgtagcaccaagtttcctgggaacaagtactgccaccgtggaagcacttttatttacgtagggcttgaccccttctaaatgcaaacaaagaagtttggtttaaatcacagcagtcctccccacctcccctttaatattctagacaaggaaaatggtcagtatttaatcctcattttgctcctagcatgagaagaatcataatttttaaacacaccaaccaagtgatagtctgttgtttctttgaatgatgttgcaaattaataaaatagtgcaaatggcagtatctattatttgggttttcttctaccagatattttcagtgctttatttgtggttagtgccattacttcatgtgctgtcactttaatttgtctctctatctctttatgggatgttagtcactcgactatcaagttcttcagcaggattctcagttgggggtgggtgaggggacattttattaaaagctccttcctttgtcttcttccaattgattgcttaacctaaagggagaggagttctgtttgtttttaaagtaaggtatttatttggccagtaagtatgtttagagagttgatacttgcatgaaaattgctgcagatttgatttgggatttggagtaaagatagtgtgcttgttaaagtgttactgtgtgctttgacaaaatggaatgtagtatagaaagttgcttgaaattcaacttctcgtatatcctgaactgactaataaggagcaggcttttgggataaaaagtacatacgctgccacctaggaggtgaagcaagatgtggatttttttttcctgtatatggaaatagatgtgggggttcttttgttttatatttataaaacagtcctccctcactcttattccttcatgtgcggtagtccctccccaccatccatgagtttcctttccaaagtttcagttacctgccatcactgtggtgtaaaaatattaaaatggagaattccagaaataattcatggccagccgtcgtagctcacgtctgtaatcccagcactttgagaggctgaggtgggcatatcctttgagcccaggagttgaagaccagcctgggcaatgtagcaagatctcatctctattaaaaatacaaaaaaattagccgagcatggtggcacctgcctgtagtcccagctacttgggaggctgaagtgggagaatcacctgagcctgggaagtcgaggctgcagtgattgtgccactgcacttcagcccagcctgggcaatgggagtgagaccttgtctcaaaaaaaaaaaaaactaaaaacagaaaaccagttcataagttttaaattgcagtgttctgagtagcgtgatgcaatcctgcaatcttgtgctgtccagtctggaatgtgaatcctctctttggtcaatgcatccatactgtctatgctacctcccatgccaccaccccattggtcacttagtagccacctcagttgtcagatccaaagactgtagtatatatataggatatagggttgggtactatctgctgtttcaagcatccactgtggggcttggatcatttcccctgaggataagtgggggactgctgcctctgattttaggcatttcttttaataaggtatattatttttttgtatttgtttggtttattttgagacagtcttaactctgtcacccagacttggagtgcagttgcatgatcactgctcacagcagcttctacatcccaggcttgtgtgatcctcccacctgagcctcctgagtagctgggactacaggcatccaccaccatgcctggctaatttttaaattttttgtagagaccaggttttaccatgttgcccaggctggtctcaaactcctggactcaggtgaaccttaggcatgaaccaccacacctggccaggcatatggtttttgttataaaactaacatttattagagagaatcagaaaattcaggaaaagagaaagggggcctggcgcagtggctcatgcctgtaatcctagccttttgggaggctaaggcaggcagataacttgagggtaggagttcaagaccagcctggccaacagtgaaaaccgatctctactaaaaatagaaggaaaaaaaatgggcgtggtagcccatgcctgtaatcccagctactccttttgggaggctgaggcatgagaatcgtttgagctcaggaggcagaggttgcagtgagccaacatcacgccactgcactacagcctgggcaacagagccagactctgtctcaaaaaaaaaaaagaaggaaagaaaacggaaggaagcaccagattctaccagtgagaggtgtttgaagaaccttgttttcatagcctgtgtgtaaacgtatattttgaaatttaatttttagggaagtaacctgtgcattgatttagaaaatcccttaatactgtaaggtttataaagaaaaagagcaggctgggtatggtggctcacgcctgtaatcccagcacttcggaaggccaaggcgggcggatcacctgaggtcaggagtttgagaccagcctggccaacatggtgaaaccccatctctactaaaaaatagaaaaattaggcaggcgtggtggcaggcgccttaatcccagctacttgggaggcagaggcaggataatcgtttgaacctgggaggtggaggttgcagcagtgaatcgagatcgagcattgcactctagcctgggggacaagagcgagacttctctcaaaaaaaaaaaaaaaaaaaaagcaaagaaaagagcaatgaccctcttttctttatctctggcttgcagcttgcattcttcagaggcaagcactttccactccttctaggtgttttttccgctggtacttttaaaaattccatatttataaaatgtgttacattgctatttcttgaattttcatcacccctcaaaatccttttctttaatcctcccattataatgactataattgttttgttaaatatttttacgttatgacaattcatgttgtgcctacagcagagtcatataatgtactatgattttctggaaaattctgtatttccttgcctggccaactgtgattttgtttttgccgtgattttttgtttttatttctgttgctttttgcccaccttggagctatccttagagtcttttgttttcctgctctgtgctagacttgttgcttcagagttgtcatgttaggatgtgccttggctttcatcctggggagtttctgaatcactcttatgggttgggtacccaatttttctctttctttatttgctcactctttgagtttgttcatcccctagaaatttgcagaagaaaggggtacatgggaggtagctgtgttgagatctcttgtctctaaaactatctttctctgttaacatttagtgggcagtttggttgtagcatttaagcttattttctcgtgaaattttgatggcattactccgttttcttttctttttttttttttcttttttttttcgagacacagtcttgctctgtcacccaggttggagtgcagtggctcgatctcgtctcactgcaagctccacctcctgggttcatgccattctctggcctcagcctcccgagtagctgggactacaggcacccaccaccgcgcccagctaagtttttgtatttttagtagagacggagtttcaccgtggtctcgatctcctgacctcgtgatccgcccaccttggcctcccaaagtgctgggattacaggtgtgagccaccatgcccggccactccattttctttttcttttttttttgtttttttgtttttttgagatggagtcttgctttgtcacccaggctggagtgcaggggtgtgatctcggctcatcgcaatctctggctcccgggttcaagcgattctcctgccttagcctcctgagtagccgggattacaggcgtgtgccaccatgccccagctaatttttgtatttttagtagaggcggggtttcaccatgttggccaggttggtctcgaactcctgacctcaagtgatctgcctgcctcagcctcccaaagtgctgggattacaggcatgagctgctgcgcccggcactccattttcttctagcttccagtttgctaattgagtgtttgctttccttggggattttagtattttgttctttatattgggggtctgaaatttcatgatgtctgttgatatgctcttttaaaattcattgtcaacaatgcctagtcatgtatcagttcatgtaaagaaactcggtcttcaatatggatgatgcccctcaagattttgcagtacagttgccctaaagtacaatttccaggactgtcttttcaggcatggaatctttcagtcctggaaaacatttctttcattagttcccgggtaatttcttccagtctgttttatctgttattttttttctggaattcttgctagtcaggataactgttttaattttcttatcttatcccactattttctttcacttagcattttgttatgttttctgggagatcccttcaactttaacttttaatttttctgttgattttgttttcttttgtttctgagatgatgtgggaggggggcggtctcactctgctgcccaggttcgagtgcagtggcgccatctcagcttactgcaacctctgcccctggagctcaagcgatcctccctcctcagtgtcctaagtagctgggatcacagattgcgtatcaccatgcctggctaagtatttgtgtttttggtagaaatgggtttcaccatgtttcccatggttggtctcaaacttgtgagctcaagtgatctgcccgtgtccaccttcagaagtgctgggattacagggatgagccaccgtgcctagccagatttttttttttttttagacaaggtcttcctctgttgcccaggctggaatgcagtggcacgctcagggctcactgcagcctcaacttctgaacctcaggtgatcgtcctgccttagcctccccaagtagctgggaccggctaatttttgtgtgtgtatgttttgtagagacagggttttaccatgttgcccaggctggtgtcgaactcctgggctcaaatgatccacccaccttggcctcccaaagtgctgggattacaggtgtgagccagtgcgcctggcctgattttcttttttcccaaaaagctatttctcattcttttttttttcttttcttttcttttttttttttttttgagacagagcttcgcactgttgcccaggctggagtgcggtggcacaattttggctcactgcagcctccgcctcctgggttcaagtgattctcctgcttcagcctccagagtagctgggattacaggcatgcgtcatcatgcctggctaatttttttatatttttagtagagatggggattcaccatgttacccaggctggtcttgaactcctaacctcaagtgatccgcctacctcagcctcccaaagtgctgggattactgatgtcagccatatcacgcctggcctgtgtatcattcttaatttacagtgagtcttttctgagctcattgtttattatttttaataacatgctgttcttattttatggttgtagtaatataatatctcccttaggatattatactgtttctttttatattttgtgctgatgccttcattgtctaggtaggcttcattggagagtaatacaacaggagccaagcccggaagttgcagggacccctgaatgccactgtcttagtaatttcctcttttagcagccactatctctagctaagtctgccagtctggagagcaccagtggtgatgggagttaggactgaataccagtgttcttgggcttgacaatgtggggcctcatccctgctctcagctatgtcatgtgtttgaatccagagtctccaggtctgtttctctgaaatctgaataatcgatttcctccttgggccaagcagagaggtatgcagtaggtttttaagaagttgtatgtaagctgaatttttgtgaatccagtttataattacaggttgactataggaagttgccaattttctaagcccaaaacagtgactattagcaattttttatgatttggtttaaaccttacaaaatcactttttactgaatccttgatatggtttggctgtgttcccactgaaatctcaatgtgaattttatctcccagaattcctacatgttgtgggacaaacccagtgggaggtaattgaatcacaggggcctttctttcccgtgctattctcgtgatagtgaataagtctcatgagatctaatgggtttatcaggggtttccgcttttgcttcttcctcatttctctcttgcccccgccatgtaagaagtgcctctcacctcccgccatgattctgaggcctccttagccatgtggagttgtaagtccaattaaaccgctttttcttcccagtcttgggtatgtctttatcagtagcatgaaaatgaactaatacagtacattggtaccagtaaagtggggcgttgctgaaaaatacccaaaaatttggaagtgactttggaactgggtaacagaggttggaacagtttggaagactcagaagaagacaagaaaatgtgggaaagtttggaacttcctagagacttcttgaatggctttgacaaaaatgccgatagtgatgtgaacagtccaggctgaggtggtctcagatggaaatgaggaacttcttgggaactggaccagaggtgactcttgttacgttttagcaaagggactggtggcagtttgcccttgccctagagatttgtggaactttgaacttgaaagagatgatttaggtatctggccaaagaaatttctaagcagcaaagcattcaaaaggtgacttgggtgctgttaaaagcatttagttttataaaggaagcagagcataaaagttcagaaaatttgcagcctgacaatgcagtagaaaataaaaacccattttttgaggagaaattcaagccagttgcagaaatttgcataagtagcaaggagcctaatgttaatccccaagaccaaggggaagatgtctccaggccatgtcagagactttcacgtcagcccctcccatcacaggcctggaggcccaggaggatatggttttgtaggctgggcccagggtccctgtgctgtgtgcagtctagggacttggtgccctgtgtctcagccactccagctgtggctgaaaggggccaacgtatggctcaggctgtggcttcagaggttggaagccccaagccttggcagcttccacttggtgttgagagtgcagttgcacagaagtcaagaattcaggtttgggaacctctgcctagatttcagatgcatggaaatgcctggatgtgtgggcaaaagtttgctgcaggggcggggccctgatggagaacctctgctagggcagtgcagaagggaactgtggggttggagcccccacacagagtccccactggggcactgcctagtggagctgtgagaagagagccaccatcctccagaccccagaatggtagatccactgacaccttgcatcgtgctcctggaaaagctgcaggcactcagtgccagcctgtgagagcagccagaagggaggctgtaccctgtaaaaccacaggggcggagctgcccaagaccatgggaatccatctcttgtatcagtgagacctggagtcacaggagatcattttggagctttaaaatgtgactgtcccactggatttcggactcgcatgggccctgtaacccctttgttttggccaatttcttccattcagaatggctgtatttacccagtacctgtacccgcattgtatctaggaagtaactagcttgcttttagttttacaggcccataggtggaagggatttgccttgtctctgatgagactttggactgtggacttttgggttaatgctgaaatgagtaagactttgggggaactgttgggaaggcatgattggttttgaaatatgaggacatgagatttggaggggccaacggcagcatgatatgatttggctgtgtccccactgaaatctcaacttgagctgtatctcccagaattcccacgtgttgtgggagggactcggcggggggtaattgaattatggggtctagtctttcccgtgctattctcatgataatgaataagtctcacgagatctgatgggtttatcaggggtttccgcttttgcttcttcctcatttctctcttgccactgccatgtaagaagtgcctctcaccttccaccatgatcctgaggcctccccagccatgtggaactgtttaagtccaattaaacctctttttcttcccagtctcaggtatatctttatcagcgttgtgaaaatgaactaatacaatccttaagtgcttttaacaagcaaatgcttacttcatttatatttgtccttatcagtatcagttttgctagcttacctttttgcatgttagattttcttaaagggagaattacagctgtgacacgagagtggttagcattgaatggacagtctaagaattttgttcagaaggtttggattctggtcagagagcctggagatataatttctattcttatgtatgataagggaggtagtcctatctgttcgtttgccatttccaagttcttcatctagttaatatgaacagctttaaaaattagggctttaaagtaaaacagccttatataattattggcctctctctctcttcctttgtctctccctctcttccttttttacctccctccctccctctcgcttccctatccccaaaccctgtgtcccctccccagtctcctgacactgtctctttctttctctcatcagtatagatggtggtaggaaaaatgtttatatctaaattgatcagtaattgtaaatatgcagtatactgcataagttaaccctgagatgtgtttaactgagttttatctcagtttctccctggcaggtggtgctcatttaatagagaactcaaaaaagtagcctgtgttcagtccctaatagaccattgttgatgtcatagaataatttttttttctatatactatcatatggtcaggtaagcatttttagagaatgagttagaatttcatgaagactgggtttaggttaaaatacattcatctgggccaggtgcagtggctctcgcctgtaatcccagcactttgggaggctgaggtgggtggatcacgaggtcaggagttcaagactagcctgaccaacatcgtgaaaccccatctctacaaaaacacaaaaattagctgtgcatgatggtgggtgcctgtaatcccagctgctcgggaggctgaggcacgagaatctcttgaacccaggaagcagaggttgccgtgagccaagattgcgccattgcattccaggctgggcaacagagcgagactctgtctccaaaaaaaaaaaaaaaaaaaaaatttacccatagatgatggctgagatgtgttaggaccctttattgttttttatctcaagttgaatttctccaggttccatttttcagtagtcttgtccttgtttaggtaaaaagtgattacataggaaaatctgttgggtgaaaaggaagcaaaactttttttttttttttttttttcgaaatggggtcttgctctgtcacccaggctggagtgatgcagtggcactatctcagctcactgcaacctccgcctccgcctcctgggttcaagtgattctcctgcctcagcctccccagcagctgggattacaggcatgcaccaccacacctggctaatttttgtagagatggggttttgaactactgacctcaagtaatccacctgcctcagcttcccaaagtgctgggattataggcgtgagccactgtgcctggccagaaaccttttaaaactgcatacaagcaaaaccagaccagagcaccatatagcagtcagagaagagggttttctgagtcataaatattgactcagaaaaaaaattcaatatttttctgagtcaaaaatattgaatggtgtgaggaagagtggaacagaattggtacaccttagttcgtgtaaaataaggaagtgtgtcagaatagccaagtgctaagtttagaaatgagctaaataaatggagattcctgagaccctgcctggaaccaattcttaccagtgttaaggtcacagttaaaatttcccaagctctcccggataatgattgattgattgattgattgattgacaggctctcattccagttgcccaggctggagtgcaatagtatgatcttggctcactgtagcctcaatcctctggacttaggtgattctccacctcagcctcctgaatagctgggactacaagaatgtgccaccacacctggctaatttttgtgtctttagtagagatggagtcttgccgtgttgcccaggctggaatcaaactcctggactcaagcaatctgctcacttcagcctcccaaaatgctgggattacaggcatgagccaccacacctgacctctcctggataactactcttttttttttttttttttttttttaagatttaaaaaaactggtaaagagttgtccaaatacagatgtttctatttttcctctacacatgttcagactgatacaggttatgtttccaaaatcatgtagtttggatgggttcacttttaacccctcccagctggagggtatgcaggctttcctgttaggactagtacagatctcttcttatgggtgagaaaatagtcactgtttctttgcaatgatatgtaagtgtcattgtcctctgtgtttgaggataaaccatgccctctttgtacctgtctgtcttctttgagttggtgcccatcatactgcagataagaatttgcacagcttatcaataagccagttctctctcttccctcaaatactgggtggttttctcaaaaaagacccacatggttcgggataaagtgtttggttacttgctttgatgtagttatagtttctaaaactgtagcccaaaagagtagccaatgcttagtctttagtaggccattgtcgatgttgctcttcctgccattcttttctgtgaactcactataagtgcttttgatctcttgattttataaacacctatgtagtggttttatgtagcaggcgttgttctggatcccactctgtgtaatagggacaaaattaataacatgccagtcttgatggactggataggtctcaaaacttcattgtaagtcatgtgtcttgtttgccttttcattggtaactgtccctcacgattgaggctatgagttcaataaagagagatcttgctgtctttgttcagcattatgtgtgtagctcttgatacatttattggcagatgacatgctatagagtgctcatttatttcagagtccattggtcgacagtcttcctgattgatgactgtagtttctgcataattatgattgcccttttcactcttgaaagtatcccacaatggctgataaattacatatgcgaactagagtatttactatgtgtattctaaagttaattttatgagtttgagattatttttaagctttaacaggaactattaaaaaagggtattgtttgtcttctggatataaagtgacagtagttcactttgtggtattataaattttgttccatgggcagtgaatatctgatttctttaggattaaatgagtaagaaattctgttgtaaaagtgataccaagcctggccaacatgatgaaaccctgtctctactaaaaatagaaaaattagctgggcacagtggtgtgcgcctgttgtcccagctactcgggaggctgaggcaggagaatcgcttgaatttaggaggtggaggttgcagtgagctgagatctcaccactgcatcccagcctgggcaacagagcgagaccctgtgtcaaaaaaaataaaaaaaaagagtgataccggtgagcagacaactctggaaggctgagagaaaagtcatgaggtagtagcatgggtcagatactactcaagtcacgcttaagggagttagcattttcagctagtgattgtgtggacattggaggagtcaaagacagagctgccaaaaggttttctggtaaaaccaaaggtcttttccctccccaccttgaatgacattgcatctcaagagagtcctcgcttgatgctgttaattaattaatctcagtttactttgcattctgactttgggtatttttttcattttttgaaaaacagttcttctgatatcaaaacacttgaaaagccatttaatgacttggttttattcactgtttgagacagattgtttcaaagtgaggactatgcattacacaaacattgttaactataattgtatcctgtatacattttttaaaggtttgttttgatgttggcacctgtttaagattttccttttttgcttctttttgacaccatttgtcagaaaatgctggttgaaagggattgtttgcatttcattttttggtaaattcagcttcatgttcatttgtttaccaataaatttattagaattgtgcaaagtgaatataaaccgtttacacacattggttactcttgtttcagttagtaattatccctgcaaattgaattaatagtaaaatgtgtaaaacattacaattttttactttttttattttttactggcataggggcccggcatagtggttcatgcctgtaatcccagcgctttgggaggccgaggcaggagatcacctgaggtcaggagatggagaccagcctggccaacatggtgaaaccccgtctctactaaaaatacaaaaattatctgggagtggtggtgcttgcctgtaatcccagctactctggaggctgaggcaggagaatcacttgaaccagagagttagaggttgcagtgagccaagatggcgccactgcactccagcctggcaacagagtgagactccgtctcaaaaataaataaataaacaaacaaacaaacaatttggtttaaaaaatactaggattttacttaaaaagatttttaaactcgacaattcttactaagctctaggattttaagtttattaataaaactcttgtggcacacagaatttttgggtttttttgggacagagtctcactctgctaccccagggatggagtacagtggcgatgtcagctcactgcagcctccacctcctgggttcaagcaattctcctgcctcagcctcccgagtagctgggactacaggcacgttgctaccatgctcggctaatttttgtattttttgtagagatggggtttcaacatgttgccaaggctggtttcaaactccaaggcccaagtgatctgcctgtcttggcctcccacagggctgggattacaggcataagccaccacgcctggcctagaattgtttatctaatgtcaaagtttaatatggttttggaaggaagttatgagtttcacacaaatgcttataattaagaaataagtttagatgacaatagcatattaggctgttaagatttcaactctgctgttttgtaggaagccacatggaggtcatttacggttactagttatcttagtcagcttgggcagccattaaaaaataatactgtagacggagtggcccaaacgagagaaatttatttcttatagttttggcatggtagatttcatcctgaggtctcttctcttggtttgtagttggctgtcaatctccctgcatgctcacacgaccgctttttgtacatacagtaagaaaatacacactgtcatgtcatttttttgtaagggaactgatttcatcatgaggaccctgccactctcatgacctgatctaatcgtaattaactccaaagaccctatctccaaatgtcagcacattgagggattagcacttcagcgatgacttttgggaggacacggatatttagtccaaaacactgttttaactgaaaagagtttgcattatggacgtttatgtttgaaaaatcagctatttaggtagtggtggtctctcactttatttgccattgacttgttagggaaaccttttgctttctcatttcaagatgctagattagtaccttattatcatacttaatctgttaactgtgatttagaaatatcaggatgctataaacaacatggaattatgtgcagatatacgattgagagttggattttttttacatctcagtattgttctgcatattattcagaggtatgtactttgtcctaatatgctatgttatggctctttttttaatctatgaaaaattatatatatttatttatatatgtataatatatatattaaatatatatatatttaagaatgcataaaacacacttattctaaatagtgattttgatggaaatacgcttccaggttaaccactctccaggttaataaagagaatattgctagttccttagaagtcttccacgtacctctcacagatcacatccctttccctctatccagaggtaacttctggccttttattttacctttttttaaatttgagagatagggtctcactctgttgcccaggttggagtatagtggcctgattactgctcactgcagccttgacctcctgggctgaagcgatcctctggcctcagcctcctgagtagctgggattgcaggtacatgccaccatgccagctaatttgttttctagtgtttttttgagatggagtttcactatttttgcccaggttggagtgcagtggcgcagcctcagctcactgcaacctctgcctccttggttcaagtgattctcctgcctcagcctcctgagtagctgggattaaaggtgcatgctggctaattttgtatttttagtagattcgggatttcactatgttggccaggctggtcttgaactcctgacctcaggtggtctgcccacgttagcctcccaaagtactgggattacagcctgaccataatttttaatttttaattttttgtagagatggtgtctcactatgttgcctaggctggattattttttagttttaccatctacatgtgtatttctttcagttacctactactgcataacaaactaccctaaaacttacggcttaaaacaaccattttattgtatcttacaaatttgtgaattagggattcagtcaaggcacagcagggtgattcttttccatgcagcattgatggaggtcactcagtgccattcagctggcagactggatccaaagatagcttcactcataggtcttgcttgcactttgatgtggatggctggaaggctgggcttagctggaactgtgtaccagagtgtgtgtacatggcctttctagcattgcggtctgaaggcagttggatttcttaaatggcagctgagatttcctagagaggcagcctcaagaggcttgggcagaagtttcaagcttcttcaaatctaaccttggacatcccattgtattggtcaggccaatcaccaagaccagaatggattcaagccaaaggaattagacttcatttttcaatgggaggaatagtaaaaaaattggtggtcatttttaatttgccacagttcttataatagttctaatttttaaaattttatataaatgaagtgatatctgcaaatatttttgcagtttgcatcttttgatcaattttgtgggactcgtgaatgttagtatagttcatttttattgctgtatattttcatagctgtgtggctctattgtatagctagaccacagtttatccattctgtcattaaagaacatttgtgttatataaagatgctgcagtgaacattcatgtgtatgtcttctgtgcaaggatttctctgtgtacatacataagaacttttctaggctgtgtaagagtggaattgctgggtcacagggtatgtccagtgcatggtacttttgctggtcttctgtgtttatattagtataccactgtggttttaacttacattgcttgatcaccattggatctgagcatattttcatatacattttggtcatttattttactttctaaagcacttgctcaaatgttttgcccagtgttcttttgaatttttgcccctttttcctgtatgataactgcttgcttttaatccttccatgtgcctaggacagggagccatttttcctttttttttttttttaaaacagggtctccgtcgcctaggctggagtgcagtggcacaatctcggctcactgcaacctccatctcccaggcccaagtgatcctctcacctcagcctcctaagtagctgggactacaggtgggtactgctaccgtgcctgggtaattttgtttttgtttgtttttttggtagagatggagtttcaccatgttgcccaagctggtgtcgaacttctgggctaaagtgatccacctgcctcagcctcccaaagtactgggattacaggcatgagccactgcaccgggctcatttttctatattcgaaaagtttcatatatatgtctttaatcttctcagaattgactatgtatatatgagtgtaggagtttttttctcagatggatatccagttttcctaggacgatttactgaaaagttcactcctcactgattagtgattgcacttctgtccgtaatagttgcatagatctgttactgtattctgtttgttgtctgtcgctgtgtcagtagcactgtcttaattactaaaacattagaatatgtcttgatagtagaggaagtccttttatcttgtcttggctgttctttgttgtagtcagataaatttaagaattggcttgtaaagttccgcaaaggacctcttgaaattctgagattgcaatgaacctatagaaaaatttggagaattggtatctttacattaagtcttctagtctatgacaatggtaaaaacatctgtctcctttgccctttaatgtaaatgtttctataatctgaagatggaactaacaagatctgggttgaaacctcagttctgcttcttactgccttaggacctgaggcaagtcacataaactctctaaactttagttttcttatctataaaataagtggtaatacctactaagcagagttactaagagaatagggtatcatgttaaaaccctgagtgtagaaactagtgcataatatctcttagtgaatggaattaatatactacatctctctctccttaaagtttgtgggatattcagttttaaactgggtgccatataatgttttaatatccttgttaacaaatttatcaaaatcacatatatgggtagaatttaggtgatgggtatatgaatgttcgctgtacaagtcttccaattttgctgtatgtgaagaattttcataaacttttgagaaaaagacaacatatatgaaaaatatagaatgcttaaaagactttgctgcctctccctgctccatgtgaaatcacagtaaagccaagttaaatctgactttttaggttaaatgttttattgaaactattagcacacacatgctcttgtgggttgatttagttctaaatatttcacgttattagagtcattgactttttttttttttttttaaagtcatggagttccttttctcaatatcattaaccttgtaagatcttctaaaagtgtttacaacacagcttataattaactgatttttggagaggtggaagggaactaagttcttttttttttctttttttaaatttccgagatggagtcttgctctgtcgcccaggctggcgtgttgtggtgctatctcagctcactgcagcctccgcctcccgagttcaagcaattctcttgcctcagcctcctgagtatctgggattacaggcgcgtgccaccacgcctggctaatttttgtattttagtagagacagggtttcgccatgttggccaggctggtctcaaactcctgaccctgtgatccgcctgccttggcctcccaaagtgctggaattataggcatgagccactgtgcccagctgatagggaactaagttctttggtgcattggttatcttttgctgcattaactgactatggaaaaaattagtggcctaaaataataattctgtcattcgagttgggctcagctgagcagttcttctgctgatactgcctgaagtcactcatgcatctgtatctgggagctatactggggctggagggtctaggaaggtctctcactcaaatgtctggtgccagctcatctgggcctttcttttcacgttttcaccattcatctgtttagtccaggcttccttaggtgttgctgggaacattccaaaagggggaaggtggaagctttaaggcctcctgaggccattgtacaatttcacttctaccacattctgttgtagattagtttaggcatgaactgaaatggaaaatttagcagaaatggatcctggattttctggtacccgtgtttcgtttaattactttgttgctttctctccctccctgagttcaattaagttgagaaaagtgttcattgttattactgatggattagactttatttgctcttcattgaatgtttcagttaatttacagactagtaaattatctgagtcatcaagttatgtacgtgtatgtgggtatctatatacataaatatagataaaataatgcaggaggcgaatacttgcagtggctttaggatgattgttatattcctgtggttcctgcttcccagaaatgttttctgtgattacatcacacgtgtccaggtttcttatgaatgaacacttaaggagcactgcttcactggagggtaattaacacattctcagacatttaatttcaaaagcaaagcatatatgtctttctctaaaggcccatgaaaacaagttttttttttttctcttcatgaaattgagtgattataaaaactgatttaatccattgtaattttttgttatccaaaagttgattttaaacagtgaatcagatttcggcactgtgattcatactcccaaaatgagtaacatgattagcaggatattcctagttgttctcttgacttaaaaaaaaaaaaagtccatggtgactcctccatttttggtagtggagttgtattgggtctatgaagaggctttgcgagaaaaaagagcagctatttatggagcatttcctcaggcctgcaatttgaagctattatagcaaagttgctgagcaagtccgtgattgcaggccaacagtcattcaagcccccatcctgcagtctgtgtggagtgagttcaaaactactgctgtgcaaagttttccctctgcagtgtttatcagttgcctactttgtaaagagcaagggtttcaggcattctaaacccgctttgttaactggtagattattaagcagttacaggatataagctagtttttgggtgttcgggagattgttcagcatttaagaatacaatgattcccccatcccctactcccttttagttacttaaaatcaaaccatcttatcataaaatgcagattttatgcagatttttccagcagttttacttacgcttataaaaacagatgttgggttgtctgtcaaaggaattatatcctgtagacctggaatctgtgtttgaggggaatttgattttagattgtagattgctttgttgcctacctatgaaaacatcatttatttttgtgtagggttttgtgagctttttttttaaatggtgacagaaaatgaaaatagcctaattgtgttttttatcatcaaaggatgaaattggcttatctgaatttggctggaaaatttgatttggtatcagcaaatgatgaactgaaaatcaatgagctttaatctgctctggataatattaacaggggtttatcctaaataggactcttctaacctgtgaatcttagaacctttccactttttggtgtcaaagttttaaagcatagtagcttttctgtatatatagtctgatagtgtaaaaaaaattgggtgttgttgcatgttattctctgtccctgtaaaaaaaaaaatctgtatttttccattgttctggaaaaaattcaatttcaaggaaaattttatatagctactagaaaattagtttttagcaatatctatgattttcatttcaagaaagcaacaattgataggaattatgttttgaggattgaaatctactctaaattgaaagtgttcacatttaatataataatctaggatatttaaaagtcatatgggcattctataaaagagaagtatttcttaatctgtttcagtaccccccatgccaacaaaactacgcatgatagcaacacacactaaaaagagaaagaacagtgtcattaaaggatgtcccccagattactaggccttttaaaaatgacatcttaggcctggcgtggtggctcacacctgtaatcccagcactttgggaggccaaagcggacggatcacgaggtcaggagtttgagaccagcctggccaacatggtgaaaccctgtctctactaaaaatacaaaaattagccgggcgtggttgtgcgcacctgtaatcctagctacttgggagggtgaggcaggagaatcacttgaacctgggaggtggaggttgcagtgagctgagatcgtgctgtttcactccagcgtgggcaatagagtgagattccatttcccaaaaaaaaaaagacatcttaatccctacgttctcttgggtttcagtaagattgggtgaaatagtgagtttcttaactgtggcagttacaactgagagaaattttctagttctgttacataaattgaaattgaggacatttctatttcactgaatggtggcttttgggaagtggtccttagatgttgttgcctcacctttgtgcctcacccccatcttttccggaacgatttaaatgaaatatacattcccttaagattcagctcaggtgttaattcctctagagagtctacctagatttttcctgtccaaagtctgccttgggagtccctcatggcctttcacaactacactgcattgggaatatgagttttcactttggacttgatattgtgtcttgtgtgcctagcatagagatgcagcacaatatgaatgctcaccaaaaagaagttgagaactattttcgtgttcccagtcatttcagaagcattgacttatttttacctgttttggtgtctttataaagcttcagcaccatgctcagaggtatgggacaaggattgagagcaatgcagtccctgtcctcggttaggaggcaaggtgggtgcaatggtaagaagtggtatgaaaaaatatccagttggcgctaaacaatgtggtaagccctaagtaatgtagcttaggaactcaggaaaaaaagagagacttacttctgtgttggaattcttggagaagtttggtctttggttgtatttgaaagatggataagaatagacagaataggattttattctgtattgaatccttttgttgactttgctttatctgtcatggttttataacaacatgtaattttagtatttctgcatttggttaaaaaaatttcctctcatttgaattttaggtgcctgattgcttattctcctccactagatgtggtaaggcccattggacccaccattgtgtcttatgcacttagcatagtttgtctggtatgcaatagatatttgagaatgtggtgtgccagctgatttactgactgaattctggagcattgttttcctcatttgtaaaattcggggattggaatatgtgattcgtaagaacttttgcagctctaaaatgctgtgaaattcaatagatttcctgtgaattctcaagtctatatatattttctagtgtgataacattgtatttgcagtgtttttcatgtagaataaagtataagtttaatatataaatgttatcattaatccagaagatttagtaatgttggcaataggaggagtattttcagaaggatttttcttactgttacttaactgatattttggaggaaaatgaagaataaaagctctaacagtgacattatagaatttaggtagaaattaagagggagttgatatttagggctgaaaaagagagggccaacctttctagagaaagatcgatgattagtttttggttgtagttttggtaagaatgcaaagtaattttaagcaatatttgtcctgtttgagaaaatgctaacatatcacaaattgtttattatctgtcaaactgtggaaaagaaattaaagaagtttgagattttaacttgcagctgtttctgatttgtacttttctcttagcatgaagactgaggcagtcaccattcctgagagccaaaaaagggccgtcttcagccttctgagggaagagctattcattgatgtcagagccatggcatagccagacactttccatagctttgagaatctattcttgacagtcagttttagttttagactgttttgattgtcaagtacaactcagaagttttgtatgtgtcactttccatagctttcagaatttattctttacaatcagttttagttttagattgtttggattgtcaagtaaaacttagaatttttttttattttatgagtagggtaataatttatacttagatttaatttcaaagaaccgtttgtggctaataagatattttcaaacttttttagtaattgataggaacttcgttttgagcatataacatttgttttatgtcctgcatttgatattactgctttgaagtgagagcaactgtatcttaaatacttaggtgtagtctcttaacgtgtgttacctcttttaatcctcttcatagttaactgttttataaattgggggcctgctttgaagagattaagtaacttaaacaggttcacccgtccaggtatgtgtcactccaaagcaggagcagtttctgtgaccctatggctgcctctctgcaaccattaaaaggttttttttgtttttttgtttttgcccttcaacaagttttggcataggttaagagaaatatagactatattgcgttttctgtagtatctcatatggcatacttattcatttggtgatcagtaaatacttgttgaattaaactggggcacttgctatgttccttaaaagaagtggcatcaataaggaagaattaagtactgttgcagaagctcaccagatgattctgatgtatccatccacttaccaaatagttgttgaatgaactggaaaattttcagatttaagatatgattggcatatactttttcatatcatcaaatacatccatcaagccatgagatgggtagaccctcattgtacagatgtggaaatgttcaccaacattagccagcacaccccccatatctgccccaaccctcaagtttccttgattattttatgtatgtgcgataatgtgtgatactactactacataaactgtaaagggccatatatatgttcccctttattacctgactattgctaacagcagaacacatagtgtaggcatgaaaggaaggctacatagccatcttgttttatctgaaaaccagtgttttaatcgaacaggttacttgttagtacttacatattgacttagaagttgataaagatttcatttatgcttgtgttgctcagtttttgtatgataactgtgaaaacagtagcaaattcaaattgacagtcatttgtcataacctccttaatggaactgtcctgcttggaatttcccacttctgggaatgataagcaataggaatgatttctttcatagtacctgattaagataaagtggccttcatcataaagacgtgtaaagaaaactaagcaaatgtagaggctgacagatatttgtagagggcatcccagcattggcagtccagcctgagaagagacaggatgacctccagggtgctttctggctccagacctgtgatcaagagtccataagcatagctgattgagcactgaaagtagtgattaccagagaaaccaatgtttaatgaaaagtgaaaattcttgacattgtagaaatgattatttatgcctatatacatagagaaatcccagtaatattttctcaactatgtacagaattagttcaggttatatagttcttgtcatgatcttagggccaaattattcccataggagtaaagtacatattcaattgtattatttaaattggagaaaaaaatttatgtaaagaaagttaccttatgccattttagaacctctgctatttaaagtaagtcacctgttgtatgaatttgtaatgtggcttattgatttttctaggatgcatatttttaaagagcagaataagcttctgctttcaggaattcagcctagtatttcaaatgagagctcatgtattgcaacattatttatctatttttgtaaagggctgttaatcacttggtgccaccctgtctgagttgtgtgcttgtagattgttcacatgaaatcacttgatatggcatctcatttctgcaagaattttttctgtatttttagcccaccagcctagcatgaagttaaattatttaatagaaatatttagagaccagaagcttacttttaattttgcgaatgttgccttaccctttttggaataggttactgtttaaaaacgtgtcgatgtagttatgcaatataattcatttatcctacctttggccaaaacacacacacacacacacacacatacacacactcatgctcacacactcatgctcacacacacttattctgtctctctctctccttctccttccctccctctcagctatttctgagcacagagtcttttgtttaaaagagggattagtatgtcaaatttgtttctatattgtatttctgggtttgaagttttactggatacttggtttttggtaaggctgtcatttaatgcctcttgaattattctgcaggagtattagcaagagttgtaaaccggagttcatatgtgaaatgtgagactgtgacctcttgatccagaggccaggactgttgccaactgaaccaaacccttccttttcctaagaatagaagtgctctgcctaatgattggagttcagctcagtgtttttggtgttctccagtaattggttagaatctcaccaattgtgttttgagtggccaagcaagtatttctttgtagggataaagagaggtacaatgtgaataatttctttaaagagttcatgaaggaattctggtatatcagaaataccactgatatgtatgacctgcctctgctcctgccccatagaagttgctatcaaatgtggaaagacactgtggaaagaagtgtccatttttaatgttaaatgtaaccaatttgataagaaacctataataattgtatcatctaggtctctaatacttgaaaacttaagttctataaattataaatattgaactgagaaaaaaattgaaggtaaaagacgttattaggacaaagaattaggttatttgtgaggcagtaaatgtaaaatgttgactgtattttataacctattagtttgaactgttcaaaatcagaacatagtgagcttcacaagttttcatcttatggacaggattaataatacttcataaattcactattcccattctcagatccaagatgccttatatatatttctactttccttactcctttgctcactcattttgctcattggactttccagtatttgcagtgttttgattcctgactgtcttgaagtctttcaggacaaaagtggctatgaagctgctgtctgccagagagactaaaagagaagccctcttctttgacccagatagtaaagatagatcatttgatcaaaattcagttaggtcaagttagttaagtcagaatgtcaaggaatcagtttagttagttaagttagttaaattacatataagtaatgtacttggacaagtcatagaacgatgacctacagattaaggtccatagcctggccccatatcacctttctagcctcatctctccctccctcttttttaattaataaaagacaaatagagacagggtctcactatgttggctaggttagtcttgaactcttggccccaagcaatcctcacacctagacctcccaaagtgcgagggttacaggcgtgagccaccacacccggcctctagcctcatctgcatctgccatctctcctcctcactcctctctcctgcctgtgagacaccaccaattggatgtactgaagagatgcacctcttttacatgttgtatattcatgcatgcattggtagcattgtaaatgctctttactacttcagctacttaccctgagaaggtcttacacacccctcatttttactttatcgtttaaggctctcagatctaactcaaatgtgtcaccatctttttcctgtagctcgtactaataacatttgaacccctcccttatcccaacttctgtagcattactttactcatttttattcctatagcatttcctcaactctaatatgtctattttttacattttaacctctgaaattagggtacttcttacaattcatgggatcttagttttgattaaacaaggtacttccattctggtggagaattgagattctgtgcttgccttgcttctggaactttcattcttgggtccatatctctaattcctcttccagcacgacaactaataatttgtgctcaaatgttgctaaatggaattaaaatactgtgtctggcttttactatattcaggggaatttcaagggcatgatttgttctgaaatctatcaataataacaataatgattagcatttagagagtctttattttgtgctaggcactgctttaattcctttatctggagtaactcagtgagtcttcacagtaactctgttatctctattttatttttgagaaagctagggtacagttcagccaaaatcgtagaactaataagtggcacacttaggattctagctctgttaatctggcaccaaagtccacgtaaccactgttatatactaaaatgtatttgaatgtttatttaaccagctctgcgctttgtgctttagctgcattttttaatgtaatcctcattatagccacatgaggatttatagtgtagtatgccagaacactccagtagtcatctttagatgtaaattctagtctctattctgatactatgaagagataaacatattatagtaaatttctacatgtacatgcgggagtttgagggctaataagatgatctttctagtcttttctaccttttgaaatcattaaatttaattgctgaaataaatccagactctggtggaaatgaactaacattgagcaccttttatgcttaaggcaggtgcgcattatccctatttacagatgaggaaaagaagttcaaagatgaaataatatgaccaacttattgaacaagaagtacaggcagaatctgtttcagcattgaatctccacccctgaggatggcttctacacaggcagagcctctgtgatattatttttatttttggggtttttaggaaatcttttttctccaccatttttttatttcaccattaagttatcttaaaaccaggtcattagctgtcttttgcttacgtattttagttattttcaacagcttttactaaacatttcgtaaccatgtacatattacttaatattaaccacaccatttctctgtcatctataccacaggctttaaaaactggcatattagagatattagaatgatagtcatgtgaaaggagaagaaaatgtctactatgtagattttagaaattattggagtatattgtggaagttaaagttatagaaaggattttgaaagcatctttgaattttctagcattgtgttagctttatgactatccttggttatttagaataattaacacagagtagtctatattagacacttaagaattttgaatgcttttactctgttttaaaattctagccagtttcataacatgaaattaatagagcatgcttaaaattgggaaactttggtgtttcttagttgacttgtaagagattgcagctttgatctctaagctgcaagtaaacatctgacttgtctataaacacatggtttcaaggctttgggggagcctaagaagatcattggtttgaaagctgaaataagtgtacatttatgacacttgtgtttctgcaaaaagagaagctttggattaagtttatctgagaaatgttgtgtgatagacaagaactgaaaaaaacaagagctatgacaaagacttaggtggtttagtggtggttcactcagttcaataaatcccgtgtacttaacgtgtgctacacactgatggtttttggatggcattaatgtgcctagtttaaggattccatgagagttcatgatactcagtattggtgtcaacttgggggtaaccatacagcactagaatcattataaagtatttattcaatatatttttaagatattatttctcttactgttctctggacaagacatcagtatctgaaatgcctttcctcaccttctgtctgttcttggtcattatatcaatctacttttaagaacatatacaaattatgctttttattgcacatgtagagatttaatataggaggaaatgtttgaaagtatataaaagccaaaagaacaaataaatgatctcataaccgattgataacttattggctgtatattttcagactgtttaactataatcttttaatattgccaaacagttctctagtacagttataactatttgttgttccactagctgcaaatgatagatagagcctattaaaatattacttttttactgctttgtgtggtattctgatatcttttacctcttcatgtgttgctatgtagtttttgttggttacagtttgaaatatgagttccttttgcttattaaagtgacatttctgggcaaaacaccatactggaggatttggaggaaatcttgaaattgttcctaaaggcaacaaattgaagatatattaatgctatgtaacctgagcacatttagataggagatcaccagccattggagtcaatctgcaacttcctgaacaggcatgttttggagccaggctttgaagaagctgtaggataagagaaggaagagacatggtttgtacagggagatggaataagatgggtatgatatgtatgctggattagaaattgataggataccttcaagagagaaaagaagctagtgagataaagggttcaaaatgaatgttaagccaggagatggatgaaagaggaaggcagatttattgtcaagggaggggaaagactaacatcagttatgtttaagggaagctggcctagcaatttacatggaagtggcttgtgatacagggagtatagtttaagtcttttaaggtatatgtgaaatgattggccaaacttgttattgctgagtatagaaagtaaaaacagaaatggtatgtaaataacttaatattgcttttgtgatcatggaaaagtaggaaggatttgtttgggaaaggaacgatgaatacctttgttttcagttacataaaagattaaattaattttcctcctctttcttgttctgttgcaactttggactccagttggagactggatctcccttattctgtacctgacatcacctggcatgatgactttgctcatagttgttgctcaggaacattcattaactaattgcgtatatgaagaaatatagattactggagtatgtctttccactgctctactgatatttgctaaaaaagagattttgagtagtgtgctttttttttttttttttttttttttttgagacagtcttgctctgtggcccaggctggaatgtagtggcgctatctcggctccttgcaacttccgtctagtggattcaagcgattctcctgcctcagcctcctgattagctgggattacaggcatgtgccaccatgcctggctaattttgtatttttactagagacgaggtttcaccatgttggccaggctggtcttgaactcctgagctcaggtgatcctcccgcctcggcttcccaaagtgctgggattacaggtgtgagccactgcgcccagcctgcttactactttgcacagaaattagaagtatcattttagcatcccttgtcttttgtctgccaatcaagaagtttcagaatgttttgatctttggccaagtaaagtattgccagtcagtgtcttgggagattttaaagtgatgacgtagtgcttagttatcttacatagcaaattgttgagatataaaatatattatcaaatagttcagttaccaattaagcctgcattatataatgtatgtgattatctaatggtttcacccaaatctttttctccctttaaatgacatcctcgagtgtagggattctatcttgtactactcattttttagcccccacatgtctatagcattgtgtatggcttacagtaacttaaaaaaatgtgtgttggcttaatttatgctttaaaccttaaaacatgttaaaaatatattgtcatattaagaatattaatagaaccttgtcaaaaaatttttacacatgcaaatcttttttcagtgaaaacatacatacaaatggtttttttttttttttttggagacagtcttgctctgtcactcatactggagtgcattggcataatcttggctcactgcagtctctgcctcctaggttcaagtgattctcctgcctcaccttcctgagtagctaggattacaggtgtgcaccaccatgccgaactaatttttgtatttttagtagagacagggtttcaccatgttggccaggctggtctcaaatgcctgaccccgtggttgctggtctcgaatgcctgaccccgtgatttgcccacctcagcctcccaaagtgctgggattacaggcgtcagccaccacgcctggctgaacatggtctttattcttaagactagaatagtacttctcaacaagggatgattttgtccctttccttcctgggtacatttggctatgtctgaagacatatttggttgctagaatcatgttaagccctttttcagccagtggggtttagctgaaatgtacttgggttctctcatttaagtggtacagaaatcatacctctgtaatttagcccatggtttccccttgcctctctttcaagaatgcttctccagtctctccagctggctaattttatagattattcagcattgccttcagaggctgtcacctttatgtgtcctcctctgtatcactaggttgtaccaagaacctttccataaacaccctaaacctttttctatcctctatcattttatattcatttatagatcattttatattcatttctaacctctgtcattttatattcaagttgtatctttatggatctttcccactagaagataagctcctccaagtcagggattatgtgttattcattttgatgtcagcagtacttggcacttagtaggtgttcagtaagtgctttagacaaactgtagctcagataatattgtttggcttaggtttagtgcggtttttttggtggtatggagagggttgggattgtggagagagaagctgattgacaggagacttgagttctagttctgcctctacgacccattagtgccatcacctcaggcatggttgagtgaccattatgagttttaattatgtacagagtgagggaggattgggctacaaggttaagaggagcactcatcccataagctgtgtatcacagctcacttaactgaggccagacaaccttattgaacacagctgtgtgtccaggaataaacagaagaggcttcagtgtaactgccagatattttccccataacttaagacagcagattagaaacagtagttaataggaaatgcccaacacctgggagtccaaatgaagaggtcctttcacttatctgtgaaggaacttttggcctatactgtctttattgatggcctggataagtgaactattattgtattcaatctggttcacatatagtcttcagtaaccatttctcaccgctaatgaaaagctatctgtaagatgctgatgaaacagctttgtagtgacttgtttctcaacctctgaggcattgacctgaaagtaatcatagatgctcttctaccagtgaccccgatgttagcagttgttggggaggtgacacataaggcagtggccatgcgactttcactctggcctctgtagattcgcctcgatttgagaggtaagtctgggttttgtctagggaaagccaggctactctgtaagtctgaaaatatgtgttttagtcttattgtgggcccttaattaaatgtccatttctttgtgtataaaatgaaacagttggtcaggtggtctccaagtttctttctgacattgtattcttctgtgtgagtttgcccttcgatttcagcaattctgttatttttatttgcttaatcaccaaatgaagccattcaaaaggttaaactattaagtgtttcaaaagattcagattatgcctggaacatagctgagtaatctgaatatattttagtgtttgcctcaattagtagaagtaagttgtgctgtccttgggtaattaaagggaaacttaacagcctttcttggaaatatatgtattctgggtttttcctcaaaaatgcaggagaggaccattggttctgttagctgctgtgtggaggctgagagagcttagggaaaccttcccaagagcggacatttgagctgtcctcaaagacttgacaggagaggagtggggatgggaaaggaattgaaggcggagatactgtgtgaacaagggcatggagacatgacgtagtgatctacggctgaagtttcctttcaggtgtgaagtgttttttatattttgagaactttgaaattttccttttctcttagattttaatcacatctccatgtggacttcatctttatagactgaggtgttccaattccagttaggcctagtctttgttccatcccttaagccattttcatagttcatcttttgtgtagcagttacatatgtcagttttgagcaatagtgaccaaaattttccacagtatcacagatatgagtgattcacagatggttaaagtcactgcgcactcttccactgctcctccccaccacagttgtagtggacaaaacattttatgaaaactcttacatgtatagaactttgtcttctttttaaaaaggatagcagagaaatcatctttcttttataattcttaggtatgtcagtcttctcaccttaaaatgcaagagtgttttctgatacagcattgaagtatcagttattttctatgtgtttattatatgtgaattagaaattcaatgaagtgagttctgtggataaccaaattgagttcctgcttcaggaacctttctcagtaattattaatctttttagttattggaagaattttgaaaagaatttcaatgaaactcctaatatatttgctgtactcaattatctttcttccaatttagtaaacagcctttttactaactttttagattccgagagcttgagtttgttcttagtgagctgctaggcaattgacatctgacatcttaatgggagactagaataatattcctctccatacagaggaactcttaaaaaaaaaaaaatctgtaagacctagaaacctgtgaacccaccttctgtgtaatcctcatgtaacactaaagatccagcctgctagcatgggtctcatagattgaggcagtctctaagtgatcatgttacttaatatttacagtataacctttttattaatttctttttaatgaccatgactgtgactattagtaacattttctaccagtagccataaaaatccccctcaaaaaggtgataatatatttcatagtataatggaatttcatagtcatttaacttgagaggttcaaagaagaaagctgtattttcactgacaggatcacatttcaattgcaacttaacagaaagcaagttgaatcctagttttcagcctgaacaaatgttctgattctggtgaactagggaatttaaaatatctttatatgattataccacaactgtgttctcttgctttctctctgtaaacatgttaaatccagaggagacagaagggaagacatttaatctgtatttgtaatttggtattgaaagactactgactcttctaagtaagccagtcctgtaagcatgatttgtatgagtgtctagcatttattttctttaaaaaaaaattacacatgcatgtgtatatatatatgtgtgtatatacatacatacagagaaaaacacagcatgttataatcatacaaagagatattaatggatggaagaatgatgggtgactattgcaagaatttttggccatgattgaaagaatcccaccactcttttgccacatacgaaatccacagatctggtaagccaccttaatatctgtcatagtcctacgtgtaaaacttattcactaatttattattatcaccagtaacctttatttagccaagggttcccttacttactttaaattactttgttacttattggtaatttaacacccaatgtgttactaacagttgaaaacttgaatgttgccataaatacgcaatggatatggtttcaggtttgtagctaagtatgattccctcacagcagacatgtgagccaaaagactgaacagtgttgacatcagatattattttatttactttaaaactggttatatggataacatactttgttttgcacaacacagtaggcagtcaataggtgaagtatttgttcctgtttaatggtggcctgttatatatcacagctgctgaagcagaggttcagaaaagtcaaattacttcactgagattgggtaacctaactcccaacttaaataaatctaatgcctttctaccactgtcctgccctcttttctgattgtggaaggccctgaaagcattaccaaagtttcaaagttacctaaataacatttcctaaaaatgacatctaacgaataatgaaacatcaaagtaaaatagattttttatatcatttaatgagtagttaagactaggtaagactctgtgcttagtatctatttgtatggaaaccatctcattatttgacatacattacgtatagaatatgtaacagttaaattgttttatgttttggggcccctccccaagttattttgctaacttacaatatgaatctttgtagatgattgaagacattctgtagtgttaccaaacttgttaaaagtaagtggtaaagaacacagaaggttccttgactgtttgtattattttcatcaaaatggctggaggaggagtgggtggtgtcagcagtttacgttacaagttccatatacactttattttgatgaagaccatttgcccactttgctaagaagcgtttagtgtggattttcctgactcttttcctggtgatttaccctttgggaaatgtttccctcgctgttagacttgtgttgtaataatattttgggtggccgaagccctgttatgttgttaacagttgaaaatttgaatgtcaccataaatatacagtgaatgtggttccagatttgtaactagattccctcactgtagtcgtatgagccagccgactgaacagatccttatttggaagccactggtgtctgatgtggccacagaacactgattataactttgtttgactgcctaaacctgtcttccttcctggtccttggttgagggcattactcctaagtcatgtcatgacaaatgaggtcagagttggtacccatcacatttgtttcatcttcacagttttttttttattctgtgcctagactgacaattataaaatgaaaagataatactgccaatgtctgtaacctatataagaaagttcacttctttttgacatctgacatgtagtagttccatttaaaatagtatttgttcaggaatgtcagtttaagcaaaacagtagaatatgagaaaaccaccaaccatcttttgaagaggttgaattgctattttggctcttttgggtaaataaatgtcttactgtatgtaaagatctgagattatgaaagaacatgtaaaattgctaggtcaattattttcctgaaataactgttgttattcataaaaatacccaggtgctaataagtctgccctgctaattttgatgcaggttgtttgggaaccacattttgaaaaacacttacagcagactttctgtaactaaaatttctcagggctgttttaaaatatttctttatttttagttctgccatttctctttttttgccttttccctgtaaggtgattattacgaaaagagctaggtggaccttatcattggaattctagtctttgttttcagttcatactctaatgacatctgttgttttctatatcatgaaatcaggacaaatacaatttttgaacttttgggaggaatattctcagtcactatggcattaggaaaagatgttcaattttgctgaacgtaacttcaggtacacgccatttgggatcaagattgagagaactgtgcttgcttcaggaagcctccacttgagctttggcattattctcatggctggtccatcctcaccctttccttagggaataatcatttcccaggggagatgtattatatataaacatgtcagcatgtcactttttttgtcaacatgtttaagttgtgtttaaattggtttcatgcttgcgggcaaatgttaattttatcaaacctaaagctatagggtcagattatagtgtggtgtacagtttgtagacttataataaatggtcatgtttgcttttatgtatttctgctcatacttgttcataattttaactcattaacagccttcagtgatagcttaattatttaaatttcaatttaagattctgatatcctgtagtgcagaaaccatattatcatagaggcaaaatgtttacgtcttctcatgcatgtcaaggaaatatagtatatgcataatcactgaatttttgaggttctagaaatagtccaccatggacatatacaaatataaaaagcctatagttgtggtttaggaactgtggctcatggaaggattagattgaacaatgtatcattgttcctagagtcagttaagcgtgtaggtttagctagtttgggaacagcctctagcatgtgactctataacacttgcacaacaaacatgggcctgataagtgagcagtaaatctgggctgactgcccactcccagtactgccatcatagtattttgagggcctgacaacaatattaaaagcttaaaacattcttcacaccgttttgtattattcctggttttccagttttattgtttactaaaagtcaatttttcttaataaaaaaagattgtttagttggtcatttgatttctcattagatactaggctttgtgaggtcttacatatatttaagttcaagttttctcacttttcttcagggaagtgggtgacttggttgtcctgatgtctcttttgggcacataaagcacatttttgtcatgttatctttgttcacttttatcagaaaaaattcagtgtctgagcaggtcactatcatcaaaagtgcatgtttgggtttttttctcttttccccttacaacacaatgaagacagtcttaaaggtgtgttaggggcttaaacacttgacagctgcatttttaaaaaagtttctaattatggtatttggagtgtccataaaaagcttctatttataacgtttgtagattatattaaattcctaacgcctaatttgtgccatctgacatcacgaaatcttagcagacttggaaggaaccagtttgttaggtagctgtgcacaggtacaaacgatttaagattacactcctgggattttgtgaaaaatcggttttacaagttttttagtttagaagaaacatattttcaaaaatggattaagaaaagaggacaaaagatacaatatagttaggtttaagtttaaaaacagtttcattctactgatactagttctagattttaaccaagatggaatcattttacaaattgagagtttcagaggttgcttaactcctcagattagtggtttttgctttatcatggacacaaaatatttaccctccaggcatatgtcgttcttaaaacaatgttgtaggtgatcaaatctcaaagtagtatctaaggcagtgcttctcaaacttcaacgaacatacagaggatctcattaaactatagattcttcatcagtgggttgggtggagcctgagtttctgcagttttaactagctcctgggtgtgctcagtgctgctggcccaaggcccacactcttgaatagcaggggtatgaaagaattgatagtatccattctttgaagtttccaaaccttatcacagtaccagtatcaatgttaatctctttcttagtatattatttttagttatttattttactaacctacatgagcactaacctcctactagtgctttcacaaattagcattataaaattataatcctaaactttgaagataggtataagaaagtcatcagtgttttcattactataaagcccattttgattatgttgttcagtgttccttaaataagggttatagattcagcatttgaaaataaaacacacaatcaagaatttgaagtgtgttttagaatttattaggatgagctttggctaatgcttaagaaatattgtttattctttgctttggtttatattgacagaaccgactatcttatggcttaagtaaaaattgattgtatggaaaggtttttagcaattaatattttgcggcatttggttatagggatgagatttttattttatttccaaattattatgttgttccccttcccctaggagccaatatagtctacacttgctgagttccttttctagttcattctctgtctctctctgtttgtttgtttgtgtttgtttttgctggcgaggtgtttattgacaggttgtggtgccgcacaggtcctcaaagcccagccagccagcaggtacccagggcgcagtgctcagcctgcagcaggagggtctccgttcacatgtccaggcttctggttaattctttccctaagctgatagctctctgcaggttgaagtaacggtccagaaacatttttatcatttctgttccttgccttcaaacctgtggcatctacctactgcatctcttcattacttattggtgaaaaccaaactcctattaaagctcttaaactagacctgtcatcttcacttaactgaactcttatctcatttttaacaaaacatattcttggcccattcaccatgaagtttttcctattttaaatattggggtagcaacagaatgaaatttttgagggctttttgcgtaccaggagtcacagtcctggttgcttttatatatgttactgaatttaattacctcaaccctggaaagtaagtaaataaatcagtcccactttattgaaggtagagcagattgataaaaattgcccacacaatccagattgtcattggcagagctgggattgtaatatacatctgcttgacttttcttttccacagaggagtcttccaaaaggaggaggcttctgggtctttaaaaggttggatagaaattaggtgctttgtgggccagttggggaaaagattacccctggaggaagagtagcgtcaagaaatgtatcagacatttcaaaagaatcaaaaatctatattaaatttgtatagctgacaaaacctgatttacataaaggattttttttttttttttttttttgagccagagttttgttcttgttgcccaggctggagtgcaatggcgtgatcttggctcatcgcaacctctgccccctgggtttaagcgattctcctgccttagcctcccgagtagctgggattacaggcgtgtgccaccatgcctggctaattctgtgtttttagtaaagacagggttcttccatgttggtcaggctggtcttgaactcccaacttcaggtggtccgcccgccttggcctcccaaagagctgggattacaggcgtgagccactgcgcctggcccagcatatttttttaagcttcaaaccaccaacttaaaggtgtagaaatagtaagcataataccgccataaccagtttatctctttaccagtgctatcagttaacaaatcatgaacattgtgtattatgtatattacatgtagctttctgttctgacagcagagtttatgtgctagttctggattcgtcttaatagatgatttgaaaaagaaagcatttaaaaggattctctgtaaaaattctactcggctagtagcaaacttatcattttagaaaaaccgttttttactttgagaccagtaagatggagtgacaagaactcccaagccagaagctaaaagacgtgtttttattcctggtaatgccacataactggaattggcagttgccagtagtacgagaatttgcttaactttcaccagccaatgaagttatttgcttgctttcttacctcctattacagtggaagcaatgcttgtatcctattccttcctgctctctgaaggatgactgtgccccatcaataatccctttgcacatcttcagctactctgtgttcacatttaaacacttgtatcccttcctcttgaaaaaacaagaactcataaccacctatttagctttttatttcctgtgcacaactaaatttgtctgcttctttacttcctactcactgtactctcactgtccctctaaaatggctcttggccagtgtcaccaataatttctttctttttttttttttttttttttttttgagatggaatctggctctgttgcccaggctggagtgcagtggtgccatctcggctcactgcaagttccgcctcccaggttctcgccattctcctgcctcagcctccctgaggagctgggactacaggcgcccgccaccacgcctggctaattttttggtatttttagtagagatggggtttcaccgtgttagccaggatggtctcgatctcctgaccttgtgatctgcccgcctcggcctcccagagtctttctgtgtactttcactacacacacacacacacacacacacacacacacacacacacactaaacaattagccttgtccaatacatactgttttataacctatttttaaaaactgtattattaatattttttcatattatatgttcttctaaaacattttcagcagctgcatacagtccatcatatatatccatgtttaaccaattccctatcattaaatgttaactggctttcaaatgcttgctgtaataaatgatactgaagagatgtttatatataagggttttattacttctggctattaatgcaggatactttttaaggtagttttatttgtataatatatctagtttttctttcattgaaacaatgaaactttgctacaagaaaacttagtacttattgcaagtttgtatgtcagataacgtgctagatgccttgcagtcttacatttcatggtatttagctgttttaattcccaactttatagattaagaaatctatatgtatacatgtatttctcagtaagttaacaattatgtagaaaatgttcagcaaacatcaaagggctttgtgtaagaacatgttattcaggagccacaggggaaaatgaaaacttacagatgaagtttaaagttctgctttggctttggagtatgtaagaagatgacttttggggttttgtggtgttttaccttaaaaaggcgttttaggcctaaaaattatgttatttggcattcttatctctaggagaaaataagtgtatgaatttcttatgaatcttgggttttagtcatatggttactcttttagtttacaaactacattgtatctttgcattagaaggggtaataattatcttaatagttgaagatgatttcctttcacttaaaattccaggcataactttttcagatgttgcacttgtaagatctaagagttgaaagttgagtgatttaagggtgaaaaatgtctgttgcagagggaggctggtgggagcagtgagatgctgtgacttaatgcttttacagagctcgcttggcaccctttgattatgagcccacaagataagaattgtttttggaacctggtatttgtttcctaatgcagtggtttgttttgtcttagtcacatcgatcagacaacaacatggcaggaccccaggaaggccatgctgtcccagatgaacgtcacagcccccaccagtccaccagtgcagcagaatatgatgaactcggcttcaggtgagtgagacactgtaattacagcacatggagtaatgcttacgcattggtaaaagttgatgtggaaaatagtcattactcgtttacagaaactgggacatggtgatgtttattgtctctccagtttcatacagaagacatagtctattttaaaataacgtaagctatattattgccttgtatagttgttaacgcataagggggccgataactgaaagccagtggttctttaagatttggttctgaagcgggtatctcaaatttgtagttctgttaattttgacgtatttggttttattctgctgctttcttgtgtctcaggtatttgagttgaatttaccctcttccctttgtggtttggatggaaagccaagctatagtgttcttattttttattattattattttttttttcattttttttttttgctatggtgttcttaacccaacttttaatgtggtgttattcattctactctgaaaatatctggaaggcagtaacttttgtaaacccaaaagaatatttcttattcccagggcaagcatggattattaaacgcatcttcaccttttttactagaagataaacctgagtataaatctttttctacctcttatttggcaatttacttgaatatgcagtttttctcatctacataatggggagtaacagtgccccttatgatagaagggaagatatgaaaggaaataatacaatttatatgaagcctctagtaattacagagtaggtactaagtgaaagtttagccccttcatcttccttatcacatactgtctggcgtctttctcctttgttaggtgggttcaaggccacagttagcccattatgtacctttgtacatattaggaaaaggtgcccttcctctgggaagatgtaacattgtgcctggcatcagagattggagcatttgggctggatttctgaccactcccctggcccccacgctttaccccgctgctcagtgcccaggttcaggacacagatggcaacaatagtatgtggcagctctagtagacttgatggctttctccaccgcccatgcattttccctagataacaagcatatttagtagctacacagtagatttcttaaacagcagtctttggcaagggactgttgtggttgggtgggaagggtggtaccattagttgacaggagggttccttgactaggcgaattcacagaacttgaaatgtccttctgcccctcgtgctggaatgtttctgctgttacatacctctgctcttgcttttggtgggttgaacatttgagttctaaagagttaagagtggaaaacaaagaaaatggcaacatttgtgattgggcttttcttgacatagactttaaattctgaagaaaaattccttaaatctaaatttaactcattatactacgaatacattctcagaatctcttttatatgtgacacttaagtaaaaattttttttttttttttttattgagacggagtctcactctgtcacccaggctggagtgcaatggcatggtctcagctcactgcaacctctgcctcccaggttcaagtgattctcgcgcctcagcctcccgagctggtactacaggcgcctgcctccacacccagctaatttttgtatttgtagtagagacggggtttcactatgttggccaggctggtctcaaactcctgaccttgtgatctgcccaccttggcctcccaaagtgctgggataacaggcgtgagccaccatgcctggcccctaattaaaaaaattttaagacaaaaattgtacaaatattaatatttttacttggcaactattatgtttttttattaccaaattttcaaataaagttgtgaaatctgccctgtatttatggttaaacaagatgattcacattattcattttgtcatgctccatctaaaaattatctcggcagttaatgacagataacattaatttaaactttattttggaagagtaagtatttcgcgtctaacaaggttgattgtaattcttttagaacattgctttggttgtgtcctattatgttttctgatggtgatggtctagagaaatgagagtatttcggctgaaatttatgctttaagtcaaaggtatgtatcaacttggttttagtgggtttttttgttttttttcttttggatggagttttgctcttgtagcccaggctggagtgcaatggcacgatctcagctcaccacaacctccgcctccctggttcaagtgattctcttgcctcagcctcctgagtagctgggattataggaatgcgccaccacgcatggctaattttgtatttttagtagagaagggttttctccatgttggtcaggctggtcttgaactcccaacctcaggtgatccgcctgtcttcggcctcccaaagtgttgggattacaggcatgagccaccatgtccagccggttttagtgggtttgaaaataattgtggatgttttatttcagctgtatgtcctgggcaggtacagtggctcacacctataatttcagcactttgggagaccaaggtgggaggatcagttgagcccaggagtttgagacccgcctgggaaacatggtgaaaccttgtctctacaaaaaaaaaaaaatagtctgtcatggtggtgcataagtgaagtctcacccagttctcaggaggctgaggtgggaggatggcttgagcctgggaaattgaggctacagtgacctgtgattgcaccaccatactccagcctaggtgatagagtgggaccccatcttaacaacaacaacaaaaatttttgtcttgtttgtaaaatatgaaatgttttaatatattacataaaaattagtatgcatatacatgtctaaataatagagctatatgtagtaaagaggtgactttgacacagtttcagtggagtggcaaaaagcgtgactggagggttaggagtgagggggagaaggcataaaggagagggttgtgaggagagagttggaagaaggaactgaaatgagaaaagccacctctgaagaggcttgagcatgtttacagcgtgctagaaggtatttaacaataataatagtataataataattcttatttatataccaggcattcagtgaaggtccattttgcactgtctcatttaagatcccatgttcttcactgtatgttaaccagggataggataactgacagataggataactgacagagcgaagcctccgataaagcagaagcgacaaggaaccactaacgaacgtcctggaggcgctatttttaaatactattaatagtagataatattggggaactgcttctccagaaggtgatgggtgtggagatgatgtttgtttaaggaggccttgtttcaaataaaatactgttcactcaagagaagagaatattcaaagagagcactcgaggttattgccttttatggggacggtcagacagtatgatggggaagggaagagactagctgatgggtccaaaaccaaaggctttttaaaacatccgcaacacatcgattctaggagtcagtcaaaactttccaaattagagtgaagtgttatcttaaatatatatgaattcccagaatcagacaagtttatatctggattattctgaatttggtcatatggagacctgctgatcaagtgctgagggtactgataatatctttacagcacatgcctctttttcctctaaattacatacacttgtctgttgtcttttcttccatttcagtggaagcccatggttttgacatgttttggaatgaatgtcactgtaatcttgatatacctcatgttcacataaaatagccgtaacgtcatgttgacatgttaataaggtttcagtaagcaaaaggatgctcttctctacttggaaaaatgatcttttaaggagtttttaaaatgttagagacagtgaacaaggacaactgtgagagcatgtaagtaaattttgagggtatttaatgtaacaaagcagaaaatggcttccgtgaagcagggtatctacagaaaagtttcaccctgaagggagtgtcttctgagtctgctaacccgaagccttcacataaaagagaaagctacaccgtgcttttgaagcactctactgggttaatcatgctaaatgcaacttgatttacatttttattactcattatttaataaggacttcctcgctttgcttttttttgaaaaagaattcccatcattcataattgagtccagcttcatgttctgctctgagatcttgttcctcatccaactgctttccttaagatactgtaatttcctctagactccccaaacctgttttctgcataattttcatggttgactaggatgaaagatcttttaagattctttccaattcttaagattttatgaaactctattttgttttctaattggctttagcaaaaatgatcagtataattatgcttttataagtcctttttcaaaatatgaggttgaaatggtagatactacatatagcctagagaccagtggtttgtgattgggcaaatttccaaatatctataactgagaatcacccaaaacaaagatgcacctggaaaaggttctagaggcaacactcaatacatccttggaagaagattaatttatattctttaactgtgccatttaagtggcagggtaaatgacagcaagctttgtgaaagaatttgaaaggtgaagaagaggaaaatggaaaaataagaggaaatggaataatgtattaagataatggttgtactttactttatattaaaatattcaatgtataaatatatgtataaataagtctagtctattaaattacttgaggtgaatgtcctttgaaagttaaaatttatagctgggtgcagtggctcatgcctgtaatcccagaactttgggaggccaaggtgggtggatcatgaggtcaagagattgagaccaccctggccaacatggtgaaaccccgtctccactaaagatttaaaaattagctgagcattggtggtgcacgcctgtagtctcagtgactccggaggctgaggcaggagaatcacttgaacccaggaggcggaggttgcaatgagctgagattgtgccactgcactccagcctggtgacagagcaagactccatctcaaaaaaaaagtcataatttataaggctgggtgtggtcgttcatgcctataatccgagcactttgagaagccaaggtgggaggattgcttgagcctaggagttcaagaccagcctgggcaacatagggagaccccatctgtattaaaaataaaaataaaaattagccaggcatggtggccacacacctgtggtgctagcaacttgggtgactgagattggaaggatagcttgagcccacgaggtcaaggctgcagtgagccatatttgcaccactgcattccagcctggacaacagagtgagaccctgtctcaaaaaaaaagttataatataaattagttattatatataatagccttttgatgcctgcttaggatccgtagtttttctccccatattgagagttaggtaaacatttcatgatttttgtgttcagcattagaaaagaaagccctggggagtgaaaagtgatacttccttagctctatgtgtatgatatatattaaatttttaaatagtgtacttgttaacactgatccacaagattgctgaatcttcaagggacagtaaagtcaaagtatattctgtgataatccagaaataactgtatgacaaatgactaggatcaataaaagttatgtcttgatttatattaagcagaatcaacccatttatctgcttttgagaaatgtacatttgataacaacccaaagcctaaatgtcttattacaggtacattttagagaattcattatttatatgctttaaagttagaaattgttgggatttatttgacagttcccaactctaccaatgtagcactttcagatttctctattatgaaaaactgtgaggatttcctaggaaatacctcaagatgggtggagaaaatgccctcttgatcatgaaaggtgatacgtgttagaggaatgtgctaagcaccttccttgaagtggggaaaaatgttcagaagcaagcaaagtgagtagtatagagctgccttaaggtttgcctcttgtgttctcctgcctgcctgtgtaatatctctcagcactgaagatcaaatgagagattgttaccaagaaaaatgagagagctagaaaatagatgtgaaatataaaaatgatgggtaaattacacattgatttaggttttaactttaaaaagcacagagagggtaaagatgtgagaagttgcagaaccaacagggttgaggtgttggtaattcctgctttatgtgctgtaattcagaaactttaaagttttacttttcacctttgaaactgagagacagtttacattaagggttaagaccaagggctctggaaatcccatggacctgatttgaatcccaggcgtcatctattgtccatgaaatcttggacaagttactgtatctacctgtattcttcacttagaaaaatgagataataactcatagggctgttgtgagcattaaatgacagaatccatatcacatagttaaaatgtattattaatagtgtacagtgcctggtataaatgtgataaaataaatgtgatctgatattttagaatttaatcagtttgtaatacctggtagccactgttactttgttaaaaatctgttaccacactatctttgaagttatgtttatctctgtaggctttttatcatcaaattgaggtcattggctcttccaagtagttggttcctgattcttctaaaagttctggattattataagatggaaattgtcagtctgaagtcacaatatatgggaaaagactatactaacgggaaacctaatagcagtgaactataacaaagcccaaagtcagagcaatgaagagatagtgtatttgactagttactctcgggcttgtattccaaataccttttttaaaaacttttaaaataaaaacacttattttttttgaacaaaattgctgttttctttttcccatctagaagttcaggtaaattaagagaaatggccctataaaatggaaaaatagtataaggaaaagcataataatctggaatcaatatagccaatccttaagaagcttggtttgttttatatagcttgtggcttgatttatttgatgattaagttcctgaaaaatgataatatggaaacaaccaccatttttcttacttaaaactatggccaatccatttcattttaataaaatatgccaatatggaatatgatgacttaaattttttctttttgaaataaaaaaagtaattcagttataatatccagcttgcaaatggcattagcttgtaattattgtatctactctagtatgggagttcttctgaagtctttgttaaacccagtgatggctgataaaggcactttctaatcatcgctcttgacttagctgcataatgaagatgccactcgtgtcagggcaactaatggctttgattttactctgatggtgagagcctttcacttcgtctccactgggaatcactctgatgttgtttaattccagtcatgatttttacagtattaatttcttcattctttgtttaaagaaacccacattcattatgctgagatgtgggtatataattactttgtttttcagtagctgcagatcagtattttttttaatagtgccacatatttttaaaagattatttcagtttgagtatcatgattatccacagtaactatctaaatctcaaatgtgttgaggagtactgtgttttgtatgcttagttacatgcttgattattccagataaggtaattctttcctgtcctctttgctttactttagagattatcttctaaaaagggggaaacatatagaaactcaagactgttgagtgctcttgacctgatcttagagcacagatatcaaatattttaaaaaatttactagaagcctttgaagtaatcatttgggatagtaaagttcatttacattttgaatgttattaagattttaaggtaggccgggtgtggtggctcacacctataatcccagcactttggaaggccgaggtgggcacatcacctgaggtcaggagttcaagaccagcttggccaacatggtgaaaccccgtctctactaaaaatacaaaaattagccaggtatgatggtgggtgcctgtaatcccagctactcaggaggctgagacaggagaatcgtttgaactcgggaggcagaggttgcagagagctgagattgtaccactgcacttcagcctgggatacagccagactctgtctcaaaaaaaaaaaaaagaaaaaaaaaatttagatccatgagtatcatttctaccagctctcttaataaatgacttattacatattggggcataaaaatagaagtatttgtgttcaacttttcttcagtgattatttgtagatttttggaaactttgctcagctttggagtagagagaatgagaaagagattaaattatttccatttaagaaccagctcaaatgcctgttttattctcttgataagtgttggaatattatttttgtctttcccactgatttctaaatccttctggttactctattgctacaataattttatgactcataggaggaatatttgtgtgaaagattaagatgctaattctttaaaaatgatattcatagactaccatatatagtcagcataagtgaaacagaataaatcttgcaacagtactcacagttttccaaaataaggttttcttttgatgttagtaaggtaaggaagtggtaaaactttctttaggttaaaatcttaatgaaaggtattaatttgagcagtctgaagtctaagtgtgctatttgtttttccttcggcaaaactttacagaaagctaatctttaataaataaacttagtaaactaactctaagccatttcattgagttaaaatctaaaggacttaagtggcactgaagaaagtctgaagagttgcatattagtaggctcactgagcttgtacttgaccttttcttctagaaagttcttacagctataacctgacaaacaggaaaatgattttttaagcagtttcatagttttaccttgagataatagtatttttcccttcttaaatcattcattctacaaatatcaaatgccctgctttatactatgccctgtgattgcagaatcaagctaagacagactttttttatattaccataaaaaatgttatggcaggaccaggcgtggtggctcacacttgtaatcccagcactttgggaggccgaggcaggtggatcacctgaggttaggagttcgagaccagcttggccaacatggtgaaaccccgtctctactaaaaatacaaaaagttacctgggtgtttggtgccgtttgcctgtaatcccagctgcttgggaggctgacacaggagaattgcttgaacctgggaggcagaagttgcagtgagctgagattgtgtcactgtaccccagcctgggtgacaagagcagaacttcttctcaaaaaaaaataaaagaaaaagttgtggcagatgtatgcactgagtgctgagaaagtagagagagaggaacacatgagtcagtagtggaaaggaagaacagtgaagaattttttttttttttttttttttttttttggacacagggtgttgctccaccacccaggctggagtgcagtggcacgatcacagctcattgcagcttcaacttcacgggctcaagtgattctcatgcctcagcctcccaagtagctgggactacaggcatacggcaccatgcacagcgtttttttttttttttttttggtagagacaaaaggtgggcatggtagtgtatgcctatagtcccagctttttggcagcttttctggggattacatgtgtgagccaccacactctgccaagacttctttagggaggttcattgatttctttatccaaatattgaatacaaactatgtgccaggcatggttctaagttatgagaacggatatacaatgagtcagatattaaaagtggaagaaagaaaaatagaccagttatggtcagagtgataggctggggatggagggagatgatagcttagattaccttctccagtgcaggtctctgtaattgacgtcttttgagcagagatctgaatgaactgagagtgagagccatgtgaatatctggggaagggagagaatgcttcatgcataacacaacagcccgttcagaggccctgagacatgtttggggaacagcaaaaaggccactgcagcatgaacagagtctgtgaaaggcagaatggggctgcattacagtggtgcttgtaggttttgaacagaggagtgacatggtatcagtaactttttaaaaaatagggagattacttggagggcagttgcagtaacccagggagaggatgaccaaagtggtggtgatgaaagtgattgggttgaggacttgagtactagtggacgagtgggaagttaagttagaagaaaagggaagataaaagtagctagtagatgggcaattactaagccctggaacctctaataccatattgctagtggtaagatgatgagcaatgagactgaagaccacctcagaatggctttgtgtcataagctaagaagtttgagccttgtcctgaaaatgttgggataccattaaaaatcttctttaggggtcttctgctatggttttccctatttttattatctgatcatttgaattttgaaatccaaatatctcattttcttatatttaaagctacttccttaggtatagtatacatgaatttttaatgtttaatatatcattggaccaaaatggtagaactattctaagaaagagtagggaactgacatttaagcacctactgggagccatgacctgtgtcaaacacgtgttttaattctctcaatgatctattgagtgttcatctctgttttatagataaagaaagtgagcatcaagcaggtaaaggaatttgcccaaggttagaaggctaataaatattggatcgatccaagatttgagcccaggtctgtctgaatctaaaccctttatagtctctaaactatactgtctttctggagttgaatatgaaactaaagtcatatgaattttatttataatgtatcaaagattttttaatcaagtaagccactgaatagtacttttgctatattgttaaagtttgagttaatggtacctctagaaaaggttgaatcatacaagcggtccttgttagtctttggtattctagagtagtgcttcttaatttgtaatgtgtcaaggaattacctcgggatttgttcaaatgcagttcttattcagtgggtctgatttagtaggattgggacctgagattctgcatttctaacaattttctggtgatgctgatactgctggttaaaggagtgcacaaatagaatactgttgaatggcttaaacttaaatccatagaaatatccttagagatcattttagcattcctattttaggctggaatgaaacctttactgagtacctaaatacaaatgagtggttccatcatttcatgagctcttatttaatataaaaaccctgcaaaatatatgttacctactttttcttaaatctattatttacaggccgggtgtggtggctgatcacgccactcccagcactttgggaggccaacgcgggcagatcatgaggtcaacagatcgagaccatcctggccaacatggtgaaaccctgtctctactaaaatacaaaaatcagtaatcccagctactcgggaggctgagacaggagaatcgcttgaacccaggaggcagaagttgcagtgagctgagattgtgccgagattgcgccactgcactccagcctggtgacagagcgagactccatctcaaaaaaaaaaaaatctattatttgtaagggcacaaaacaagtctctgagagatggcaacttcacaaagaccgatcatacttttccacagataggctcttaatcatgtcagctcagcaaactttggttgtatttggtggcagtgctaagtcctagggatacaaagacaaaaaagtcagcgtctctacttcttgagtctgttgagaagagaaggatgcaggcaaatgattggggtacagggaggcatctgctataaagaggacatgaacatagtagttggggcaccagtatgctggtgcatagaatgcaggtaagtagtagtgccagaattccaatctaagccttcatatgtatggtccacagtttcatcttattctaccacactgcccattgtaatccagaaggggcttggattcatcagcgtgttctagtagtttggcagaagaatcttctaagtacctataggacatgggtgaacctgaactcaggatggggtgggcaggatggattagccaccaaccactctttgtttgcccaaagcttattttcatcagtatgtttatagtatcattagtttgggaggccaaggcgggcagatcacctgaggtcaggagtttgagaccagcctgaccaacatggtgaaaccccgtctctactaaaaatacaaaaattagccgggcatggtggtacacccctgtaatcccagctactcgggaggctgaggtgggagaattgcttgaacctgggaggtggaggctgcagtgagccaagatcgcgccactgcactccagcctgggtgacagagcgagacctcgtctcaaaaaaaaacttatttcttttaccaaaacttgatgtatagactgccttttcttcagtaaatgtttattttcccatattcggcttatcaaagccacaaaataagttagtgataataatatagtcatgtattgcttaatgactgggataagttctgagaaatgggttgctgggtgatttcataattgtataaatatcatagagtaggcttacacaaacctagatggtatagcctattatacacatagactcaatgatacagcttatcgctcttaggctacaaacctggacagcatgttaccgtactgaagactgtaggcagttgtaacacaatggtaagtatatgtgtatctaaatatatctaaacatagaagaggtaatgcattgcactataacattaccttatgacagccacgacatctctaggtgacaggaattttttagctctattataagtttctgggatcaccattctatatgtgatccatcattgactgaaatgtcattatgcagcaaatttgtatataactatttccattgcgtctgcctaaaaatcttagtagtgtgggcagaacttgattagggattgtttaaggcatatatggtcaagcatatgaatttcagatatttatgtttatggaagactcctttgtaaaaaaaaactgaagaagaatcagaggtgatacattttagttcctgtttattttgaaagccaaaagtctgcacaaattgcagaccaaagtatcacaaactactaacaaggcagtggtttctaataaatgttgctatctttgtcctgagcaaccttgcaaaactgtacattcccactcataaaaaatggagaactttttccctatagtctagggcagagtgataagtttttctcataattccacatagcttatagttaaactcagtgtagaagagtgatgaacacaaaacaatacatactgtattcaagaaatcagaacaggtgcaatttaaatttataggtggggaagagtcttactagtgggacagattggagaaaagcttcacaaagatatggcataagaatagagtagaattgggtcaggcacggtggctcacgcctgtaatcccagcactttgggaggcaatgtgggtggatcttgaggtcaggagtttgagaccagcctggccaacatggtgaaacctcatctctactaaaaataacaaaagttagccgggtgtggtggtgcacccctgtaatcccagctactcaggaggctgaggcaggagaatcacttgaacccaggaggcggaggttgcagtgagctgagatcacaccattgcactccaggctgggcaacagagtaagactccgtctcaaaaaaaaaaaaaaaaaaaaaaaaaaaaaaagagtagaatttcagtgggttgaaaacaatggaggctgggaggacacaggctttggggtggacatactgagaatgtagggaggtggaaagtgcatgacacttctgggtactggaaagacaggagtgaacaagccatgcggctgggaggactgaatgaattactaaagtgatagaatcatcttaccagagagaaagcagctgatgaagtaggagaagaaactatatgtagacaagttattaggaagaagtgacattcagagtgggaagggatgagagggagttagctaagcaaagaaggtagagagaagagttcctgcagggagcaactgcagttgtgaaggtcctggagctgggagaggagatgtttgaggaactgagagaagattgaatgaggagggatgtgaaatgatgtggaggaatagatagagcctggcatgttggatgctttcagtaccgaagcagtgctatataatgcctgactatagaggataacccactaaaaatttgagaattttcctttagggagctgagccttgagtcagaggacttcctccttagaggaggtgaggtaagatgatcatgtggctgtggtacatacaaagtttaatgttggagttgaataagaccaatttggaagttactgctaaaactttgtcatggaaatgtgaaagtttatgtgaaagtttcaaggtcaaaagatcgagaccagcctggccaacacagtgaaaccccatctttactaaatacaaaaattagctgggcgtggtggtgagggcctgtaatcccagctactcaggaggctgaggcaggagaatcgcttgaacccagcaggtggaggttgcagtgaaccaagattgcgccatggcactctagcctggcgacagagtgagactcggtctcaaaaaaaaaaaaaaaaaaaagtttatgtgaaagttttgagggacaaatggaaatggcattttgaagaaaccccactcaaaatatgggaacatatcttgtgaagtgtcaaatgtccagttggaggagaaagactagtattgaccctgtgagaggcattaaagatatgggagtcatttatgtgaatatggcaagccatgggatttcatgaaagttccaagaaaagaggattaaaaaaatatgattactgtttgtcataattgtggtgtagtattcaagagcatgatttctggagagctcaactgtcaaggtttgaatctcactctgccacttactaggttgggctgaatgatcctggacaagctaacttttctttgccttagattcctcatctgtaaagtgggtataataatagtacctccatcgtagggttgttaagtgacttaacatttgcttgcaaagaacttaggaaaagtgccgtgtacatagtaagaacagtttgtgaatcatcataaatacacgagaccagaatttcaaaacaagcagcaggcagaatgttcctttaaaaggtcattgaatgtacttttccagctactcttgttactttctaaggaaactacttgataatcctgtactttgtaggactcatcagggtgtgtttagtaaacttcagtgtcctaggtgacttctttattcccaaattgtggggcaggtgacaaggggaggttggtcctctaactcgtggtgtagttaatcaggattttcctgtttgaatagacatggcaaatggttttagttagtcattactaatgcaagagggtccttaggcaagagcaggaagttaatggtgagtcaccttcagtgttatgacatggagtatttctttttaaaatatcacagggagttggtttttgctatagtagctaagttgtcaatcaagtaatactagtagtaaatcttacataaaaactcgcttccctcaagtttaagtagttctaatttatgcattattttatatattgcctactactctctttttgcttatcctgaatcaaatttctcaccctctgtcaatctaattttgtgttgctataaaggaataactgaaactgagtaatttataaagaaaggtttaatttggctcacagttctgcaggctgtacaggaagcatggtgccagcgtctgcttctggtgaggacctcaggaagcttacaatcctagcaaaaggcaagtgggaaccagtgtgatacatggtgcaagaaagtgagtgggagaagtcccaggcttttaaacaaccagatctcaggtgaactgaatgagaactcacttatgaccaaggggatggtgcgaagccattcatgaggtaccccaccccccaccccgtgacccagtcaccccccaccaggccccacctccaactttgggaatcccatttcactatgaaatttggaggggacaaacatccaaaccatgtcaccctctttacgtctcattaaaatgctggcctgtttctctcttcctttttgctatagggcctacttttaatcttttcttcgaaagaagactttggtattggtggtcaggcatgatagcccagccttgaaaagcttccacatctttttcacgtctaagggcccagctttcgagtgtgtaaaagttatttggggtgaaaatgtgtattatccattctcaccaatctagaggttgtcatgagtttgggggattggaattactgtttaataatggtaatcccctttaagtatttactggttgaaataattaaagtttttctggtagattcttaaccataaaaacgaagcgaactgcttattctgccccatccacaggtagcagcctcttcatgcttgcccctgcctggaatgcccatgcccggaatgtcacatgtttggctaggagtgcatttaggtcagagcttacaggtcacttcctgcccttgatctgcttttctaaaaaactgtttcccatttttctttttctttcccatttttcatttttctttctttcatgcatgctgctttatttttgctgcacgtatcattagccaacattgtactgtcttctatctggaacataaattccatcagatagggactatgttgtttattgctccatctccagggcctgaatatagtaggaactcaataaatacttgttgagtaaaagtatttgctatatccctgtcccttcagtttaaatgatacataaaaataatgcagaaattgagcttacatagaaagaatgaaacaatattttgttttacaagcataaacaaaggattttaattacattcatttcagccaacatttattctattttttttttttttttttttgagatggagtctcgcatccgtcgtccaggctggagtgcaatggcacaatcttggctcactgcaacctccaactcccgggtacgagagattctcctgcctcagcctcccaagtagctgggactacaggtgtgcgccaccacacccggctaattttgtagttttagtagagatggggtttcaccatgtcaccatgttggccaggctggtctcgaactcctgacctcatgatcctccctccttggcctcctaatctatttctaattagtagatcctatactggacaaaaatggaaaatgcaaaatatatactcctgtgttcaggaatttcacagtctagccaggaagaaaacatgcataatgaaataatactgaatgagccaggcgtggtggctcacgcctgtaatcccagcactttgggaggccgaggcaggtggatcacaaggtcaggagatcgagaccatcctggctaacacagtgaaaccccgtctctactaaaagtacaaaaaattagccaggcatggtggcgggcgcctgtagtcccagctacttgggatgctgaggcaggagaatggcatgaacctgggaggtggagcttgcagtgagccgagatcatgccactgcactccagcctgggcgactgagcaagactccatctcaaaaaaaaaaaaaaaaaaaaagaagatcaaaacaaaaataataatactgaatgataaatgctatgacatagatataaagaaatttttttactagcacagagaaagaactcttcatctgtattgaggaagtgaaaagttctcaactaaaaatgtttcgaagctaaatggccagtagtaattctcggtcgggcatggtagctcgcacctgtaatcccaccactttgggaggtcgaggtgggaggatctcttgagctcaggatttcgagaccagcctgggcaacataatgagaccccatctctacagaaaaatttaaaaaatagctgagcgtggtggtgtgcacctgtagtcctagctccccaggaagctgaggcaggaggtcacttgagcccaggagtccaaggctgcagtgagccgggattgcaccactgcactccatcctgggtgacagaatgagaccctgcctcaaaaaaataaaataataggccaggctcggtggctcacgcctgtaatcccagcactttgggaggttgaggtgggcggatcacgaggtcaggagatcgcgacaatcctggctaacacggtgaaaccccgtctctactaaaaatacaaaaaaattagccgagcgtggtggtgggcccctgtagtcccagctacttgggaggctgaggcaggagaatggcgtgaacccgggaggcggagcttgcagtgagccgagattgcgccactgcactccagcctgggtggcagagcgagactccgtctcaaaaataaataaataaataaataaaataaaataataactcctatgggtcacatccattctttttacttcctgccacctactccttatttctatctggtcattaaggacaaatgtgaaatgaattttggagacggagaaagactctctcaaaataaataaataaaatttaaaaaaaaacgtactgcccttgtggtgcctgttttgtcatggtagatttgcctaatcctagcagacgtgactgtgtactattcccagacctgcatagattgatctccaaactgcctaaaatgaatagatgtggttgtgtataactcagataaatttgagaaatacttctgtactagctgaagaattctaagtggttgtgttttgtttgtttttgttgttgttttttgagacggagtctcaccctgttgcccaggctggagtgcagtggcgtgatctggctcactgcaacctccacctcccagattcaagtgattctcctgcctcagtctcctgagtagctgggattacaggccctcaccaccacacccggctaattttttgtatttttagtagagacggggtttcaccatgttagtcaggctggcctcaaactcctgacctcgtgatcccctgcctcagcctcccaaagtgctgggattacaggcgtgagccaccatgcctggccctaagtggttgttttaaatcagtggttccttagaccggcatcagcaccacctgggaattttcaggcctgctgaatcaaaaagtataggggtaaggctcagcaacatgtgttttaacaaaccttccaggtgattctgatgaatatttatagcacattataatcagaatataaattgaacataaaggcatcctaaattgattttgatcgagccactgtggtctcctcttacatttatttttgtggtaatcctacatttccccccttggacttaaccttcctgcatcctaaccctagcccaaacagatgattgaaacacattttcactaagtgtaatttgtttcactttcagaaaacatatcactttttgctttctctccttttcatggttattcaacagttagtttaagagaatgacttggaatcctgcattgagaatcaagtcactgaatttcttctaaggaccactggactaaaaattctttttttgtgaataaagcctttatctgtattgttccattaacactggaagaattgtttcttttcagttttctctatcttaattctatgacaaagatagtgtggtgaaaagttatttaaaggtgatcttttctaatctattccttgcctttggtgcgcagctttctttcagtacaaagaaagtatcctattttgggccatctctttccatataacattatattttacccagagagtattaaatgaaagataaaatgaatataaagtattattttgtatttggtatatatgtgttggtataaatgttaattgcaaataatataggttctacatgattttaagcttacagaaagttcaaagtattacttaaaaggcaagacattgattcttccatcaaacatttattgagcagctattcaggtattagcctacaagcttgtaaagaagaatgacttgatcattgccaggagaacagatatgtaatcaagtaattacaattctacctgttaaatgtgcatggagaatggaagaggaaactaatttctgtctgaggtagtatggaaaggctgaattaaagaagtgacatctgagctgtctcttgcaggatgactaagagtttaggaggtaggggatgcagagtatttgtgataatgggaacggcatatacaaggagatggcatgattttatggaaagttggtgggaaaactgggtatctgaagaagacttcagaaatgaatccagctagtaaagaatttaggcattttcctcttgatggagagcaataggaatgttctttagtaagaatgaatgacatgtttaaaagatgaatcgaaaatattttaagaagagaaacccctggtgactgatagaggaccttggagtgagaagagatgacaagccagttactgaggaagtggtcaaaaaagagagctggtaagtattgatggctgagttctctgagatggactgtggcagacccatcggagagaatataagtggaatttacaaaatgaagtgagtggagcaggtagggaaggttggtttgtatcctaggtatctcttgtggctctcattcagacagctaaggtggggaataatgctgtttctgtgtgtgtgtgtgtgtgtgtgtgtgtgtgtgtgtgtttaaaccacatatatgaaacccatatattcaagcaggcttgaaagctacaatgagggccgggcgcggtggctcacgcctgtaatcccagcactttgggaggccgaggcgggcggatcacgaggtcaggagatcgagaccatcccggctaaaatggtgaaaccccgtctctactaaaaatacaaaaaaattagccgggcgtagtggcgggcgcctgtagtcccagctacttgggaggcggaggcaggagaatggcgtgaacccgggaggcggagcttgcagtgagccgagatcccgccactgcactccagcctgggcgacagagcgagactccgtctcaaaaaaaaaaaaaaaaaaagaaagctacaatgagatcttggggttgttgagttgaggctcccaaaggcattcagtgattgctattgacttgttcatcaccatgtatagtcacatggtattttcagtgcctaaaaattttaaatacagttagttgttttgcaaaagctttttataattcagccattttacagttaaagatagtagcaaaccattaatattcagttttggagttctgtctttctggggaggaaatagagcccaaaatgacagtgaaagctggtgagaaaaggtttgatatacatgtgataaacaggtttgcttctcattcagcctctggtaaacttgggatgtgtacaacaaattctacctctggacttggttagtagtgtgtactacacatccaggactgaaggggagccttcctaaggattctaggcatggagaaaactaattccacacgtctgcatttcctaacaggattttaccccatcaaagtagacctttgaaaatgcagctgcaaattgatctgttcctaatacgaatgaaactggcctaaaaataggactttgggtcccatgggccttgtgtgagtggtcagtttaaccaaagttacttattcagcatcacccatgagactggtgtggactgccaatacaggaagaagggaattgttctatttgtgcataggagggatacttaggctctggtcatctgtgggagatgagtgaaaagaagtatagttgtgaagagcagtcagtgggttaggaatcacgctgcctggctttgagtaccattcctggtactaactagctttgggatcttgtaccagactgatcaacctggcactttgtgcctcagtttcctcattagaataagtagtactactgcttatgtcatttgtttactgtaagaattaaatgaattaatgtacataatatataagaacaatgactagcacaagataagtgttcaattcatgttagtccacagaagaaaagattttagccatgtactgaccatcccagtttgtatctcctgccctgcctcttttgattcctgttggaaatgggaactgggggagttgggagggacaaggaaatcaggaagaattatgtttgaatactttagttatttattctgggcctctcttttcattgctgttacctcccaagagcaattgtcttgacttctctattcctataaagataggaaaatccttttagagttaactgtattctttagtcctatctctcaaatgatgttccttaaagtttgccttccaacaactttagcacttatcttgcctcctcccaagcctccaacaagcttaaacttcaaattgcaaccccaacccattagcaatttctggtctgctgaaaaataagctttgtttggactgtagctttctgtcttacagttttcttggtgtgagccactcacataaaacatggaaataaatagagcttggctgtcttagctaaaatgtgctttatattaaatagaatgtttatgatattttcaacgttctaaaaatacttgcatgtatttcttattaatgaaccttggtgttcctaggaaggtattgtcacaaaactgattggattgggtggtagtttctgagctgcaagctcttccgtgtcttatgttaacagtaatagtaattatttgggccatgacttccaaaaggattttttggaaaaaaattttttttcttcatctctgtgttgaggaatattcattttattatttggtggtttctttttagtggagaagaagcaggtatataggtttacctttcttctctgaacacagccttaaatatgtttcaatgaattgttttatgttaagatgtgttttctttttaaattagtaccccctcccacttttttttaggtgcaccaaataaaaaccatgatttttttttttttttctgtattataggtcctcttcctgatggatgggaacaagccatgactcaggatggagaaatttactatataaaccataagaacaagaccacctcttggctagacccaaggcttgaccctcgttttggtaaaggttcatctcaaaacctttttagatgcttttggttgctaattttttttgtaaatatacttcggaaagcacatttaaataaaatcgcattgctttatagtattaaaaaatgaccctgcccacccaatgtttaccagtagtgtttttatccttctcattgtaaacttgagaaatttagatctgaatcagatttttagggctcctcaggttggggtgggggaatgtcataatggccgactaaccagaatcacttgttcctttcacattttgggagaaacacagtgattgtttttaaaatgttttttttttttagctgcaataataatcaggctgtcatgcaacacctcagaccaggagtaccagcttttgtcagtgacctgatgtctgcttgtgcttaggttctgagagtgatgagtaccatcttatgcctgggtgttgtagtgtttcccatcctaaggaggaacatgtcaccccagaaatggcccagtgaaagcattttgccccctcttctgtctctctcgaaaaataaatgtttttttttcttcattcagaaaacaaagaaagccatattcccctccagatctcatgaataaatcacatttgcacaaaggaacccctccccttccaaatgtgtacattttgataagggtgtaaccagttcttcagtgctttttaaaaaatgtgtgtgtgtgtgtgtgtgtgtgtgtgtgtgttttaaactgttttcagtttttcatttgggtttctgagatatttttccaaggccatggaatatgcatctaaaaaagagcagataattgtggttttgaagcttcatcttggactagatgcagctaaatgaaaacaatgtgcagatcactgaataggtcagactgaggggactcggaacctttgaagctttacagggtttgacctaacaacaactgcggggccctcacgggaaagaggaattaactctgtgaatgccatgaaaacacaaccctgcggggggaaaaaagaaaaaactgtatctggagctggttggataaaataacttctccatcgggaatattatgagcagttattttgtgtcttatatatacctttaaaaaaataaattcaagtttgccccaaactgactgaaccccctgttcaagttaagtcaatggcaggatcagggcagtgatgtcattttgacagataaccggtttggcttaaatactgtccttttaagcttcaagacctgtttgggtgttaaaaaaagtaatgaggtatgttaataatttgcaacttcagattctgtttactatttgaattagcccttgtgattggaacaggaaaccaagtaagatagagaatttaataaatgcggccaattgtttggactggaacaataacagccatgtttccttaaattatctctaatgaaatgaatgaattcagtttctccacattttggaaattctgaagaatggtgttgcggaatttttttccctgacataaggttatgaaagatgatgacgaacgctttaccaactgcagagatcaggaagaacaaagctttttaaagaaaaaaattttttcctttaaaacagtgaaataaaacaacttttctgtaagcttaagtagactattgattacacacacagcttggtcttttgttttaagaggaggaggtactttaaaaaaacactaccaccctccagcacgttatgtacacacaggcatacagttagatgtgcccagaaaaagtttcataaaattctcttattgcatttagtttccctttttgggcccaccgtgtgtgtattccagacaggcttgacaatatgccagagctttttattttgtggcccgacttttaatctgttccagaccttttcactcagagagctcaagtgtaactgaaggggggcaggaaagaaaaaaacgtgtgggtttctctgatctagagtgacagcaaatagagacaagctgttagctgctggatttgaagttttccttgaaatcagaagttctgcatagtggattatgttttatctctgccaaagaaatataaactatccccttgtttctgaccctttgggccatacaaacacaaacaaatggtgtaggatattgctttcatgattgtggagtttgcttttcgatattcttcaaatctatattaaaatatttatcaatttttggcttaagtcaagtagatgtgtgtctttcagtgtcttagaatgggagctaagcccctagagaagcttaattttagctccttcaaacaaccccttttatatgtttatttatcagatgctttcagattaattatagttagaatatagccatttgctttaagattaaacatatttagtaattacacttcatttgctgcataataacgtttcagtcagcggcagaccacatatacagtcgtggtcctatatgattctaatactgtgtttttactgtaacttttctatgtttagatacacaaatactacccgttgtgctacagttgcctacagtgttcagcacactaacaggctgtacagttctgtagcttggggcgataggctataccttacagcctaggcatgtagtaggctataccatctaggtttgtgtaagtactctctaagatgtttgcacagtgacagaattgccaatgatccatttcacaaagcatatcctggttattaagtgacacatgactatatttatagtatcaatccttcacatctcacatgaaattaatgttatttatgtaattttagggaataaaagagtaatttgttgtggattgggttttttaatgatttttttctttaacatttaaaagctatttctttaatattttaattttagagaattcattagtaatttataacaaatcatgaagtgacatcagatggcaataaggatgccctgatgtttattgagttttaagaaaaatagggctttttttgtttgtttttttaaggagtcatattaggagtgtttttactctttgttcaagaaaatggttccttgagtattatgcaagccattaaattatttcatataaacacataggaggtgattttttttccctggagattttgtactggcaaacatgagtctcaggtttaaacatcaccttgtatgttgtagatctattactgtatataatacagtcatggacattttccagtaaaaggcctaatgaaaacacaatgaaattataattgctgttcagaatgaaaaaagatctttaaaacactaatagttgataaactgatctttaatgttattttcgctattgtttatattataaaaagatgtattaaaatattgttaccaatctgtgttttaggaaataagtgctgatggcaccactgggataaaaatatttggtgtaaacaaaatattggagcaagagatttggggaaaaaattatacttctgaattttaaagcaagtaatgaacagtccagagtgacaaaaacagaatatttaattcctaactacagttctgtgcacagaaattctatgtgtagaaatgtcagaggtattaaacctcataggttgattttggttcctttgtttcagtttcccaaaacttgctttctgtgcatttacatacacgtgtgtatgtgttactataatgtcttgaaataagaaataaaaggataagtaaaatacaaatacctatatgcaatttattaaaataagactaaagccgaaggttgttgagacttctttttcatcagagttaaatatttggcattaataattaaatatctataaaaattttgagacattcattaacattttttcttttttaagccaaatatttctgttgttaaaaataatattttccttttgatgaaaatgcacctaacaaccaactaaataactaagaatccatcctattagtgttgggggaaaaccactgaagtctctagaaaccaaattggtaactttattaatggagtcttgagcaaagagaatgtcagcatctaattatttaaattttatcaaagcaagtctcttgatagctgtatgctaaaagtgaggttttttttgttctgttttgttttgttttgaggtttgaggctttttttccccttatcaactcaagtctttcctggttatcctgggctgtcagtatttggttatggactacattaattacttagcgtacagaggaaaagatgtgtgttttagataaaaagagctattgcgagctaaaaattattaacagatggccaggtgcggtggctcatgcctgtaatcccagcactttgggaggtcaaggtggatggatcacttgaggccaggagttcctgaccagcctggccaacatagtgaaaccccatctctactaaaaatagaaaaaaatagctgggagtggtggtgcacgcttgtagtcactcaggaggctgaggcatgagaatcacttgaatccaggcggcagaggttgcagtgagtgaatatcatgccactctactccagcctgggcaacagagactctgtctcaaaaaattaagaataaaaataaaaattagtaacaggctggatgcagtggctcacgcctgtaatcccagcactttgggaggccctggtgggcagatcactttaggtaaggagttcaagaccagcctggccaacatggtcaaaccccgtctactaaaaatgcaaaaattagccaggtgtgatggcacacgcctataatcccagctgcttgggaggctgaggcactgagaatcacttgaacccggtaggcagaggttgcagtgagctaagatggtgcactgcattctagcctgggagacagagcgaaactccatctcaaaagccgaggctgatggatcatgaggttagagatcaagaccatcctggccaacatggtgacaccccatctctgctaaaaatacaaaaattagctgggctggtggcacgcacctatagtcccaactactcaggaggctgaggcaggagaatcgcttgaacctgggaggcagaggttgcagtgagcccaagatcgcaccactgcactccagcctgggcaacagagcgagactccatctcaaaaaaaaaaaaaattattaactgataaaactcacaaaatttggccctcataatgagtcctctaatcatcattttttcagtggggagaatgctactcttctgatcactgcagaacattcaacatccctggcccgctaagtgccatagcaccacacagccattacgattcctcggaccaccaacacttttttttttttttttaaatgctgggagagttagggaatatggtctaaaatctgagcccctctgagatcagggaaattatacccaaggttatatagttaaatggcaaaactgaaatttgaatttgatcttttgatacctagaatttaaaagaaatttagattcaatgcagttaatctttcagaaatacctactaatgctgatacatgaaaatttgagagggagaaaaatagtggttaatgcacttgcatcttgtattgtgactcatcttgaataagttacccaaagataatgagtttttctttttttcttttcttcctttattgtttctttcttttttggagagagggtctcactctcatcgcccaggctagagtgcagcatggctcaatctcagttcactgcagccttaattcctgggctcatacaagcctcccgcctgtagctgggactacaggcatgtgccaccataccctgctaatttttttgtgtttttagtagacatggggttttgccgtgttgcccaggctggtctcaaacccctggggctcaagcagtctacctgcctctacctcccaaagtgctgagtttacaggtgtgagccatagggcctggccaagtttctaattacgtaagagaatttaagatctctgattggaacagactttaaaggcatctagttgaattatttacccaattcttgcctcaccgatctcagctttgacctttccctttactagtttacttcattatagtgtagcccattctacttaaggaaaattctaatgaccacaaagtttatatttcttgattacccaaaaatttacttcctttcacatgtgtgaatacagctctaatcccagcagtgttctcttctaactgtggtttctctggtttttcatgtgttcagagttctctgttctttatcaatttactcacttctctggatgtccttcattttgctagtgcttctttaagtgttatattctatagtgtttcatatgtacattatcctgtgagaaaaatagttatgtcattgctctgacctgtcattttcaatctcctccaaaaatctttcttcaatctgcagtagaggctagcatctcttttccacatgatagttacaacaatgtacttgattcaactgaattaaattgggatgtagaaaaatttaccttctcagttggaaatcaagagacccaagttctgctatcacaatataaccaactggatcagaaagatacctaacttctcttgactcatctgtaaaatgtgactggattagactggatgctcttaagaatatttccactctttaactgaatacaatatgctcagtaactgctttggactcttgcttaaggttacttctcaatagcctttttgatttgagtgcattgaggtttcagagatacttttgaactatttattgcaccatttaagtttaactttggtcctctggtcacagtgtggaattacttttgaagaggagacagggaaatcttccagcctttaatctaaagataagccttatcacatggtgagtatgtccaggcaaacaaatctgatggggggtgtgggaagtgctgggctgaatagttaagctttgtccacactctcaaactcttggaagcatatgggagtttaaacatgttcatgttagcaaagttcagctttattgccttaaagatgatgccttgttggtacactttgtttctaaaatttaaaactcccataaagttgccatgacagaaagtctaatgtaagcagatttgaagcctagttccaggccatgtgcttagcaaaacctgatttaagacataccaatagagattgttagtaattattgctctcactacattttctttttccttcaaaagcaagcatttgcttaaatgaatattttaatacataagattatagaatagatttcaaaattagttccacacttgagctctgcagtttttaaaattttatgttaaattcagtaggatatattctaaaaagtaaacaactttagttgtattcctctgtccagtatgtctcaactatgttttgtgaaatttcgctgttcctttttaaaatgttttattttttatctaaaaataaatactttggttagctagggaaaatatccagtaaggtagttccaaaatagtttatcagttatggtaagcaatctctcctgtactaaccaaggctgagtagacatatgttacggaggataaactaataggtaatttctacttgatcagtatttcattgatgcaattagttaattatacagtgaagaaacatttttatctttctttacataatgagtacattgttcatacaggattttttaaacatgaaagtttaagaccagcaacgtcaattagatgatagtttaaactaatgccttattcgtgttactaaagccgctatcaaacacacttaaaaagaccttacatagttttttgggggtttttttttgtttgatttttgtttttttttttttgagacggagtctcgctctgtcgcccaggctggagtgcagtggcgcaatcttggctcactgcaacctccgcctcccgagtagctgggactacaggtgcctgccaccgtgcccggctaattttttgtattttagtagagacagggtttcaccatgttagccaggatggtctcgatctcctgaactcgtgatccgcccacctcggcctcccgaagtgctgggattacaggcgtgagccaccgtgccaagccttttacatagttttttaaaaggaaactttttcaagttatatttgtattaactctgtattaacagcaaacatcttatatgctggaaaagaggaaccatttggtgttgcttgctactttttgtaccaacccaaagattcagatgtaagaaaaagaaagagattatagaattattggaaaggtcaaatttctgttgaaagtaattggtgtgatttagaaggagagtggttcagattctgttttgttttgttttatactcattttgttctgctaccctagttgctaaggtcattttagaactcattctggacttgcttcaacttggagattctcctgtgcattactaatagcatcctcctaactagggagagaaactattttaggatttatttatttatgcaacaaaagtttgggtgccagttacatgccaggcactatgctagccatgggttgggaggaacaagctactaaacaagtaaataaatcattacaaatgtattaagtatggtaaaaggtactaaacaatgtggggtgaaaggaactagggtggtgggaacctgcttgcacctgggtggtcaagggaggtttttcaaaaaggcacataggaagccaccagtcaaatttcagaccagtttttgtgtttttcagtaaaaactctgaggtatgcatcacttctaaattataaattatcctctgtgaaagagctttactagtaataaatgaaattagaaataaagtgttataattgacctgtttattcattaatctaacatgaattaatagtgacaagtatattttaaaagataatgcccctttatttttttaatttttagttttttagagacggtgtatctctgtgttgctcagtctggtcttgaactcctgtcctgaagcagtcctcctgcctcagcctcccaagtagctggtattacaggtgcaaatcaccatgtctggctgcttctctacagtctcattatctgaactttctttcctaactagaccttaaagtttattttcatagtggggaaaaacatctagctgtgctctggggacaaagagagctgaaagctaattagaacacgttctcccttttctgcctcacctcatttagcaacccttgtgtcctgccctaaactgcttgatgaggtgatgaggagaaaatgttctgctggatttctttttgttttcttttagctccattcatgattgtattgtttgaaaaataacattataatgaatttttatggttggaggagggggaagttgaattgactaaagtattgatatttgttaccagtatttttgaacagctaaagatgtgaaaactttaatccagtttggggaggctgggagttggtgctggggaaaaggtttggctgtgtccccacccaaatctcatcttgaattgtagctcccattatccccacatgttgtgggagggaccaggtgggaataattgaatcatgggggcaatttctcccatcctgttctcagatagtgagtgctcgcaagatcttatggttttataaggggcttcccccttccctgagcactgattcttctctctcctgctgccatgtgaaggagtacatgtttgcttccccttttgcaatgattgtaagttttctgagacctccccagccatgctgaactgtaaatctgttaaacctcttttctttataaattacccagtcttgggtatgtctttattaacagcgcaagaacaaactaatacagtaaattggtaccagaagtggggaaagaagtgcagagtgtgggatggagaggttacttagcctgtgacaaaacctagagtaggatgttagagcaggtgaactgtccccacatattgatcattagagaaatgcaaaccaaaaccacaatgagataacacttaactcccattaggatggctaaagttttttttgaaaagataacaaatgttgtccagaatgtggagaaattggaatcctcatacattgctgttgggattgaaaaatgatgtaaccactttggaaaatagaatgacagttcctcaaaacattaaccataacattcccatatgaccgagcaattccattcctcggtatagaggctaaagaattgggaacgtatgtctccacgttgtgggaacgtatgtctccacaaaaacctgtacccaggtttacagcagtattattttataataaatagccaaaaagtgaaaataacccaaatgtccattagttgatgaatgggctaacaaaatgtggtatattcatataatggaatattatttggcaattaaagggaatgcagtgcttgatacatattaaaacatgaataaatctggaaaacattataaatgagaatagccaggcacaaaaggccatatattgcttaattccatttttagaaatgtccagaatgggaaaattcatagagacagaagtagattagtggttgccagggactgggaggaagggcagtaggtagtgaactgctaatggatacagggcttttttgtttgtttttgtttttgtgactttttttttttttttttgaagtgatgaaaatgttctgaaattagatcgtggcaatgggtgtacaattctgtgaatttgtaagaactaccagacagtacatgtaacaagggtgaattatcccagtaaagagaaaaaattatttctaggcatgatgtcatttaggtatatagtgtattgagaaataccttttgtatattgatcataaaaagatgtattcagtcattaggttaggacactcgtcttttccttttcttttgtaaaagatagcttttcagtgtgaattaaaataagcaatttttactgaaaaactacattttatgtttaagtagataaattattatgccactttatagcgactctctattgatgattcagtccccttaggtcatgcagtaaacacttagagccaggagtgagtgttttgtgttttgtttttactgctttaagacccacagatggcctattagtttgtgtttttagaagaacattaatttcttttaaaaagtctactgttttgtagttttgagtacactcgtaggtatgaggaaaacccaaatatttcttctaaatgttttgaacaagttaatatagctatgctaatatggaaatattcagtgtctgagatttgaaaaaatactagacaaaagcttttgttgtgggagatttgatgtaatgttttaatagcttaagaatcgtttattattgtaaatgtatacccagtaagattactagaattaaatttattattccaaagtttatgactaacagatctgtaatacattgttataatccaagttttgaggttacaaatcatgtaaatttttagacaatctaaaaattgtctgaagtttggaaattcacatgtttagaatgaaacttggggaaaaaaaacctatggtgatgacccctttcttttatttttgagaaagtagtcccttatttttcagtaattgctcagtcattggttttctaccataaagctgtcagggctgatttgttaagcaaaacttgaaacagttactatttcgtagtgcaagaagcacagactctaaattttaaaatattgcataatttttaaaattctgacattttgtggggtttttgttttgtttttaccttttggaaattttattaaaactggaaacattgggatttcaatagttgatagccagaggaagaagttggtaatgctattcttttcttttcttgctgccctgccccctttccccaggaaacaaagccggttttgtttcttgcctgcttgtgaggtctctgctgcaccccatgtgggtgcaccgctctgtgctttgttgaaagacttaagatactcagaaggtaaagaacaggatgcttctggagaggaataaatcccagcttcagtagataaacaaggttgtttgaattggtcatttaagtgagttctttctatggaaaccttgtagtgctgcttgtatccataggtaacaacatttaggtaaagccaaaagtactcacaatagtcatcagagtatttctcttacataattttgtgcaagtttctgtttaattctgtggactggttcttccttcatcttttgatatcctaactaatttttcctgttccgtggttttgaatagtcagataagcttagatttgaaaaagaccttaccaaccaattcagtttgttgtcagcattggctattgtcattaatgattactgcttttggtatctaattctgggaaactggtgagaagcaaaggatatttaccactttatttttgtgtaattttattgctattcagtgtttttcaccaagaatgtatgttatttcataaataacttaatgttatgttacataatgaaaatataatggggaaagctcaaaagcttatccaaatgtttcttaatagatgaagtatttaacagtgtatatagctctagaatctgttttgaaatcaatcatgttttataattccaacactcctcagcttactaatgggctattttctagcaggtttttggtgttttgcttttttattgcttggaaccaaaaacacttttccccaatagttgtttgccttgggcctcaatttacgacatgttcattgtatgtgatgaatctcagatcagttccccaattcatatttaactcatgctatcaaacctggcacagcacactgtataaaatgtttctgtgtggaaatatgttgagtgttgtattgaaacaccgagaagatgtttcaccgaaagagaaggatcctcttatatcgttggctcaatctccactaccttttttctatttagaccttgtaggaaagagaaacatgcatatttttgtaaatcataggaatatttggaaacagtaaatggtatgataaaataggaggagggagagagagaatgtatgtgtatgtctatgtgtttgtggaggagaaggagagaggtataggaatcatcaaaatatggaattcgtctgtaggagtcagagtctttaggtttagaaagaagttctgcagaagagagaggactaaggtttatggagcacccactattccaggtgtgtgagagaataatcagtcctcataataactcaaatggagatgtcagtattgatggtacggatgagaaaaccaaggattaagtgaattaccaaattagtatgcccaactctaatccaagttcatttgactctaaaggctgtgttttttatgatacctgtcaattatgtaactatgtttgttggtaacagataagagcaattttattacatgaggttgttggtgcctggcaaatcttaggtcccaaaaattgttggcttttttcgtatccattgccctataaaataataaactataacctataaggatgaaagttttagccatttactttttataaagccatttcataagtcttcgtgagttaataaatatgttttttttccatatgagattaataaggctttgaacaagctggagcagtatgtcatgttttgacatcccttctctcttcttccagacaaaatattaaaacaagataaccaaaaagacacaactagggtaggaattttttaaaaatctctataggtcagaaaataaaaccacatgaagcattgagggtagtgctagaggcctgccagttttaggggccatttggctcctgagaagaactgttaataaaagtattaataaggaagaggacacacaaaacacgctcaatgggaaaagccaggcgtgcagctgacctggccctggcctaggacaatgtttacaaggattgaccactgtcaagtcacagagtcacaaattgtctagaatcaatattatgtagactatgttttttaaacctcaatgcaactaaatttaaacttataataaaaaagttagtttcaaaaaacatgtcttgccctaccagctattaaaacatactactaaagttgtacttttgtacatattgtacatactaaataatgtttatatacacatatatacatgtatataacttacacgtttacatagtataaacataaaggcagtactgccgtactagtataagaatagttagattaataaaataaaaaatctggaaataacaaaatgtcagaatttattctatgataaagatgaggggaaagatacacagttagcatatggaagaagataaaattagatccattcatcccatacaacagaaaaaattgcagtggatcagatttgagttgccaagtaaatgagaactatagttttttaattaaaatgggtgaatttctctgtagtttgaaagtgaggaaatgtaattcagatttttaaaaagattgacaaatttgagtaaagaataagctttttttttttttttttagacaagagtcttgcactttttgcccaggctggagtgcaatgatgcaatctcagcgtgctgcaacctctgccccccgtgttcaagtgattatcgtgcctcagcctctggagtagctggcattacaggtgcctgccaccacgcccagctaatttttatatttttagtagagatagggtttcaccattttggtcaggctggtctcaaacttctgacctctagtgatccgtctgccttggcctcccaaagtgctgggattacaggcatgagccaccatgcctggctaagaataagttcttatgaaaaacaagcaaaaagatgacaatctgaggaaaattattggtaacttatatcacagacacagatttcttatccttagtgtatagattgtataataagacatagcaaaaataaaatcatactgagatactactcatctttcagatgggcagaaacccaaaattggcaagtccttgggggcaaaaaagcactcttacattactagtgaggatacatcaaagtacaactcctggggtggggcggtggtgtaaatttggcgatatctagcaaaattatttatgctttcaacattcaactaagcaatctcccgtatagacatctacccaaagatatagtagcagaaatacaaaattatgtatgagcatattctgtacagtactctttactaataatgaaaacctaataggaaattggttgaatagaatattaaccagctatgtcaataggaaaatgagggaaaatctctatatactgctttagagttatctcaggatatattgttacaaaggcaaaagcaaagtggaaggaagtatgcatagtatgctaccatatatcaaagaagaagggatgtgtgatgtgtatgtgtttgcttacatttttaagggtagaataaaggaaatactgatacagtttacctgttacctattggaggtaggaggaagcgggtgggaaataaagcaaatctctgaaattcaaagacagaatgtcataagtacacctgtatttcaggtggttggctaattatagaagaataatttcaggtgactttaaagcacagtgattttactttatgtacttaatggaatatcttaaggagataaaattgcaaagaaatctgaaacttgaatcattttagtgatcataatgttatttttagatgattgcgtatgtatagaggacaatacatattaatgttgttagaacccagtttttcagcatgagaaaaaacagttgttacaaaatcaaagtaaaaaccatgcatcctaaatctgaattggaaatatgcattttctgaaggagagtaccacctagaaacagttacaaaaaagcaacagaataataataggtaccccctagtacgcagagtaatgtctctaaataccatttcccactcaaagaaatcagggcttcttcaaaaaaggctgagtaaaatttggggcagggaatatactagatgaccttggaacatctttttgtgcctaaaagcaaacaaggaagtagaacaagcccattgtagccatagcaaaaagatccagcttgacctggtcaaatatggcacactttgaacattgatcagaataactgtgctggattaaaacacatcataaacatattttcaaatctgtgatttcataatgattttttttcccttcgctccaggtagcagagtatcagaattattattattttttttttttgagatggagtctcattctttcgcccaggctggagtgcagtggcgcggtcttggctcagtgcaacctctgtctgcctcctgggttcaagccattctcctgcctcagcctcctgagtagctggtaggtactacagtcacccgccaccacacctggctaatttttttttttttttttggtatttttagtagagatggggtttcaccatgttagcccggatggtcgtgatcttctgacctcgtgatccgcctgtctcggcctccccaagtgctgggattacaggcgtgagccactgcacctggccgatttttttttttttaaaccctcattggctaccttttggaggactctgggaccaactcatcatcctgaaagtgtacacaaaaagggaatgaatcaaacatttattctgtatcttacctgtacaaattatgtttcagagtaaccaaatacttaatatgggaaaattcttatttatagaacttcaaataatacatgggaaggaatgataccatcattttgtaacctctaatgaaataatgggtttaggtttaaaaaaatcagtggttgctaaaaaccattgggtgaaaataacctaaaatggatataataagtttaccacatctgcaccactgattcatccttatcatgaagacagtcatcttgtgccttctctcctcatgtagtgccaccaatgaagtattcttgccaaaaattgtgatcaggcctctatattcgaacttgtttacagcaaaccaagaaatggaaaagcatgctgcatagtactatggggatgcaatgagcaaagtccaggttgtagaagattctttgaggcaaatgacacagtttctttgacaaataaatgacaaagaaaaaaccaagggggaacctgtgtattaaaacagtggtcctcagagcgctggcatgaatcaaaagtcactgggagggcttgtcaaaacacagattgctggcttcatcccgtagtttctcattcattagccctgggttagggcccatgaatttgcatttctaaaacgctgctaggtgctcttcctcctgatgatccagaaaccacagaaccatgttattaaagaagtcttggattatgaatcaaatacaatgtatggaccttgtttggattctgttttgaacaagccaattgtaaaaataacaataattcccttgataatagggaaatgtagacatgggatggacttttgataatattaaggaattggtaaattttgatagtgtaatcatggtattgtaattatatttttctttttttaaagaaggccctgtctttttagaaatacatgttaaaattatgggtaaaatgctatattgtttgcttgaaaataattggcgctgaaaagtagttgaggatagaggtaaaagagattggccatgtattaacaattgggaagaaagcgagtgatgagtacacaaggattcattatctgtattaatttttctacttttctatgtttatggaaattaccttcaaaatgtaaaatatatgtttggaaacataaaaatatattccaaaatagctcatgaattaaatgtaagtcaccatagaaattacacgttttttggaatagaacagtcatgaattatactatttcaaaacatgtgggatgcaggtaaagcaggacttaagggtaagtttattgacttaagtcttccaaaaaaagatgtaaatgaattaagttcaattcaaaagttagaaaatgaaacacagaaaagctggagggaaaaagaacagaaaaaatagaaataagttaataatgcagtcatcttttattaacaggtagctgagaagattggattgaactaaggcattattctgagggaggttggtctgtaatattcctctctttaatatccttggttctgtctcggtgctgtgctagcctgatagaagaattgggcagtcttgagccaggtatgatgctcgcctgcagtctcagctgcttgagagacagacagtaggattgtttgaagccaggcatttgagaccagcctaggcaacatagtaagacagaaaaggggaaaaaaaaaaaaaaaggtgtgctaatgtaaagagaaattaaaagtaggacttctgttgtcttaaatagtttctgcctcagtgagtaactactcaacttatgtagaaatggctcagtattttttcagcgcacactttgtgccagatgctgtgctaggtattgaggacacatagatgactacgatatgacccatactcctgtggcactcagtctgagggagcatataaatttgtaagtaaaaaattagaatcaggcaataaatgtcagtagacaatatggaaaagttcccaggcaattccttgagagaagaaaattcttaatgtataggatgggcccagccttgtgaggttttgctcaagtagtctccaagaagaaatggcatttaccaagcagccagtctgttataatgggacacattaaaaatcacaaggagtttgctgtgtgactgggagaccattaagttataagagctgtcagtgtatgttatttaggatttttgtagcaaggtttatatgagagattggcctgtaattttcctttcttttaatatccttgtatggtatcaaggttatgctggccttataagtgttggaaagtattctttccttgttatgctctggaagaggctgtgtaagactggtattatttcttccttgaatgactgcaaagccattgggacctggggttttctttagtcaatgtgtactaaacatttagtagaaacagtgacccaaaatttcaacttaagttgaatatgtatctgaaaaggtttattattcttactaacattttcacataaaacttccctctgctcactgaggttaattcacagtttgatcagtgttgtatcagtgacagaaattcactagtataaaaacccagtccatttctaaccaccaaatggtgtattacagcttcaaaaaaaaatttttttttttttactacctaggctttgtgctgggggttaccatggtgtcaaatgagacaaatccatgtcatccagatacttgtggactcaatttgatatgagcaagcatcagatcattttaatctacttgctttattgggatgtgtatgtggatatattaagggctgattattttgatgggctttgctgtttggaatgctttgtcttaatttttgtggatgaatttttaatttatatatttcataagaagtaatgaatttgcatcattcacacttcagaagttataaataaggttctccacctttgtcctttagtcacccagtttcccatctctggagccaaaagatgttagttgcttcttagctattcatcaatttttatatcctctgaatatgcaatatattcacccccgctcccttcccccaccccgttttttttaaacactttctcttctgcaccttgcttttaatttagtaagtccttagaaactgttccttattgcatgttaaaactacgtcttgtttcttttctcttatgacttccttgtatcttgtgacaacagtaataataaattaatgtagtcattgtgatattgatggatttttaggttatttccagtcttcctgcccaaaaaagttacatcgaatatcccaaattgcttttgaataattaaatcatcattttatcttccttcactagttttttaggacagattttttttttcttttcatttcagccatgaaccagagaatcagtcagagtgctccagtgaaacagccaccacccctggctccccagagcccacagggaggcgtcatgggtggcagcaactccaaccagcagcaacagatgcgactgcagcaactgcagatggagaaggagaggctgcggctgaaacagcaagaactgcttcggcaggtgaggccacaggttagaaaccagccttccacttttgggggtttgttttcttaaagttgggcagatttcattttaacatttattagttacagaggaatgttgtctttgtaaaactgagtgacacagaagcattctatccagccctgtccttgtcttagttttgtgactgtgaatggcctttgatcaagttacaagggatgtgacttggaaacctgtatcatgaagagctgttttggtcatggtcattgcaattgagcaaaaattgaaggaagcaaggatgctttctctaatgtacatggaattgtggattgctgtttttctgaggatttcactaaaggggaaattctagaacatcactcaggagaaaacatcctttattaataacttacgtggcgggatacaccaatatgacatttctcaaatgacaaatatacttcggtattaccgaatctaagaattttcattgaaaacaaaataaatgttacctttggccaggtgcggtggctcatgcctgtaatcccagcactttgggaggccagggtgggcagatcacttgaggccagttcaagacaagcctggccaacttagcgaaaccccatctctactaaaaataaaaaaattagccaagcgtggtggcacacacctgtaatctcaacttctcaggaggctgaggcacaagaatcacttgagcttcggaggcagaggttcggtgagccaagattgtgccaccgcactcaagcctgggtgacagagtgagattctgtctcaaaaacaaaaagttatcttcaagtttagaagatgccagtgtgctttaaaattacctgcttatggatgtttttttattttggggaaagtaggacatagtagagagctttgaagccctttaatcaccaattccatcagctttcttccagaaggtactgttggtttttatgttcctaatatatataattaatctcaacattaatttttactttatcttatttcagagtggttaaatctactaagttcagatattggagataaggtcttttgttaagtagcgtagatatttttaaatttccatataaaatttttttgaatagataatagaaaaatggtatactagtgatagatgtacagaggtgaaagtacactcaaaataagatcttttccctgtttttctagttctctcctatggggcctaaataactatgagtttcttaggttttttgttttttgttaatttttccagagatactctgtttacatacataaaatacatgtatctgtgccattttttccctagctaaatcacagcatgctaagtatagacatttaaaaatcgtcatactcggccaggcatggtggctcatgcctctaatcccaacactttgggaggccgaggcaggaggtttgcttgagcccaggagttcgaaaccagcctgggcaacatggcgagactctgtctcttaaaaaaaaaaaaagctctacatttctgttaccaggaaggaggcacctaaaggtctgttttttgttttttgggttttttttagggctgtattttaaaagtatctcttgagtgtcagtgaaaatatgtgaactcagtactacctgaactctgatttggggtttgaggaattggtacttcaggagttaaattaagccatggcatctgagacaggctcacgttgaaactgtgctttgtcggtaatctgtccatacaattctagtgtgattggcatcaaaggtaaaccctgatagaaggagtaagacagtatgtgccaacatacgatgtcaggaacttgttggggctcagaaaatgatactccaaaatatggttctttgacaaactaaggaagcagcctcaagttctatgccaaagcacaggatgaggctgttccttgaagttcctttatctgcctagaaaccagacccaccaaaaggaatacaattgcctttgatcccctcctcaaaatttcattaaccagagaagcctgaaacttgtatgacagaggaaaagactaaaaattaaatatcacacctagagagctcagaggaactttgcccagactattgtctgttctcagatcccattcagtttccaaagagaattatttactaaccattgtctgtgtactgggcccattcattcttcctaaaaatcatttactgcccttcaaaatggcgtcatttccctcatgtccccttcccctgtgaagaagggtattatatagtatctggaactcacttggttattgggtaataattgtcttgcaatttcccccatgcttatgcaccttaaataaatttgtttgccattttctcctgttaatttgtctattatcagttcattttcagcgaacctttagagggtagaggggaagttttccttttggcccctataaagtgatcttgaaagaaatgtttctttatctgacataaaaaaggatggagaaaggaagcattattgtacctctgactttctaacaaattaccataaaggaagaatatttttcgtctactattgttagaacaccttagaaccatcaaaaatataattacatggctaatagaaaaaaaaagagcagttttaaaatatgttttatgtaacctattttcattgtttttcattttgttgttgccgagtagtagttgttctaagtaaatacaggtctcaatttcactatgaataaaaactgtcaaaatcaagaaactaaaaaaaaagttctttaattactaatgtcaaaaccatactgtttttaagataatttgtaaagtctagaaatggggccattcgccattttgttttatgccatagatcatcctggggttttttggtgggcaaatgctgctatttgtaaaactcttccttccaaagattttcctaaatctttattctcaaacttactctgggtgatgggtcctggacagaatagcttcacttcctttaaaggtaacttctttgtttcatctttactgcctactgtgtcgtcttttcttatgttgaagttgacagacctgctctattctcatactaatagactatttttagatttttttaaagtaatcacaataaattcagtatatcttaagtcttttggcttcctgtgaacttcttcccttgacagtttatcttagcactgaaacatcaaatatattgtatctgctttatctaatactcagaaacaaagaacctacgtgaccaatatcaaattttattttttagttctgactcctaaagtcttgctgtcctatcctcaatgctgttaaaaacttctgaggttccagttttgttatgtggtgactccattggctcctgtcttcgtcagtctgcttcttcttgggtagcttgggaattctgtgctatggtgatatgtctggatacaatttgtaagtcagcctacacagccagaccatgtggcttaaagtaatttttatccgtcttattttttactcttaggcaatgcggaatatcaatcccagcacagcaaattctccaaaatgtcaggtaggctcttatctgatgttttagcactggaaaaaaaaaaaaaaagatattaaattaggaaagagaaacttacattccagggtcctgtccttattggacattagcccagagaataactttgagccatctttctaccaagatactcaggttaacattgcccttccaagaaagtctacacagtctgctccctccctgctcctcctagggagtttctgtttattttgattccatggaggtcttttttattctatatttaaatgtattgtgtctcagttgtacatcctatcagctaggtatgcctaatttttatttgaatagcttaaaatagtatgtgtaatgatttaaaggaattaataaattgaacagtaacaaaagcagtatttacttggataggctactttaggaaattttagagtcatgatactatgaggaagagaaaaattctttctagtggacattccaaaggaaaaatatcaaaattatcaggagagtatctgcctggatagtgtttcaggttttcttgttggcttttatcagcattctctgatgaaccccagggagccctggttgtgaaggcatcttatttagaaggaaagattgtggccaatttttcttctaacacaggcacttgtctgactcgtgggaagaatctcgttcttaaaaccaaaaagattttaggtgtttgaggtccacaagattagaagaaattcggagccagaggatcattctacttctcttggggcagaagcaaccatataatgcctcaccttctatgtaacttactctgcactatgctaaataagtacattgttttagaatctgctgtagaagtaggagttggcaaaattctactcattttggatactgttaagttgtccgttggagcaccatgatgataaaagtcagatacagtcttcatagaaaccagttaattttgtgagagggaaaatctctattcttctttatctatctcataaatgccaccattaatcaaaagaccaagcaagggataactcaataataagccatcttcaccaaagttgagcatagacattcttatgatgagggggcactaatataccatttgactgtgaagtgcaggatagcattgggtctttataacgtgaagccatttttttctttgccatttctctgaagtgtttgttttgttttgtctttttgtttttgttttttgtttttgtttttgagatggagtttcgctctgttgccgaggctggagtgcagtggtgtgatctcggctcactgcaagctccgccttccgggttcacaccattctcctgcctcagcctcccaagtagctgggactacaggcgcccgccaccatgcccagctaattctttttgaattttttagtagagacggggtttcacagtgttagccaggatggtctcgatctcctgacctcgtgatccgcccacctcagcctcccaaattgctgggattacaggcgtgagccaccacgtctggcctgaagtgtttctgaaagaagaattttattcatgataaatgaaatagaaactaatataggagcagaaattaactcaaaggagatttggattcaggtaaaaagtcctccatgccaaaaaaatgttgaaattgtttccttttttcccaaggtcttataccctgaatctgataaataagtcaaattcttcttgatctttgtttcatacttgaatagaaaagtaaatctttactgttattaaaattatcaggaattcttagattttttaaaatagtaaagttttagaaaaggtgaggcttattagtagtaaagcttctaagatacgaagattagaggtaattactcagatttgcccagaccagagcaaaaaacttgaaagaggtttttaaaaatcttctttgcatatgctggagattaaaatattggtttgttatatatgctttagttgtcagtgtttaatatttacctggcataattgtggaaagttatcagtaaatgtatgaaattcaagtatagggttatatttgaaatagatcaagaaatctggtggtatttgtatcaagaaagcatgtgtatatttttctcatcctattattttctaaataaccttaaggtagatgtcaggaaatagatcacaaagaagagtcatgtcttttcttctttttttttttgagatggagtcttgctctgtcacccaggctggagtgcagtggcgcaatctcagctcactgcaacctccacctcccaggttcaagcaattctcctgcctcagcctcctgagtggctgtgattacaggtgcctgccactacgcccagctaattttttgtgtttttagtagagacggggtttcaccatgttatccaggatggtctccacctcctgacctcatgattcgcctgcctcggcctcccaaagcactggtattacaggcgtgagccaccgcgcccagccagaagagtcatatcttaagtgaagatggctttaaatagtgtttctcagaataatcaagaaagctagaaaggacttttcagccccaaagaacagagggtataaagacatcactcagtatctgaacactagacgctgttgtaaagttactgggtttttaacttatactttgtaatagatattaatgcagctgagttagcaagcaatagtgagatcagtgtcattttctaatcgtatacctcatatgctgtgggatgtggaaagccactaaacttcaaaatgcttatgaattactacagaagctgtctttaagtacttcctataggatttaacatatcatgtggctgttgtagggtgctgtgctcgtgtacactaacgtcagtatgggtgaggttaatgaaaaattccaagatccatggcccaagtgatattgaaatgtaaaattttgaaaaaactttaaaggcatttatatatcttcttagttaaatatggaaattatcaccttaatttattatactatgttggcaggattttggaaaaattcatccttacagagcttaactttttatttttatttttatttttatttttatttttattttgagacggagttttgcccttgtcgcccaggttggagtgcaatggcatgatctctgctcaccgcaacctctgcctcccgggttcaaatgattctgcctcagcctcccaagtagctgggattacaggcattcgccaccatgcccggctaattttgtgtttttggtagagacagggtttctccatgttggtcagcctggtcttgaactcccaacctcaggtgatctgcccacctcgtcctcccaaagttctgggattacaggcatgagccaccacaccctgccaaagagcttaacattttaatttcattttggttacttatgatttttatgtttcaaaagcaatttccattctcagaagaaactttctgaaactgtaaacatctttgctttgtgagattgagcagttaatgctattttctagtcatatctctgttacacatcagtgctcacttgtaaattggagagaccttttgagcaagtgggtttaggaatgcactctagcttctgttttaaggtcttttgagagaagaactttgaggaaagatagtcccccctgaggtgcgaacacttctaccttctcttgtgcttaagaatatggttcttggactgggggcggtggctcacgcttgtaatcccagcactttgggaggccaaggcgggtggatcacctgaagtcaggagtttgagaccagcctggtcaacatggtgaaacccgtctctactaaaaatacggaaattagctggatgtggtggggcgggcgcctttaatcccagctgctcaggaggctgaggagggagaatcgcctgaacctgggaggcagaggttgcagtgagccaagatcgtggcattgcactccagcctggcgaaaagagcaaaactccgtcttgaaaaaaagaaaaagaatttggttcttaatatctggggttccctagtacctatgagatcgagtttaaactctgcaactggctcatggtctgtggtcagtagccttttcactcactggttccagttaagccagtaactcttccattattagctaagtgtactccactgccttgttgctgttattctgctcacaagcttttccccatagtgagaaccttgcttatcccctttcttaccagtaaagattcttcatttctgttttaaggcttagggtgagattcattcccaagtgcccttatgagaattcttgaggcagggcacagtggctcacgcctgtaatcccagcactttgagaggccgaggcaggcaaatgacctgaggtcagaagtccgagacctgcctggccaatatggtgaaagtccatctctactaaaaacggaaaaattagctgggcttggtggcatgcacctgtagtcccagctactcaggaggctgaggtgggaggatggcctgagtctgggaggcagcggttcagtgagctgagatcatgccactacactccagcctgggtgacagagtgagactctgcctcaaaaaaagaaaattagagaattcttgaaactacccagaaataaaaacaacactgctgtataaagatgtcttaactcagtagccagtataattccaatttaggtggtcaaaagtatgatatggggttactttcatttctgggcaagtaattgcttcaatctgtatagaaattacagtataaatatttggcaactactgaataatgtgtagttgccattccttataggtggtaatgaatagacaccaaggtcagtccctggtttaatgaataataaagcccacagtattgctgatgaggatattatactgcaccattacctctcaacagtgaagaggttcagatgttcacagttgtagttaatgagaacaaaataataccattgttcagagctatatgaaaacaattgccaacaaccatttttttcctgaatttagtaaaagtaaagtatttggcttttttcccttcaaactgtctttcatgttagctgtttcaaaatcctgttaacacttgtctaacgttatctttctcttcgaagttctgatattaaataaatcatagatttatttgaaggttttccaatgaatatattatattttatttttaatgggtacattgaaaactttatataagagggaagatttagtctcacacctcacatacttttaactggttatttcatttgttttattaaacttgcctcttccttgttatttgaacagtgccataataactttgagaccatgattgagtaatacagattacaaaaggcctaattccagaagtctatcagaaagaatgtagaatcctaggataatgctagggaacaccaacctgccatcctgttttggatgtgatttttcagagtttaagattatcatctagttctcataactgtcccccaatccatgtgtatactttttttaatcaaaaaagttgttctaaagttaaaactgctttggtaaatggcataaacattaaaaaacataaagcattggctcagtgttttaatgactttagaaataataaaatgttttattacagtttaaagctgtgttggaaaatagggtatggcaagacctctatcttaaacagttggaagaaatggcatttttttctatttttagaattgttgacataaactgctatcactaaggcaaactacttacaagacatatatttttagagttattctccatttctaaatttggatttccagttcactaagttaatcttccttaaacaaattgattaccaccctccctgcaaaaaccccttgctcctgtgccatatattatcgaaaaaagacacacttttatataatgcagtatttactaaagacagaattgctttaagaaagtaacactgactaggtagttagctccccaaatcattaattcttatgttattttatttatttaagatggagtttcactcatcacccaggctggagtgcaatggcacgatctcggctcactgcaacctcctcctcgtgggttccaagagcttctcctgcctcaacctcccaagtagttgggattagaggcgcacaccaccacccccagctaattttttttgtatatttagtagagacagggtttcaccatgttggtcaggctggtctcgaactcctgacctcaggtgatccacctgccttggcctcccaaagtgttgggattacagtcatgagccactgcgcctggcctgttaatatttttatatgcaacgaacatagtatgtttcattgggttcagtaaggaagataaaatagtgttgctatttaagggaattagtagacatgggatagggaaattgcatatatttatataagaaaacaggccagcctttttctccctttcttaacaatatgatatgtctttgtggttcagtctagccaaaaaacaacaacctctgcctcccatacaagcgcgcgtgctagcgtgaacacactcagataacaaaggtttcaggaggcagaagtgaaatggaaatttcggaaagtatcctactccatgctttacctagtcagattatgaaggagaatgaccatgaagttagacaaatgaaagagttttctcctataaggtgtcctgcttctggggaggaacagttaaatcatgtgtttccatcgtgagtaagttttataattccttgtattcttagcaaaggattgtaaatgtgaaagtgaagttaccataggaaactaagaattttagatgtaaaatagtgaaaatttgtttcagggttatctagacattttgctactttaaaaaaaaatcttaatatgggtaagcatgaagtcaaattaatccgaatgtttaatcaaaaatatattttatataaattctccattatattacatttaaaaataagcctgtatatgtcttatacctgtgttaaaaaatgccaattatatttcaataatgtaattttatcaaaacacattttcagtgaatatcaacattatttcataattgggtaaatctggcatagctcttttgtagacagtccaattatgtcctgagccataagccttgggacataattggattgtctacaaaactgatttcagttgaaacatttcatgttgaaagttacgtctatctctaagaagtttttggattattttatcctgaacacaatgcctaaaattagaatactggactaaaaatacaagtttgttaaacttctgttttcccaaaggtaactaggataaatagtttgacagactttcaaaactggggaaataagttacaggaaatttagccaaaacataatcatgcttctgttctgtatttcaaaggtcaaatagtttttttctaactgaagcaagtatttttagccattttcttctgtaataatacaaaaatgtggtagcttttcccattgagcttgtaaatcttagctaatgtgggacacatttggagtcagagctatctacgctgtaagtaaaactaagggtcccagtttgttctggaggaaactttgcagggtggttcataaaagaaaacatgagtttgcctgctttatttagtggacttttatggaaccaagacctagccataagccattggcccttcttactacatttctctcctctcatgtaaatagcaatataatttcccagaagtcaaaaaagatgctaagattatgtagttttgaaagttaaggtatgttggccttacataaaatgatgccttagtccacatcatttagaaaaataatgagaaaggcagtaaaagtagtcagaagtctggaaacacttagaatatttttaaggtttttttaaatttttagagtatccaagagaaacgaaagcatgtttctacacaaagccaaaatgtagaaataacccaaatgcctatcaacagatgaataaacaaatgtaatatattcctacagtggaatactagttagcaataaaaaggaatgaactgtggatataacatgaatgaatcccaagattatcacactaagtgaaaaagtacatgctgtatgattttattttagaaaattctagaaaataccgaataatctacaatgacaaaaagcagatgattagcttctgaaggttgaagtaggggaggtgagaagtagtgggagaaaattttgaggatgattatcttttttttttgagatggaggttcgttcttattgcccaggttggagtgcaatggcgcaatctcagctaccagaacctctgcctcccgggttcaagcgattctcctgccccagcctcccaagtcctcccgagtagcttgaattacaggcacctgccatcacacccagctaattttttgtatttttagtagagacggggtttctccatgttggtcaggctggtctcgaactcccaacctcaggtgatctgcccacctcaccctcccaaagtgctgggattacaggtgtgagccactgcacccggctgaggatgattatcttgattgtagtggcagcttcacaggtgtacacacatgtcaaaactcatcaatttatgcactttataatttattgtatatccgttatatatcaaaaagcttttcaaaatttacttggaatatctaatcacctgtaactaaaagtttcaaaactcagctgagtatttatacctttagtatgctatccataatctgcatatatgttatttgtatcattggccttgttacattagagtcatcccttgggggattggttccagcaagtcccttatataaaatggcatgctatttgcatataacctacacacatcctcctgtataccttaaatcatttctagattacttataatacaatggaaatgctatgtaaagagctgttacactgttataactgtgttgtcattctgtattgggaataatggcaagaaaaatagtctatatatgttaagtacagacacagccttccatttttcttctcgaatatttcgatccatacttggttgccttacggatatgaaaggctaactatatttgttttcatgccaaattcttccctatttgattaataatacactcctgccaccagtaagtaaagtgtctttttttcattgattctttcaagtctaatttaggtgaatccttaggttagttactgttagtcatggctcaaatataggtttaatgagaagagtgtttccatagcccttcaaggggtcggatatctccttaggtaacttggaatgatttccctgcttactgacatctctaagttatctttctttataaatctgcatagttggttctgcagtgtctgctgacatagaaattcagttgttaaatgaagtaaaaagtaaaaatttcacggcttttaacaaacatagtggccaaattcaaagcagcaagaacatggagagtctagtctgcacatgatactagttttaacctaataaaaagtaggaattttatttaaaaggctaaaataaaaagttgtaaaaataatatgaaaattatagccaattcagttattttagttatgacttacagtttagtgttatatatttgttttgtgctacaaacaggagcataccttctttgataaaaagcaaatgagagtctttagaatattctccaatactcccatgtttgtcacagaaccctaggcatcagccttttctggagtctataattttattcattttaaagtttattgttaaatacatcctcatattttaagagcaaaataaattcttcaaggaattttaagttgttttatgctccagagtaattcattcactctggccttagggggtacagcaaaaataattacgatattttgtgataagtgctgtgttcaggatgttaaagacatgacatgtctgtgtctaatccaatctcaagatcgagatgggatcaccacggagagtttcttcaaaaaggtagtgccttcaccaggtcttaaataatacggaagaaaggcatggtattgagaggatgtgtcctcccacagacagactacaatgagtgtagtatcactgttttaaagtcacttctcactttgtaagatgagcatgggaggagtcaaaagtagaagatagaaaagaaataagagggatccccataagactgcaagaaaagttaaaaagatgatgagtataaatgaagttacttttgaggcaagcaggaagaggtggcaagaggggccagaaaaatcaaagattatacctgatgacctggttttttttgtttgttttgttttttgttttttgttttgagacagagtctcgctctgtcacctaggctggagtgcagtggcgcaatctcagctcactgcaacctcagcttcctgagtagctgggactacaggcatacgccaccacgcctggctaatttttttatattttcagtagagacggggtttcaccatgttggtcaggctggtctccaactcctgacctcaaatgatccgcccacctcagcctcccaaagtgctgggattacaggcgtgagccaccacacccagccaatggcctcagtgttctaatgtagatggaaaagaaatagacatggacttcactggctgggcatggtggctcacgcctgtaatcctaacactttgggaggccaatcgcttgagctcaggtgttaagaccagcctgggcgacatatagtgagaccttgtctctacaaaaaaatttggaggaagagaaaagaaaagaaatggacttccctgaataggggcttgagatagtatgccatatttggagtagtgaccatgaggatgtgaaaaacaactgaccaagaacaaaacaaaacaaaaaaaccaataagtggtactagggtccatccaaaaccaaagacctttaatttgtaatgataacattctggatagttatgtgatttcttttttttcttttcccttagcatttctcagcaatctcagaatgaaaatggaacaaatacactttggcattgctttggggttgggatttgctgggctgagataaaattatatgtacatcaggaatctaaaaggtgcttatgctgttttgaatgatcagtcatgaatttaagcttgtagggaaggagaaaaaaaaataagataccaaaagacagccaatagactagactagtaaggagagatgggtctggagtctctgaggttggagggctggtagagtggacatgagtctatgcaggaactggttagaaaaaaatgtgagaaagtaaaataagtgcatgtaagattttggggagagaagtttctaagccagttcttgggtatgactgagggaattaatgattgaaatacagtgatgaagtggtcagtatcatttcggtgtaaaggcgatcccggcatttcaacaatgggttattatatgggttttatgcatggaggtcataattccaatgtgatgaatgcagttggaatgaagagaaacactgatcatcgtctcaaaacatgacttaagattttagagttggtttggtttcaaataacaggatcttagtggctgtgcaatgggtgtttgagtggagtggagatgaaggtcactggaatccagaaggttcaggaagctgtcaggttaagtgaattgtccatttaatactgaagcatgttaagaggcatggagaatacttggagtggcaagaggctttgaccagactccagaattttcccgtatataagatggagtaacgaagagatcagtaaatttgagtacaagaagcagtttaccttgcagggaagacaggcaaacaattttggcatttggccaagtccctaggttccctctcaggacattggtgtttgtttttttttaaagtacaggattgaaaagaaaaggaatttcattgatacagttaagaaaatattaaatagaaacttgtgatataacgtgcttctttttaatgtataaataacaagatctaaggctgggtgcagtggcctatgcttgtaatgccagcactttgggcggccaaggagggtagatcatctgagcctgggagattgagaccagctgggcaacatggcaaaaccctgtctctacaaaaatacaaaaaattagctgggtatggtggtgtgcctctgtggctgcagctactcatgaggctgaggcaggaggatcacttgagcctagaaggtcaaggctgcagtgagctataattgcatcactgcattccagattgggtgacagagtgagaccctgtctcaaaaagattaaaaaaaaaaaaaatctagaagcacatcttataacgtaactactgtagcattgaaatagcaatgatcataaatggtattttaaaatatttgcaacaactacaatgtgatatgaaaacatttatatgttctattggtgaaaagttaggtacagtgaatactaatggtgcatactacattggagaaaatgttgacaaatttagcgaaagttaatgtgtaatttttttttttttaccccattgaagttcagagactctctgaattctgtcatggtccgctggttaagaaactctggtttaaaggatggtatatccagaaggcataaacctaaagaaaaataagtggtatttgcatgcaggagaattgtagtttagaagtggcagcgtagagctaggagaagctttccatacttcaggaccccatggcgattgtggaggtgagggctggagatggtggggccgtgcctcagtgagcagacttggctcagaaagctgtgtggaaggatgacggagtcaggccagtatcctttgtgataagaaactgtatgtatttcaaatcaaacccaaaaagtagagggaaagaaagctgatggtctagtagagatgatgtttacgataggtggagaggcacagtgaaaattcttaggagggtaagaaacagtgaacagataaaggagagaaaaaggacagagtagtaatgagtgtgctacggatgggtcacagtgagatgaactgtttttgaggtcctgggcaaatacaggctgaaacctgggaggtttggaagcccttgaaggcaggccttctgcaaccatcagagtagcaacctacagcctttgctcaggtttacagggagaatcctgctgagaaattgttggatgaccctgaagaaattttaccccattttaaatattatgtttgtggtggagaagccttgggtttgtgttttaacttctgatgtctttttttcattttcctcctctctccctgctagaggatggaacatattctatccagctcaggatagaaaaacctaaagtcaaaatgagacatttaatagcaaagtgtgaaatagtgttgggggttggggaaggattggtgtcttatagtaaaatcatcagatgctattcttcctacttctttttttttggcgggggagggggtcggggggttccaaacacacaaaaccatataagagttgtcgagtaaaagcaaactttaagaattatttttttagggccgggcgcggtggctcacgtctgtaatcccagcacttttggggggccaaggcgggtggatcacgaggtcaagagatcgagaccatcctgggtaacatggtgaaaccccgtctctactaaaaaaaatacaaaaaattagctgggcgtggtggtgcgtgcctgtagtcccagctactcgggaggctgaggcaggagaatcacttgaacccaggaggcggaggttgcagtgagccaagattgcaccactgcactccagcctggtgacagagtgagactccgtcttgaagaacaaaaaaaaaaaaaaaaaaagaagaatttttttttaaagaccagacttgccattctataataacccaaaggaggatttgggagtatcttccagagtaaggaaaataacaaaaagaaaacaaagtagcaaaatgtatatagggtggggggtggttaatatgactagacagactttaaatatatgtaacttaatttttagtcatttgaaatggatagaattaggtcattctgattgggaaatgtattaactttaaagtagatgtttttaatctatctgcacggttactctgatgaacgttttatttctttaaacctaacattaaatgtgttaatcagtagattgattctctttggctttatttttaattaggagttagccctgcgtagccagttaccaacactggagcaggatggtgggactcaaaatccagtgtcttctcccgggatgtctcaggaattgagaacaatgacgaccaatagctcagatcctttccttaacaggttggtgaaagttgctactggtgaatatctgaaaaggatcattgctttaaaatcattctgcttagtgcttgtaataggctatttggaacatctgtgtgggccaaaaaccatagctgtaaatgaatctctctgtaaatggcaagtacatgcagagttgaggattaaaagttgtctcctgtgagaggaagtgaactgttcagacttgtacaagggatacttattcaaagtcatgacgtgtttgcttctgcctatactgttgactaacagttacttaaaattacagaatcatgaaggaacatgtgaatgcctttctgtgaaagcaaatgaatttcatgttaaacctacttaggattgcattataaggatcactggaaggaattttccacatagctattcaagctaaaacgtttcacccagcagcactgtaaggcctcatgttcttaagggctatagtccaaggagataaaatgtaaggttgtgcctctttcaaaaatgcactaagattaacggcagtatttgaaaataacatagcttagggatgcttcttagtgagttaccacaaatcctgggtttcagacagattgcaatattacataaactgccattttgaagtctgtaagctgaaacaggtcatattctttgcctaggaagtcatttaagattaagatttaactaaaattccttcttctaggttgtggagtttcaaactttttaaaatatgggattagtttacgctttggattccttttctaactgatttaaataacacactttcttaaatactcaaaggtattttgcactaggaaaactattacaccaccttttcagttctcaccaattgaattggaaacttagtaattccaagagaaaatatcttatcctgctaaaagtatttagtgcaatagaattcaccatttactcagtttttaagattagtactggtggcctagttggaaggtttgattttgaagaccatctaaaatgtattttaagtttgtatttactcttctgacatacactttaaagttctaaaagtaagtgtatttatataagattatagttctagacttaaactgaggctaattaagagaggcatagcctcagaactttttttccaacaaggaaaatttcatatccatgtaattccagtacctgtcttgttgaaggggctatattaatcccagggataaaaattagaccattttaaaaatggataggctgcatatccttctgacagtcacttatgaagattttttttcttaaaacttttgatgagagctgggctacaatttgagattctattttctgggaagatcagagtggcagataatcagtgttactaatctaagggcagaattgtatatgcattctctgcagtacccccagtttctaataataacatacatctgactttgactttttttttctttaaaaaaaaaaacaactcttggctgggcatgatggctcatgcctgtaatcccagcactttgggaggccaaggcaagtggaccaccacctggggtaagagttcgagaccagcctgaccaacatggcgaaaccccatctttactaaaaatacaaaattagttgggcatggtcacgcatgcctataatcccagctactcgggaggctgaggcaggagaatcgcttgaacccgggaggcagaggttgcggtgagccgagatcatgccgttgcactccagcctgggcaacaagagtgaaacttggtctcaaaaaacaaaaagacaaacaaaaaaacctcttgatggtttttcccttgtttactatttgatttatgtatattccttaagctctaaatactttttgccccaacttgccttggcattgactcttagtagtaatgctgagttcccttagttcccttttacttttaccctcaaagctcactcagatgtccccctccatgaaacttttaccctttacttctaagctccctgtttgttctgaaagcactgtgcttacatctgagttcatatagcccctaaatatgattcattagtatatttgttcatttccctccttgaagttgtgagcctctcacaaaacattgtttgtaggtggtggtgattgttaacctctttatcctcaaagcctagtctaatgcctgtcatgtagtagcagatgctcagtgaatgtttactgaatgagtggggcctgtaggaagtggggttctgcagggagcagttcctcaccaggaaaatggccctgtaaactctgtcctcaggaatgcccatgtgcttcccctgtggtttggaatgaactctgcgcaactctgtaagttcagttattcagtaatagactaaaatgtctgatgtgtgtcccatgcttagcagccgaatagagtgatgactaggaccaggctcttgtcccagatcagggcaggcaaaatacaaacaaaccacatcctgaggccttctcatatatggctgcattgtataccaatggtctcagaggcaaatgtgtgttttcttggatctgtgtgaggcttttgagccttggcaaaatctggcagaagcattagagtaaaccagtgatggcagtatatagaatgaggggagagagagaacaaggcaaatgcattgcatcatttagggaaggcagttggggtattgactgagcttttagccttgagcaattgttaaacttgtttttattttttaacttttatgtaagttaaatagctgcttattaaatgtacaagccgtagagaaagttgaagttcacactcacacagaccattgaagaataacagctgccttgattttatgcgtttctctaagattttgtagagttagtagaactcagggaatgccagctgatgtctagatgctactagcttaggaaagtgttctatttctcagggtaatggatatttaccatacttttaatgtaaatctgggaaaccttacttagtctaaagtgaaaatctgtgttgggtcattttattttcaagggatgtgccttgcagttttttgttttgctcttttctttaactggagctatatgatttcccgtttcgtttcgtactgaagtgtttgaggctttttcctcccccgcccaaacacagaagcaaggagatcaagccacgagtattcttatcttattggcagtgactcacctattttggctcagtcctaaaaggaattctggtggtttatttggggttgatttttccttggcttatgttctctgcacaatagctaggaatttaacttgagtctagtgcagacctgtctcctcgcccacctggagtttgtgttgtgacgtctctgtgccaccaccacctggagaattgaggccttgggacaagtaagttgtatgggttcctccgcacccccagattcaaatgatattacagagaggagaatactgatgcagagaattttctgtcagccaggaaaactaactgggggtatctttttttgtcccttattgtcaccaagcacagaaccttaggagaaatcttggttccttagagctgccagcttcaattaggattaacttgtctatttcacttcatagcacaagccctgtctatggccctgagggagggtgcttgtttcagacattgcaggacaggaattttcactaatcctctttgagaattatgttgctgctcagcaggtgtttatttttaccttgaattgatttttaaaattttttgtgttggtctttaactgtcatgtttatgtagtggcacctatcactctcgagatgagagtacagacagtggactaagcatgagcagctacagtgtccctcgaaccccagatgacttcctgaacagtgtggatgagatggatacaggttggtattctttattcctcttagtaacctgacttaacagtgggatatgttatcaccaggtctcataaggtattgtaagcaaagatgattcagaagaaaaccaattaaaatcctgtaaatttgaattaaattgatcctgctttgtctctatacggtgatttgtaacttgtcttttcctagtttaaaaaaatatatatcatggattggccgggtgcagtggctcatgcctctaattccagcattttgggaggccaaagtgggtgtattgtttgagcccaggagttcaagaccagtctgggcaacatggtgaaaccccatctctataaaaaaacatacaaaaataagtcagctgtcatggtacatgcctgtagtcccagctactcaggaggctgaggtgggaggatggattgagccccggtgatcacaccactgcactccagtttgggtgacagaatgagacctcttctcaaaaaaaaaaaaaaaaaatcataaattggatatattagctctatttgaataaaactctgataacatgacttatgttagcatgttgatcttaattggcaggacaaactgacaaccctgttagaacatctctctccttatagattagtgtccttaattttgagagatgtctacatgtaattcagtgtttgtcttcatcttttctctaagagtttttggtccaccttaagtgttatggggctcaggaaaccaggtgggaaagactaggaggtggggctcacttactttgttagaatagttgcagaaggccaggtgcggtggcttaaacctgtaatcccagcactttgggaggccgaggtagccagatcacgtgaggtcataagttcaagaccagcctggccaacatggtgaaaccctgtctctactaaaaatataaaaattagccacatgtggtggtatgcacctgtaatcccagctactcgggagactgaggcaggagaatcatttgaacccgggaggcggaggttgcagtgagccaagatcacaccactgcactccagcctgggtgacagagcaagactccgtctcaaaaaaaaaaaaaaaaaaaaaaaaaaagaatagttgcaggggtcttgcaggagctaagaaatacctgcctcacaggggtaattacggaagcatttctcctgtggcttacctggcaaccattgccctagagttgacaactgccagagtgcatgaattggcagggaaatgaagctgttctttagctaccaactctttcactaactgcttctattctgaaagtgtttagcaaggcttttgtgcctgtattcatccagctcctggctttgatgctttctagaatccacactacccctcctctctgattatctagatgttaaatcatccttaggagccacttcaaacccatttcacacacaacacctttacttactcctctaatctgtattgctctcttctccagacccctgtagcacttaatggtttatgttagtttttctgaaagtatgttctattgaagctctgaggagtgttaatgttgtcatatgcaaaaaaggctctgtggccaagtaagtttgggaaacctagaagcaaggctaggaagatggatttattcaaagccctctgggaaggcttgttttgctgttaggaaggtgcatctcctaagggtagaataaagtattcttgcagtctttctattttagtgtttcccaaagtatatttaaggccaaggtaggtctataccactcatgtttatgtttagtcttattatggtggtgcttatctggaagacagggtagtgatgctgtcgtgttgtgtacttgttctttctcccgctgctgcatataatttttcaagggcttttttatttttttcatgactcctttagtgctcagcacataatagcaatcaagctgttattggatatctgaacaatgttgaagcaaaagtaaacttggcattgttattttgttatctgtgagttgtttgacctgatataaattctaggtatcagtttaggtcagtcaggagcgcttttctttccctgtgcatttctctgtgctcatatgatacagccctgatgttagcttttcaaaaaggactttgttatctctgtgtgtttccactaggtgatactatcaaccaaagcaccctgccctcacagcagaaccgtttcccagactaccttgaagccattcctgggacaaatgtggaccttggaacactggaaggagatggaatgaacatagaaggagaggagctgatgccaagtctgcaggaagctttgagttctgacatccttaatgacatggagtctgttttggctgccaccaagctagataaagaaagctttcttacatggttatagagccctcaggcagactgaattctaaatctgtgaaggatctaaggagacacatgcaccggaaatttccataagccagttgcagttttcaggctaatacagaaaaagatgaacaaacgtccagcaagatactttaatcctctattttgctcttccttgtccattgctgctgttaatgtattgctgacctctttcacagttggctctaaagaatcaaaagaaaaaaactttttatttcttttgctattaaaactactgttcattttgggggctgggggaagtgagcctgtttggatgatggatgccattccttttgcccagttaaatgttcaccaatcattttaactaaatactcagacttagaagtcagatgcttcatgtcacagcatttagtttgttcaacagttgtttcttcagcttcctttgtccagtggaaaaacatgatttactggtctgacaagccaaaaatgttatatctgatattaaatacttaatgctgatttgaagagatagctgaaaccaaggctgaagactgttttactttcagtattttcttttcctcctagtgctatcattagtcacataatgaccttgattttattttaggagcttataaggcatgagacaatttccatataaatatattaattattgccacatactctaatatagattttggtggataattttgtgggtgtgcattttgttctgttttgttgggttttttgttttttttgtttttggcagggtcggtgggggggttggttggttggttggttttgtcggaacctaggcaaatgaccatattagtgaatctgttaatagttgtagcttgggatggttattgtagttgttttggtaaaatcttcatttcctggttttttttaccaccttatttaaatctcgattatctgctctctcttttatatacatacacacacccaaacataacatttataatagtgtggtagtggaatgtatccttttttaggtttccctgctttccagttaatttttaaaatggtagcgctttgtatgcatttagaatacatgactagtagtttatatttcactggtagtttaaatctggttggggcagtctgcagatgtttgaagtagtttagtgttctagaaagagctattactgtggatagtgcctaggggagtgctccacgccctctgggcatacggtagatattatctgatgaattggaaaggagcaaaccagaaatggctttattttctcccttggactaatttttaagtctcgattggaattcagtgagtaggttcataatgtgcatgacagaaataagctttatagtggtttaccttcatttagctttggaagttttctttgccttagttttggaagtaaattctagtttgtagttctcatttgtaatgaacacattaacgactagattaaaatattgccttcaagattgttcttacttacaagacttgctcctacttctatgctgaaaattgaccctggatagaatactataaggttttgagttagctggaaaagtgatcagattaataaatgtatattggtagttgaatttagcaaagaaatagagataatcatgattatacctttatttttacaggaagagatgatgtaactagagtatgtgtctacaggagtaataatggtttccaaagagtattttttaaaggaacaaaacgagcatgaattaactcttcaatataagctatgaagtaatagttggttgtgaattaaagtggcaccagctagcacctctgtgttttaagggtctttcaatgtttctagaataagcccttattttcaagggttcataacaggcataaaatctcttctcctggcaaaagctgctatgaaaagcctcagcttgggaagatagatttttttccccccaattacaaaatctaagtattttggcccttcaatttggaggagggcaaaagttggaagtaagaagttttattttaagtactttcagtgctcaaaaaaatgcaatcactgtgttgtatataatagttcataggttgatcactcataataattgactctaaggcttttattaagaaaacagcagaaagattaaatcttgaattaagtctggggggaaatggccactgcagatggagttttagagtagtaatgaaattctacctagaatgcaaaattgggtatatgaattacatagcatgttgttgggattttttttaatgtgcagaagatcaaagctacttggaaggagtgcctataatttgccagtagccacagattaagattatatcttatatatcagcagattagctttagcttagggggagggtgggaaagtttggggggggggttgtgaagatttagggggaccttgatagagaactttataaacttctttctctttaataaagacttgtcttacaccgtgctgccattaaaggcagctgttctagagtttcagtcacctaagtacacccacaaaacaatatgaatatggagatcttcctttacccctcaactttaatttgcccagttatacctcagtgttgtagcagtactgtgatacctggcacagtgctttgatcttacgatgccctctgtactgacctgaaggagacctaagagtcctttccctttttgagtttgaatcatagccttgatgtggtctcttgttttatgtccttgttcctaatgtaaaagtgcttaactgcttcttggttgtattgggtagcattgggataagattttaactgggtattcttgaattgcttttacaataaaccaattttataatctttaaatttatcaactttttacatttgtgttattttcagtcagggcttcttagatctacttatggttgatggagcacattgatttggagtttcagatcttccaaagcactatttgttgtaataacttttctaaatgtagtgcctttaaaggaaaaatgaacacagggaagtgactttgctacaaataatgttgctgtgttaagtattcatattaaatacatgccttctatatggaacatggcagaaagactgaaaaataacagtaattaattgtgtaattcagaattcataccaatcagtgttgaaactcaaacattgcaaaagtgggtggcaatattcagtgcttaacacttttctagcgttggtacatctgagaaatgagtgctcaggtggattttatcctcgcaagcatgttgttataagaattgtgggtgtgcctatcataacaattgttttctgtatcttgaaaaagtattctccacattttaaatgttttatattagagaattctttaatgcacacttgtcaaatatatatatatagtaccaatgttacctttttattttttgttttagatgtaagagcatgctcatatgttaggtacttacataaattgttacattattttttcttatgtaatacctttttgtttgtttatgtggttcaaatatattctttccttaaactctt

SEQ ID NO: 1262 - DNA, 122963 bp, Homo sapiens; identical to SEQ ID NO: 1259

SEQ ID NO: 1263 - DNA, 68198 bp, Homo sapiens
tgtatttccatgaattcaaagccttttaatgatgtgaacacttactccccatttcttttttacattgttacaaaaaatttacatacagttttctgaaagtggcattttgttggttgttattatactgatgacacatattaacactttgtattgaagaagtatcataaaaatcacagggcattacagatttttgataagaagtagtaatagcattgtcttttaacagctggaggctcccaggcatactctttggtgagaaatgattaattttatattttcattttgatgagaatcttttcttgtttttaccagttataaaaacaaagctttttctttgttgtgatactgtgcactaagacttagtttcttgagctgatgctaaataaaatgagatcaataggaatattccaggaggtcgtgagaagtttttagaaaggatggcatctacatatatatggagctctgaaaactgttggagagtatgacctgggactgaaactgtggagcacatagccagtgtcacaggctccgagagcagagagagtttgctctgggacctggaatgagtgatggagaaatgttttaaacaaacaaacaaacaggccaggcacagtggttcacatctgtaatcctagcactttcggaggccgaggtgggcagatcgctttagctcaggaatttgagattagcctgggcaacatggcgaaaccccatctctctacaaaaacaaacaaaacaggcctggcacggtggctcaagcctgtaatcccagcactttgggaggtcggggcaggcagatcacttgaggtcgggaggtcaagaccagcctgggcaacatggtgaaaccccatgtctactaaaaatacaaaacttagctgggcgtggggccacatgcttttgtaatcccagctactaacacttgaatccaggaggcagaggttacagtaagctgagcttgcaccactgcactctagactctgcatctcaaacaaacaaaaaaacaattgtgggaaggttcctaggtttactgcactccagtttaatgcttgtatagtactcacacttatatctcaagacttttcaagggctgacccacccgttttctgccacatgcagtcagccccaaggcctcatctgtacccaaaggcctgtggacaataactgcctcagcaaaaaaaaaaaaaaaaaaaaaccttgaagcatctgacagaggaaacgtactccagagccaccgtgagctgcccctgttcctgaccaccaagcccagcctggacagcctgctttcccgccctggcctgaggctggctcagtcctggatctctccccagtcctgctttcccactggtgcctctaagaccccagtgtggagtctgcacctcatctcctcaacacgaacagatattggtcctcaaacacagaaacacactcttagcttggtttctgctctattttggtatttctacttttgaactttgttcagtgttcctttctaaaacctaaccactggatccaacccagggttgtagagtgtccattctgagtctgctatttccccaagtgtcccctcagcaggcagcaggctctgctttatcctggtgggggatgggtgcgccatcttctccagctacaagacagcagagtgggtctcctggaggttctcctccagcttcagccccaggttgtcaatcccaatgctggtgactggaggcacgctgctttcagccggctcggccgtgcgagtaggggtggagcagtacaggataaaccccaccatgatgacagtgaaggacaggatgtagagtcctgaaaactagaagggaagaacaggcagtgaattgtgcccctcacatacacatctttgctgctggcttttgccaactgtgcttcgaggattaccctctcataatctttttattttctttctttctttctttctttctttttaagacagggtctcgctctgtggcccaggctggagtgcagtggcacaatctcggctcactgcaacctccacctcccaggctccagtgatcctcccgcctcaacctccagagtagctgacaccacaggcactcaccaccacacccggccaatttttgtgttttctgtagagacggggtttttccatgttgcccaggatggtctcgaacacctgagctcaagcaatccgcccgcctcaggctcccaaagtgcgggggattacaggcgtgggccgccatgcctggcctcatgatcttttttctgaaagttacctaaggagatgctaatgcacaaaaccttcccatgtatgctggtgaatgatgggactctgccaacagcacccggcacataagccacctggatccttggatctttaggagaaatggacctttgcttttctctgtcataatccagctacaccccactctgcatatagtcccacttagtggagaaaataaaaggtcatcatggataccacagagagccccattcagaccctagacactgcttacaatattggtatgaagcagaggaacgtaagactatgatgaaatgtggaagtacagaaggggcatctgctcaacagcctctcaatgtgtgctattcaatgaaattcattttgctaaaatttaatacattatcttgtctctgtgggcaagtattacatagtaaaatttatggtggactgagcagattcagaattgtagagctagaaagagcctaagatactagaagagtccaaagcccaaagaggtgactgagtgtaaggtccggtgaggacaatcataggaaacagagccctgtgagaggcatctcatacactctctgttcccagaaggaccaaaaagagcaggagcccattctgacagaaattttaaaagtatggatggagtttttggtgaccttccccaactttccccttcctaagactgaaaaccaccacccagagcaaaatgcaatgaggaaagaacactaattcattgggtatatatatggaaaaatgatataccccaaaagtctaaataaattctattaagaattttgtatatttcctcttgagttgaaaatccatacaaaagttgaagtattaaagaaatcagtctgtattttttcttttttttttttttttagacagagttttgctctgtctcccaggctggagtgcaatggcgcaatcttggctcactgcaacctctgcctcccgggttcaagcgattcttctgcctcagcctcccgagtagctgggactacaagcatgcaccaccatgcctggctaatttttgtatatttggtagagacggggtttcaccatgttggccaggctggtctcgaacaccagaccttgtgatccgctcgccttggcctcccaaagtgctgggattacaggcgtgagctaccacgcctggccatcagtatgtatgtttagcagcatgataaagcacagaaagagagtggctaaagactgaccaagaatggtgtactaaaaattagagaaactatgtactgtaactaatgtgtaatcaaatacccagggccttatttttcctttcaactggaaaagcaaactcaacttatgattaatcctgctaacctgattttaaaattaggaatggagtagctaacatcatactgaatggggaaaatataaaagccttacttttaagaactggaaaaaaacaaggatgcccactttcaccactcctattcaacatagtactggaagtcctagccagagcaattaggcaagaaaaagaaataagaggcatccaaattagaaaagaagaagttaaattatccctctctgtagatgacatgatcttatatccagaaaaacctaaagatgccacaaaatagctcttagatctgatcaataaattaggtaaagttgtaggatacaaaatcaacatataaaaatcagtagcctttctatacactaataatgaactagctgagatagaaaccaagaaggcaatcccatttacaacagctacacaaaataaaataggactaaatttaaccaaggaggtgaaagacctctataaggaaagctacaaaaccctgatgaaagaaattgaagatgacacaaatggaaacacccatgcttatggactggaaggattaatctcattaaaatgagcatactgcccaaagcaatctataaattcagtgcaatccctatcaaaatatcaatgttatttttcacataaacagaaaacacaatcctaaaattcatatggaaccacaaaagggcccaaatagccaaagcaatgctgggcaaccaaaacagcatggtattagtataaaatgaaaatgaactcctatctctcaccatataaaaaaatcaactcaaggtgggattaaagacttaaatataagacccaaaactataaagctactagaagaaaacacagggaaacactttaggacattggtctagacaaagattttatggctaacatctcaaaagcacaggtaacaaaaacaaaaatagacaaatgggactatattaaactaaaaagtttctgcacagcaaagaagacaatcaacagagtgaaaagataacctcctgaatgggagaaaatatctgcaaactattaatccaacaagggactaataaccagagtatacaagtaactcaaatgactaaagagtgaaaaacaaataatcctattaaaaagtgggcgaaggacatgaataaacattcaccaaaagaagacataaatggccaacaggtatatgaaaaaatgttcaacatcactaatcatcaggaaagtgcaaatcaaagccacaataagatatcatcttacctcagttagaatggctattattaaaaagtcaaaaaataacatgctggcaaggatgtatagaaaaggaactcttaggccaggtgcggtggcccacgcctgtaatcctagcactttgggaggctgaggcgggtggatcacctgaggtcaagagttcgagaccagcctggccaagatggtgaaacctcatctctactaaaaatacaaaaactagctgggtgtggtggtggcacctatccagctactcgggaggctgaggcaggagaatcacttgaacccaggaggcggaggttgcagtgagccgagatcatgccactgcactccagcctgggcaacagagcaaaaactccatctcaagaaaagaaaaagaaaagggaactcttaaatactgctggtgggaatgtaaattagtatagtagagccactatggaaaacagtacggagattctcaaaaaactaaaaatagaactactatacaatccagcaatcccactactgggtatttatccaaaggaaaagaaatcagtatatcaaagggagatacctgcactcatctgtttattgcagcactattcacaatagcaaagatatggaatcaacctaactgtccgtcagtggacaaatgaataacgaaaatatgatatataaacacaatgggatactattcagccacaaaaaaatgaaatcctattatttgcagcaacatggatggaactagaggtcattatgttaaatgaaataagctagggcacagaaagacaaatagtgcatgtttcactcatatgtgagagcttaaaaagtcaatcttgtggaggtagagcatagaatgacagatatcagaggctgtggaggatgtgtggattgggggtgggagataaagagaggttaggtttttgtagtggtggttgttttgagacagggtctggctctgtcacccaggctggagtgcagtagttcaatttcagctcactgcaacctgtgcctcccaggctcaagcaatcctcccacctcagcctcccaattagctgggactacaggtgtgcaccaacatacccgtataatttttgtattttttttttgtagagacagggttgtgccatgttgcccaggctggtctcaaactcttgagctcaagcaatctgtgtgtcttggcctcccaaagtggtgggattacaggcgtgagccaccatgcccagcctaagggacgttgtttaatgggtacaaacatttagttagatagaaggaataagttctaatgtttgacagcagagtaggttgactacagttgaaatgataaatactcgaggtgatggacgtctcaaatactctgacttgtacacagtctatgcatgtaacaaaatgtcttatgtatcccataaatatgtataaatatttgtatcaataaaaaattaagaacggggcattctattttattcacaccaataaatagttttaaattagcttaagtttcatattatgcccaataaaaagttcaaataaggagatgacagcaaaaaacagtaagaaaacagaatgggctagggaaggagggaaaaggaagagaaagaagatgagaaggaaggagggggtggaaggagtgagacagagagagaagaaaaagcaagcaagctagcttggcacagtggtaggcacctgcagtcccagctactcaggaggctaaggtgggaggatcacttgagcccaggagtttgaggccaacctgggcaacatagtgagaccctatcgctaaaaagaaaattaaaaattaaaaaaaagcaagatacactcccaaaggtaaaagaaaaaactaagtaattttttgaaatgagtattaagtagattgctggtcacatccagctgtgggctccttgggtcaccaacagctttaatgtgctaacttgttatagatgctcaattatttcttaacgttaaaccttaagaattccttaaggaatgtaatagccacagccctccccaagacaggaaaatgcttcctggattaaatgataatgcaaaaccaataataatgtcaagctaagcagacaactataatttcctaccactgattttcattcttggatctaatacatagcacagggcccaacacatagctggtgtttaataaatgtttgttgaaaaaaattgattcagagaatattaggggaagttagagctgtttggagtactctaaactttttaagttggtattttttatttttttttgttatttttatttatttattttttgagacagagtcttgctctatcacccaggctggagtgcagtggtgcagtctcagctcagtgcaacctctacctcctgggctcaagcaattcttgtgcctcggcctcccaagtaactgggattacaggtgcccgccatcatgcccagctagtttttgtatttttaatagagatggggtttcaccatgttggccgggctcgtctcaaactcctgaactaaagtgacccactcacctcagtctcccaaagtgctgggattacaggtgtgagccacttgcgcccagccttaagttggtattttgaaaggtaatcttgctgtcccataaaatgtttactgttacctgtgaaaacacctatataacttgttcaaaacctgttatatttggtttggtggcttttaaatgttcagaagaaaaactatcatgtctctcttaagaaggcaggtgattaaatggagtcacttttattaggatggagagactaataaagagattaagtctcctgaattagaggcgcttacttctttgtcttgtaaaattctttgtgtctggatctatacaggaagtttcttgcgattactttattcagcaaatattcactcaagatcaatttcaggagaggcagagtgcttaagggacacggatgagcgtaaaaaattctgagcctctttttcaactgtctgcttcaaaaaattagagccaaagttattttagacacagtttttaaaactggtagtgtatcaagcttacaatctgcctttaaaaactacttcttggccaggctcagtggctcatgccctgtggtcccagcactttgggaggcagaggcaagcggatcacctgaggtcaggagttcgagaccagcctggccaacatagtgaaaccccgtctctactaaaaatacacaaattagccgggtttggtggcaggtgcctgtaatcccagctactcaggaggctgaagcacaagaattgcttgaacccagactgcaggggtggcagtgagctgagatcacaccactgcactccagcctgggtgacagagcgagactctgtcgcaaacaaaacaaactacttctaaagtgctaggtgtcttcattatgctctgagttttttctacctctgtaatttattctgaagatttcagaagacctgctctttgctctgtaagtcttgaaacatttgaccaaaaatagtaaaaatctgatctaagaatgtactattagacattcagggacaaaggaacacaaaataactggaaaggaatttatcaactgcatgctctgattctgagaatagtagtttaaagttatgtggccaaaaaatgacataagaaagggatttttcattttaaagttgaaagcagttgaagccaaagccggccaccaactggcctgcaactgctatatagaaacaccagcacccctagtggtggccagatgaaatgcagccacggcatcacagaaaaacttaaggctgacattgtagtctatgacaatttggctctcagaaaaaaatctgcacccatcaggatgacttctctgattcactttgactttatttatttattttactttttttgtttgtttgtttagacggagtctcaccctgtcacccaggctggagtgcaatggcatgatctcggctcactgcaacctccacctcccgggttcaagtaattctcctgctgggactacagatgcacgccaccactccaagctaatttttgtacttgtaaagacggggtttcaccatgttggccaggatggtctcgatctcttgacctcgtgatctgcccgccttggcctcccaaagtgcaggcgtgagcccctgtgcccggcacactttggctttttttttgtttttgtttgtttttgtttttttttttttgagacagagtcttgctctgttgcccaggctggagtgcagtggcgtgatctcggcttattgcaagctctgcctcccaggttcatgccattctcctgcctcagcctcctgagcagctgggattacaggcgtatgccaccatgcccggctaattttttgtatttttagtagagacagggtttcaccgtgttagccaggatggtctcgatctcctgacctcgtgatccgcccgcctcggcctcccaaggtcctgggattacaggtatgagccactgcgcccggcctggcttttttttaatgatgttactagtaagctataaatactccttcagtcttagttcaggaataccttaaccagcaagtctgcaaagataacagctggttccttcacatgtaaccttgcaaaccaaaggtttacactccttaagcagaaatttctgagaatccactgagcttaatgtatcagtaattcagctaagtgttgtgagttcatggccgacttctgggaatagcataaataaggatttgtctggatacaaaattctacaaggacgaagaaagatagttaataacctctactgaaactaaaattatcaggtaacagccagcattctaactatctgctcaaatgactgtcaagaaaataggaagcaggtcaacaatcctttactgaaggcacactgagaaaagacaggtctcgctctgtcagccaggctggagtgcagtggtgtgatcagatcatggctcactgcagcctcgacctccctggccccaagtgatcctcccacttcagtctctctctggagtggctgggactacaggtgcacattaccatatctggctcattatttttgtatttttttgtagggatggggttttaccatgttgtccaggctgaaaagaggtatttctaaagcaggggttctcaaagtataatccaaaatccttgaggggacctaaaactctggggaagaatctatacagtgaaagctattactacttttttttttttttttttttttgagacggagttgctcgttacccaggctaaaatgcaatggcacaatcttggttcactacaacctctgcctctcaggttcaagcgattctcctgcctcggcttcccgagtagctgggattacaggcatgtgccaccacaccctgctaatttttgtatttttagtggagaggggggtttccccatgttggccatggctggtctcgaacccttgacttcaggtgatccaccctcctcagcttcccaaagtgctgggattacaagtgtaagccattgcacctggccctcaaaactatcattactataatactaaaatgctatttgcccatttcgctttcatcgtcttgcaagtgcacaatgaaatgttctagaagctacatgatatgtgatatcacaaggcagaaggaagaagcagatgtgagaatccaggtgttttttctagtaagccacagagtaaagagattttttaaatataaatcaatgaaattcttctcactatttttttattttgaaaaatacattttttcataaaaatgataacatgatgaatttattattttcttaatgagttaataagtattttttaatttctcagttttcagttataatatggtaaataataggtataaatgactggggttcccaatttttaagcatttaaaaggggcttaaaattttaaaaagagtgatcagcaagccctggatctaagaaaaaaaaaaaaatagatgagaactgctaaactgctgccctaggaattttcaaattagctgtgaagttggaaaaaaaaaatctatatacttggttctgtctgattatgagactttaacatgatgcaatcataagcttgagactcttatcttaataatgaaattaaggtggaaagtgcagtggcaagaagcctggactgatagaagactgacaactaagacttaatattggctttaccattaaccagctgctgactaagggtaagtcactgagctacacatcacctccctgggcctttgtttttccatgtctaaaataaatggctccgccaggcatggtggctcacacctataatcccagcactttgggaggctgaggcaggcagatcatctgaggtcaggagttcaagaccagcctggccaacatggtgaaaccccatctctacaaaaatacaaaaattagccaggaatgatggagggtgcctgtaatcccagctactcaggaggctgaggcaggagaatcacttaaacctgggaagcagaggttgcagtgagccgagatcacaccattgcactccagcctgggcaacagagtgagactccatctcaaaaaaaataaataaataataaaataaaataaataaaatgaatggctcaatcaattctcaagggaaggtgtatcagactctctgaggatgttattttttcaaactccatatttgctctcttgcttcccctgaagacactgatatattcccttccaccccacctgccttgagaattagtacaggtaataggacccattgctgatggcagcaggttacgcttgtaaatgctgtgatgatgtggatagaaaaagtctgaaaaaccactggactgaattacctttaagatataaaattactatcaaagacagaaccattccaatcatgcatgcatgataaactggccatctctctttcctttccatcaggtactccagactttttgtctctataccaaggcaaaaagaatgaatggaaaagttcctagtgctcaggttaagttacactgtccctcaaggtcaacagcagctctgggccagcttgtttatcacctgaaaacatgcgttaacaattccataagctagtgccctgggccataccatcgaagatgaaatccatgtatttcactctttagaaaaaccctagaaggacaattcttacgtgaacccattttgtaattcagaagcagcaaagggaggcctgaccaatgaaattcttgccaagaagatgagaaggttttattttttgatctagagtcttgaagaaacctgctacgttttttggatccaagcaagtattcttatttgaacgtgatctatttgtttaccttatagccaaacagaaagagtccaacaaaaaggctgtagaggtccgctgtcaggatgcccaggttgacggaagtggcactagtgactttaatcaccaatggcatgaagctgtacaggcaaaacatacacagggcaaatgccacgaacagcagggctgtggaaaaaaacatggaatatctaatattagggcaagaaaacataagacaaaggagtttgaggcttagctgtcatataaaactccctaaccctttaacatattatgtacaaagccccttgttaacagtcagcattgaaaatgagaccataaagctctctcgaaaaaagaatataaatagcaagttgtgatgtagataaaggacctcaaaaaatccaacaaggtattggatgatcaaggtcagaaaatcctgcttatggtgtgacagtccattgctcttaatcaccccttgctatgcaccctgccaggacagcgatgcctgtgataaaaggccaataaaggcagaatcaacatctcatgtcaagaaaaatcactcattatgttttctttgcttttgtttggttggacatgatttgtataattggattcagaataaagtatctttaaagacatcaaagacagttattaggtccattgtattttgttcatctcattaaattaagtgctccgaggcagcacaatataattatcctttttaggacagtgcttgccacgtggatgttgactacattagcagtatctctgctttgcaactacttctttaatctcatcccatactcaacacacacacacacacacacacactttctagcaatctaagttatttttatttttatttattttttttgagacggagtctcgcactgttgcctgggctggagtgcagtggcgcaatctcagctcactgcaacctccgcctcccaggttcaagtgattctcctgtctcagcctcccgagtagctgagattataggcgcccgccaccatgcccggataatttttttttttttttttgtatttttagtagagacagggtttctccatgttggccaggctggtctcgaactcctgacctcatgatccacccacctcagcctcccaaagtgctgggattacgggcgtgagccaccgcaccaggcctgcaatctaagttatttaattgaattaaattaccaaccatggtagacaatcttccatgacacctatgtactgtttaacttctccccaccccatcattaaaccaggttccaatcttttctgactgtcccatcaccattttcttttcctttatttatttatgcagatgcctaggaatatcagatgacaggagcaatgggaggtgagggagatttcacaccattgatgattcaggttaatgcttcacaaattatatcaagcagacaaccttcgcaagaagtttgaggacccaagatacagatctaattgaaagctggtttgaccaaaggtcaatctccagtcttgttcaggattcctagtaaccaaaggctattcctgcaggtaaagattaagaattaacttttatggaagcttatctaccaattttcagagaaaactcaatgtaaaccactatagttgatatgtattaaatcactcctggattttacaaagacgtctaaatattattaaaataaagcacatatttctagatgttcatttgtttgttaaagaatgctgactaaaaggaattatttctttacataccaattttccagtcccaatgaatgctggcaatatccttatattccacaatcaatctaagattaaaacaagaggtcacagagaggtccacatactaattttcactattttataagcattttagtcactatacttcagctaaagtgaggaattacatggacatttgaatttgtcttagaatataaaaataacgatctttaataaaaatgacaaagaataaaaccaaaggagttcataaagatatgtttgactcccttacaggtgctctgaaataatagtcaagtataggaggaaaatatgatattatgctttgtttttgaataagcttaggaagttaatgtgttaatattttctggaaataactaaaaaaactccttactggcaaatgcctctaccacatggtaatcaggaatcctaagcaacacacatgtttaagaaaataggaagtaattcttgatgttttaacaatcctctagtagacactcagcaagttattaggtaatggcaaaaccacaattactcttgcatccacctaatactaattccaaatgtgaatttgggccaaataaacaatgaatattagtagttatcatctataatatatttgcttattttgtctttagaaaaaaattgtagaatcttacagctgtataccactgataattgttccaaacaggcccaccattcctaaaaactcctgtctgctcagcttcttcacgatgtattcctcacaaacatttgaaatggcatagagggaagccccaagaaggaccaagatgtcaccaatcaatacatcactccctgcaggaagacaagccacagaaagcaaaacactgtcaacagatgaacctccacagcgtgcctccaggcggtcatctgactcgtgttcatttaaatgacactaaagaagaagaaactggttactagaagtttatgtgtgagagtgtgtgtgtgtgtatgtgtgtgtgtgtatgtgtgtgtttgagacagtcttgctctgttgctcaggctggagtgcagtggcgcaatctcagctcactgcaacctacacctccgggttcaagtgattctcctgcctcagcctcccaactggctgggattacaggcaccctccatcatgcctggctaatttttgcatttgtactggtcttgaactcctgacctcaagtgatccgctcaccttggcctcccaaagtactgggattacaggtgcgagcgactgtgcctggcctaatttttgtatttttggtagagaccgaggtttcaccatgttggccaggctggtctcgaactcctgacctcaggtgatccacccaccttggccttccaaaatgttgggattacaggtgtgagccaccgcacccaacctggttactagaagtttaaaatctcttactcttctcactttctggtgcaattctgctgtaatttttcataatttaactcctcagaagtctaacaggctagaaactgatgatatatatcataatgtaaggcctcagaaaatgattccatgacatgacaaattaatggagttcattgaaggggtaggtcaatttgaaaaatgggaacctgctttcaaagtaattttccctctcaatccaaagagacacttaactcacttgtagactgggtgaattcacagaccttaattagattttatactatcaactataattttctctctcaatccaaagagacacttaactcacttgtagactgggtgaattcatggaccttaattagattttatagtatcaactgtaattttctctctcaatccaaggagacgtttaactcacttgaagattggatgaattcatagacctcaattagattttatactatcaactgaattcaacacaaagtgtggcaaagtgttctcacctacacagtgacttaaaaagaaatactccagtaaacaagtttctttgttgatataaaagtgaaaacataaacaaatttgctgtgattgaagcacaaacatgtgacaccgtctcacctgaattgtcttccctccctgctagtatgtctgcaccaaccatggttcctacacccaacagacagacagccacggcgatgaagtggatcactctgtatcttgcatgaagaataaaccatgacagagccatcaacacaggaatcccaaagcaatccaaaagctgcatggaaagagaatcaacagtttaaaacatatctctcattagctaaaagatgggtaattaagaaataataggagtcagtatttataataggagtcagtatttattgagcatttattattgccagccctgtactaagagctttacctggattcactcatttaatcctcacaattccatgagactgaaattacaatccaattttatacatgagaaaatgaagatacagagaggtgaaatgagttgccaaaaacacatagttaaaaatgggatgacagctgggcacggtggctcacgcctgtaatcttagcactttgggaggctgtggcgggcagactgcttgagtccaggagttcgatatcagcctgggcaacatggtgaaaccctgtctgtacaaaaaaaaaaaaaaacaacaacaaaaaaaaaccttgggtgtggtggtgcactcctgtagtcccagctacttgggaggctaaggtgagaggatcacttgagcccggagttcaaggatgcagtgagctgtgatggtgccactgcactctaggctgtacaacccagagagaccctgtctcaaaataaatgaatagataataaaatacaatggaagagtcagttgctgtatacaagaattctgctgagggcctgtgcactttacctctatgctcccacctgtgtatatcttttcttttattttattattattattttttttttgagatggagtctcgctctgttgcccaagctggagcgcagtggtgcaatctcggctcactgcaacctctgcctctcgggtttaagcaattcttcctgcctcagcctcccaaggagctgggattacagccatctgccaccatgcccagctaatttttgtatcttttagtagagatggggttttgtcatgttggcaaggctggtctcgaactcctgatgtcaggtgatctgtctgcctcggcctcccaaagtgctgggattacaggcgtgagccaccacgcctggccctgtgtatatctttaagttcagtagacaaacattccttcctacctgcaaccatttactcagtcaacaaatatttgttaaacaccttgcatgtgtgagacactgtgaaaggagctaggaatagcggtgaacaggacagagcaagctgtgtccttaggagcacacaaagctagaaaggacatggaataaataatcacaccaccagatatttcactggaatcgggctaagcgctacaaagaagcatgggttactgtgagagaacagacaccatctccctgacaaagcgtccaaccccaccatgtgagacacactcgtgctcatggcaaatactcttgctcatcctcctcacatgctccccctcacctgttgatactgggtccagaaaacactagctatacacctgatattgctcatctggaaggcagagggattaagtgtgccaaaattacagcaggtccaaaattgtttgcaagataaaagataaaaaagagagtgcactcactcaattcttaaattcacaaatttaatgtgcattcaaggataaaatatattcaagagattcttgatgcattccaatgtatttctttcaaggaagaaatatattccttataccagtaatattcccgaaactgctgttttattgctcacccttttgttgtttcaaaccttgtccctgattctctctgtatctgtttggtcttgaacaagacaggcccctaaatctccaacagcccattcgatcctgtccacagttgtttactgattgcctttcactgcagtagcatcagtggagtccaacgcatcatgtgtaggaatgggcatcttgccttgttatttattccagctgcagaactctaatctcctaagtgctttattgagcctgcctgaataacaaaacattaaacgatgcaaatgataataccctgtccctgaagacaccagcagaatccagccataacggcttaacaaaatctcaactacattccttaaacaaaaaaagtagaaaaagacattctaagaactaccacagaagagtcccttgtgtcttaaaatcaaacttaaatttgctctatctttaacaacttttgttgggcaatgagggagatgcctatgtcatgatcagagctccagaaacctcaggccccggccccacgctgaccagctagctgtgtggccccagccagtcactctccaagtcaaaatataaaataaaaagatcagacgaaatgatcacacagtttccctccgactctaacattccatgacttctcatctgatatctatcacctttagtcatgtgaaccttcttttcaaaatgtattcttggtggccgggagtggtggctcatgcctgtaatcccagcactatgagaggccaaggccggaggatcacttgaggtcaggagttcgagaccagcctggccaacatggcaaaacctcgtatctactcaaaatacaaaaaaaaaaaaaaaaaaaaaaatcagctgggcgcatgcctgtaatcccagctactcaggaggccaaggctgcagtgaaccaagattatcccacttcactccagctcggtgacagaatgagactccacctcaaaaaaaaaaaaaaaaaaaaaattagccaagtgtggtggcgcgtgcctgtaatcccagctgctcaggaggctaaggcaggagaatcacttgaacctgggaggcggaggctgcagtgagccaagatcatgccattgtactccagcctgggtgacagagcaagactccttctcagaaaaaaaaaaagtattcttggtgatggatgtcttctctgtttcagttcgaagagtatcaattttatttttaaaaattattgtatagtcacagtaagcagagtactaagacagaccctgcgacatgggtataaaaacaagttagatcatattagaggtacaatagagtatagaagagaaaatgaaaattgaattaacctttgacaatgaggggagcaggcttcaaaaaggactgcattctaggaagaacagagcagcacaggggagaaggagcaggccatgagtgggaaatgggttgatgtggcagtaaagtgggaagggacatgagcagcaacctgggccacatcatcatcttcacgtgaactatcccatgactgttggtaattacagaaccttctaaggaatccttaagaagaaggttcaaagaccacctaatccagatttccatccttttggactacccaggccagagatttactcagttggagaaccagcttgaatcattcctatcacagctgtcgctgctgctggagaaaacattaccttgttagatgccttttttataatatattctttgctaggaccgtaagtgcatgacttttggcaaccaaatgcttaggtttttctaagaggctagcgtgaaagaaattgttttcaatttctttgaaattgaaagaaggcatgaacttcagtcgcaactatccaactgtaagtgttctgtttaactgtgtttaggccttgcaccaattcaaaactttttatcattagttagagatcaaagttcctgggaattgtaatcaagtaattaaaatgtaggtgagattatgagagtagatgtgacaagaaaataccattttctacatacttatgtatacttcattaaccaacgctaaaagtacacttactcctattagtgataaacttcattctctaggtaactgctgggtttaatttttacgaaactttaggttctttttgtgcctcctatagtgtctgtcttaataaatcatttcctatctcagctttttaacccatactggtcaaaatccaagaggtttcctgagaacaatgcttagcacaatgttacagaaaagaaagtagttaatataatggtagtaacatttaatgtaggttcacactggaaaaatactgagttctcatcaatccttatattttctatgcgaaataagtctaatttcaatttttccagtccctaaaatttggagtcaagtaagaacatctctgtattttgtatagtgagaaagggacatatcaaaaagttataaacttcaaatcccacatctgatacacacttttttttattatttaaaaaaatgaaaaaaaagttataaacaaactgtgacatctaaacctggcatttgagtctatctcactttcacctccacttataaaacattttgtagtcagtaatggtgagtcagtgttaggaaacatcccatagtttgctaacattaagacaactgaaatcagttgtcttcaactttacaaagttgaaaacctctgcaatgtaggaatatttttctttcaatgcagcaagaataaacctaacaaagaaatagggatgggagttttaactctggctaccacctctcccaaaaatgtctactgggtttcttccaatggtttctttgtcatgaatatctactatgcttgcaaagcttcaactttcctatagaacaaaggtatactttcatatgccatgtttgagcagcatataaaacagaacacgtgtcaacaccacagcatcaactgccaactaaatatttatgcttatttggtaggaactgttctaatctgccatagcagtttgggggcagcttaagttgtatacattttcactaattctaggaaacattactcattagagcatatgctctactagaaaacagcatccacctgtgtttaggttttcttcaagtgaatagattttcaataaaattaggtcaacacatatgacttcgtgttcttcttttgaagctataaaatccaaagtggtcagagggctccctcttacctggacactggttagagttgtgtactggtaggctctgacgatcacataattagcttccacatctgctagtcccagcaggatgtacttccaccattttcttttcaagattactaaaaggttatcactgcctggttgaaagaaatatgggttagtacatgttacttgcaaatgataccatacatgttgatttgaagataaaagagtagaagcaagagtttcttgtttttttttcttttttcttcttcttctttttgagatagggtctcattctgttgcccaggttggagtgcagtggcacaatctcggctcactgcaacctctgcctcctgggttcaagccatcctcccacctcagcctcctgagtagctgggaccacaggcgtacgccaccatacccacctaattatttttgtatttttagcagagatgggggtctcaccatgttgcccaggctggtcttgaactcctgagctcaagtgatctgcctgcctcagcttcccaaagtgctgggatttcaggcgtgagctaccacgcctggctattgtgtatttctaatgtggccccctcctagtttccattcttcataacccaaactcctgcaacagctcaccagagttagatttttttctagcatgaaaccctagttaaagtatcatcagagaccaagtgttcaataaaagcaccagaatgaaagtaagagaaaagtggttaaattccctttcccaaatgggcacagtggtgtgcacctgtaatcccagctactcaggaggttgaggtgagggcagaggacagctggagcccaggatttcaagaccagctgggcttacataatgagactccacctctttaagaaaaaaaagagggagggcagggcgggagaagagcattaaggaaaagagctaatacatgctggacttaatacttaggtgatgggttgatagctgcagcaaaccaccatggcacgtttatctatgtaacaaacctgcacattctgcacatgtatgctggaacttaaaaaaataaaatagtttttttttaaaatccctttcctatcataacagaaacaaaatttctggatatgagcttgtatgtcgccacttctgacaagccacggactatcctaggaaatgaaatgttttcctagaaattaattggttatttaacttctattcatgggcttcttcaaagaaaagtctgcaggtgatcattcttttggaagaggtgtgctttcaagtgaaaattaagtcctcgataagcttgagaaaaggcttagtgcacactgaagaaacaccttttattcctccaaattatatgtattcaaattaattggattcactactttggagaatctgtcatcacaggagatgcagagttggcacatatatgagaaggttttatggcaagataactcacaaataaataaaagtagtgagaatcataaccaaataattatcagtaaaatccagttagcaggaacatcttgaaaacacagaattaggccgggtgcggtggctcacacctgtaatcccagcacattgggaggctgaggtgggcagatcacctgaggtcaggagttcgagaccagcctggtcaacatggagaaaccccatctctattaaaaatacaaaaattagctgggcgtggtggcaggtgcctgtaattccagctactagggaggctgaggcaagaaaatcgcttgaacccaggaggcagaggttgcactgagccgagattgtgccattgacctgaaatcgtgccactgcattccagcctgggcaacaagagcgaaactccgtctcagaagaaaaacaaaaaacaaaacaaaaacacagaattagtcttcctcagcatcaaatggcataggaagcacctaacaaccatcccttagggagactaactgcactgatacatttgggagtctcaccaaattcctgaaggccaatgcttccacaaagagcaaagtccagggttattaaccatgtacagttccactcccaactcttcttttttttcctttggagacagggtcttggtctgtcatttgggcttgacagcagtggtgtgatcttggctcactgcaacctcagcctcttgggatcaagccatcctccacctcagcctcccaagtagctgggactacagggacatgccatcatgcccagctaatttttgtattttttgtagagaaggagtttcatcgtgttgcccaggcttgtcttgaactcctggcctcaggtgatcctcccaccttgacctccctaagtgctggggttacaggtgtgagccatcacacccagccctaaatttcaataaagacttttagatagctggtgcatgggatgaaataaattactctaatttcctaagtgtgcacagtgctgtccttgttcactggattcactaacctttgcaaggctttttcttctgctatgtcagccacacgattcaaaagcaagtagtaaacttagaatcagaccttcaaacccctttacaacaaagggttaaactaaagttttaaaaaataatgaagctggacaggcacctataatccccgcactttgggaggccgaggcagacagatcacgtaaggtcaggagttcgagaccagtctggccaacatctccactaaaaatataaaaattagccaggtgtggtggcacgtgcctgtaatcccagctactagggaggctgaggcaagagaatcgcttgaacccaggaggcagagattgcagtgagccaagatcacgccactgcactgtactccaacctgggtgacagagcaagactctgcctcaaaaaaaaaaaaaagaagaagctgcagctaccaggagtttgtggggagggagggaggaatgaataggtggagcagagggatttttaaggcagtggagctgttctgtttgatactgtaatggtaaatgtatgcattgtacatttgtcaaaacccatagaatgcacaataccaagagcgacccctaaggtaaattattgactttggttaataacaatgtatctggctgggcccagtggctcacacctgtaatctcagcactttgggaagccaaggtgggaggactacttgagttcaggaattcgagaccagcctgggcaacgtggtgaaaccctgtctctacaaaaaatacaaaaattatctgggcacagtggctcacgcctataatcccagcactctgggagggcaaggcaggtgaatcacttgaggttaggagcaaggtaagacccggactccactaaaaatacaaaaattagccaggtgtggtggtgtgcacctgtagtcccagctacacaggaggctgaggcacaagaatcacttgaacccaggaggcggaggttgcagtgagccaagattgtgccactgcactccagcctgggtgacagagtgagactctgtataaaaaaaaagagagagagacctgagctacacgtgcaactgacgttccatttaccatctttatttagttggaagtaaatattttggagagtaaggttcttgactttaagtgtttttaatatcatcttaatattttaaaatatttttaaaattgggggggaaacctaacttgtaatgacatttacactttttaggttgggtccagtggctcacacctgaaatcctagcactttgggaggctgaggtgggcagatcacttgagcccaggagttagagaccagccagcgcaacatggcaaaaacccatctctaaaataaaaaaaaaaaaaaaaaattagccaggcatggtggcacactcctgtagtcacagcttactagggaggctgaggtaattggatcacttgagcctgggaggtcaaggctgcagtgagtcgagattgcaccactgcactccagcctgggtgacagagtgagaccctgtctcaaaaacaaacaacaacaacaacaacaacacacacacaaaaaaaaaaacactttttttttggacaacttctgtgttacaaacagtatggtgctacttactttaatcaacaatttcagagaattgtgcataagtctccagtcactactttcacagaatttagaggtgtcatacttttctagtaatttttatgaagataattttgttgaaaagataatttccacatttgacatacctgatcgaaatgccagcatcactgtataaattaggaacagcaagcaataattgataaagctctgaagcatgggggtgttcactttgtatctttctgccaaatactggctggtgatggctgtcccacatatacacaaggacaacatctgacccagggcaattgttttcaaaatattcctagaaaataagggaagaaatcagaacagcatgcaaataagttataccttacacacacacacacacacacacacacacacacacacactgctaaacacaaagggaaatgctaattattccaggtggttcttcatttcatgaaataaaaattaaaatgttagttactgaaggactacatttttattctctatttttctgatcccctccattcccacaaaagcatattcccccatttcactgaacatccatttagagatcattttgattactcagctataacatatactttgtaaagtgcgcacgtgtgtgtgtgtgtgtatgactttttttttttgagacagggtcttgttctattgctcaggctagagtgcagtggtgcaatcacagctcactgcagccttgacctcccagactcaagcaatcctcccacttcagcctccaaataactgggactataggcacatgccaccatgcccagctaattttttttttttttttttttgtggagatggggtttcactatgttgctcaggctggtctcaaactcctaggctcaagggaccctcccacctcagcctcccaaagtgctaggatttcaagggtgagccatcgtgactggcccttaccctgcatttctaacatggaaactaattaaagaaacaagttgactgagacagaagaggctaaaataatacgtattttctggatcagataattggatagatagcaatatggttaaccaagatcctaaatgcagaaggaaaaggcatatttggaaaagataatagctccattttggacatgctggattttgtttaattatgagacagccaagaagaaatgtccagtaggcagcttggagctggaagaaaggattggattggagaaataaacttgagaatcatgagcataaatgtggtggctgaatgtgggaacataatgagatcactaaggcgtataactaaaaattgggaagaaaagagcaaaaaagaaatactgtgggaaacagcaatatttaaagggctggagaggctgggtgcggtggctcacacctgtaaccccagtactttgggaggccgaggcaggcagatcacttgaggttgagttcgagaccagcctggccaacatggtgaaaccgcgtctctactaaaactacaaacattagcggggtgtggtggcaggcgcctgtaatcccagctactcgggaggctgaggcatgagaatcacttgaacacaggaagcggaggttgcagtgagccgagactgtaccactgcattccagcctgggtgacagaatgagacgacaaaaggaagaaaggaaagaaagaaaagaaaaaaaaagaaaagaaaagagctggacgggaaagactcattagagatggagataagagggcatggccagagaagtaaagggagaactaggaaggaagaaacaatctggaggcctagagaagatggcgtttcaaagaggaaactttttctaagcattcttcctatcctactctcattctacccaaatccagtctccacactgcagcaggagtgatgttctgagtgttaatatgatgagatcatttctcatgtctaaaacctttcggtggctggttcctctctggccttaggtgaaagccacactttaaaatggcctacaggcaacccaccctctgaatctccagcctcaccttgaactactctcacagcttatttcatttttaatttttactatttcttctatctaacacacaacaaagtatgtataatgtataatcaacatgtatccgtgtatctatcacctcaaaaaataaacaatttgccaggcacggtggctcacgcttgtaatcccagcaactttcggaggctgaggcaggcggatcacaaagtcaggagttcgagaccagcctaaccaacatggtcaaaccccatctctactaaaaatacaaaattagccgggtgtgatggcatgcacctgtagtcccagctactcagcaggctgaggcaggagaatcgcttgaacccgggaggcggagtttgcagtgagccgagatcgtgccactgcactccagcctgagtgacagagcaagactctgtctcaaaaaaaaaaaaaaaaaaagaaagaaagaaagaaagaaagaaagaaagaaagaaagaaagaaagaaagaaagaaagaaaaagaaacaattgtcagctgggcatagtggctcacgcctgtaatcccaacactttgggaggctgaggcgggtgaattacttgagcccaggagtttgagaccagctcggcaacatgccaaaaccccatctctactaaaaacacaataattagccaggcacagtagtgcacgcctgtaatcccagctagtggggaggctgaggcacaagaatagcttgaacccaagaggcagaggttagagtgagctgagatcataccactacaaaaaagaaaaaaagaaaagaaacatttggcaacatcgaggtatcccacctgtgttctctctaatctcttagccctcttgaggtaactaattagaacttagtatttattattttcatgcttttctacatattttaatatttatgtaagtatccctaagcaacaaatagtattgtttcaaaattttatacaggcggcatcatactgtatatacttctgcaattgtggttttgatcaacatggtttgagagggccatccatattgatacatgagttcttgttcttccttttcagtactgtatagtactctaccacatgactacatcatgctttattgatccattccactgttgatgaatattttggttgtattcctttttcttttttgttttcatatgtctcttgatgtaattttctaagagttttttctagtttttagccaggtggtagaaatggattacagatggtgaggcgtggtggctcacgcctgtaattccagcactttgggaagctgaggaaggaggattgcttgagcccaagagttcaaaaccaccctgggcaacaaagagagaccctgtctctattttaaaaaagtgggggggtggttatagatatgctgagatttaatctcctcagtactcaggatgacctgatgggagccatctaaggcatctggagagattccagccagttgcattctgctgggagcaggaaactcagagtgtcctacaaatataatgactttctatttctatagtaaagtttaaaggaatcacttgctctggagatatatccaagaacagaattggacgagatggtgtttgttcttagggcatgagcatcttcagtttcgttttcctagattgctctccaaagggttatattacttcatgtagctgagtctggtactctcaaaagtaaggaatctccactctccaaagggaaggtgatgatgtcaagaactggccaaatccaaggacactgtgttaggttactggaggaaattttcaccaagatgagcaaaacgttaaggatttcctcccctacaggtagcattctttctaagcatgctctaccaggcaccagctgatgagctaaaccagatccagagttgctatctccttctcttgtgcacacttcctcttgaaggagtcatggtttgcattgattcgggtctgaggctgccctatcctagacaaaggaaattcaccacttagtccggtatagtgcaccaggagtctccaggaatgtggggccaaagccaaaggctgaaaaagttcattcattttgtgtcattattcccagccatatgcttctctcaggaaccatgtggggagaggtacctggctgaggaaatggttccgatttccctatatttcattgttcaattaatacctatcacagctcacaatctcaataacatgatcctgacaacagccctgagaaaagtactattgcactcatgttacagatggagaagatgactcagagtgggtccagaattcacccattgtcatactgtccgtaaaaggcagaagagatcagtgctcctattaaaagaccagatcacaggattcaaatttgcttaaaggtggctcacacctgtaatcccagcaatttaagaggccaaggcggatggattacccgaggtcaggagtttgagaccagcttggtcaacatggtgaaacccagtctctactaaaaatacaaaatttagctgggtgtggtggtacacgcctgtaatcccagcttctcggaggctgagggaggaaaatcgcttgaacctgagaggcagaggttccagtgagccgagatcataccactgcactccagcctgggcaaaagagtgagagtttgcccaaaaaataaaaaaaaaaaaattgggagagagagaaaagaaagggagggaggggaaggaaggaaggagggagggagagagggctctaaggaaacttcctctcttccctggaagtctcagaattgcagaaccttggcactaacccactttaatcaaggagactggggcccagaagagagtagtgttttgcctaagatcacacaggagcagtgttaatgcccaaatttcctggccattaaacatctgctatccctcctacagcacacagtcttgggataacaggtgggtcatccctcacagttggtatcttcctacgttctatatctctttctccttcctgtccttcccctcatccctctcttcccctcctgtatctctccattatgattttataacagagtttatattagaaaaccccttcaggctgggcgcagtggctcacgcctgtaatcccaccactttgcaaggctgaggcgggcggatcacttgaggtcaggagttcaagaccaacctggctgacatagtgaaatcccgtctctactaaaaatacaaaaattagctgggcatagtggcaggcgcctgtaatcccagctacttgggaggctgagacaggagaattgcttgaacctgggaggcagaggtttcagtgagctgagatggcgctactgcactccagcctgggcaacagagcaagactctgtctcaaaacaaaacaaaacacccttcttcaaagcatccctgtacctcgccttgctgtcaggaaagaaggaacctggcctgatctctctcctcccagtagtcacactgcttccctgtacatcatgggggagttggatgtccaaagtaccaggcacagaaaccctaaccaagtggctgataacctaatcaaattgagagcatttttcacatctcataatggacttgaaagcaattataaatctgaaataagtgagaataaaaagtgtggaagcattaagccctcttcacaaattgacagaattcctacagtaagctcatatctgcattctaaaatagcacaattaagcaagctgtcctccaactataaagtaaaactatcttctaaaaaaaggagagtcacaaattgagtatggagatttaaagttacaggaatgcacttctcttggctccaaatcataatgacctcatctataatagaggagtaggagagcaagagtgagagagaaaagctggcggggagggggtaggaaattgagcaaaggaagaaagaagacaagaacactcaaacttatagacactgaaggcctcaaaacaatttttgttacttatagctccactttcatgtttgtataaatttgtacaaggtcctggttcatgtgaattctgaacagaggaaccctctataccataacaaaacctgttcctgtttaagcaaagctgccagaagaaacatgcatctgaccttgggatatatcctgtcccggttttactaacggaacctccactaaaatgaacttcaatggcaggatatgatccaactccaagacaaatttccccaaggcagcttcacactgggggccaggctaccagaatacacagcaaacaagagttatggatcactgagggcaggagtggacaaacaggtagaagatgggctgagtaaggtcacttccaaccacattactattagaatctattttataactttaagaatttaaggcatgaggccaggcacagtggcttatgcctgtaatcccagcactttgggaggccaaggcaggcggatcacttgaggtcaggagttcaagaccagcctggccaacatggtgaaaccccatatattttggaaaaatacaaaaaaaattaactgggtgtggtggcacatgcctgtaattccagctactcgagaggctgaagcgggagaatcacttgaacccaggaggcagaggctgcagatcacaccactgcactccagcgtgggcaacaaagcgagactccgtctcaaaaaaaaaatttaaggaatgaaagaagaaaagatcatgtggcactttacttcactccttctttcttctaggaaacttaaaatgtatatcgtaacctcccttccattccaaaatagatacttatgtacctgatttccaatgaaaatatatttttatttacatcttcagtcagtaagctcctcagtcatatattcaccaaagttcaatggttgttaatatgtgccaagcacaaggaatttagaattaagactcacctattttctagtcccagaccctctttcttctccccagaacacatcggggagctccactgtgtgcccccacaaaataccacaaccctccatcacagtacccaccacacactgttctttccccaaaactctaagctccaggaggaaagggacattatattctccatgattaatagtgcctggcaaatagggtatttgctattgttgaacaacctcagaagttttctgtgtgaggagtcagacagacctcacaacacaaaaccacaataaaatgagaaagggttaaaataagagttgtgcatgcagccaaggagaaggaaagctcaagatgtcctggagaaggttcacagaggagtcaaaacaatcacacacctgaaaggtattttaggaagattgaggaatgcaggaaaggccataatacaagtttgtgcctaatttaaacactagttttacattatatatatatatgagacacaatgatgggatgcattcatatacacatatatataatatatatatgagacacaatgatgagatgcattcatttctttagctcttctttatttactatttcaaattagataggcagtcctctactgattatatatttaaaaatcactgggctttaaaaataacactgacaacaagaccccagcccaaaccagttggatcagattctcagagggtagattccaagtatcagcctattttaagtctcccagatgagtctaagacatgatcaggacggcaaaccactaaattattcttttctttttatttgaaaaaaaggagttccaagtgaccgataagatgcattatttgaatgcaaattatgcattcccttcactttatgtctcaataaatctgtgctgctaggttgcatgttgtcagctaaaggcaggatttcatattagtgctaagactcctatggaacatagttacttgggggagattttaaaatccattacatctgccacctgtaaatacctggtaaagaataataacttccagtacgtctataaaaatcctattatgaacccaaaaagaaatatacatttaggccaagttctcgcactctgcacataagctacccagtttctatttctaaagcattttaaattatatcggaagcatgtttagaaataaattataagtagtttttggtcaggcactgtgactcacacctgtaattccagcactttgggaagcagaggtgggcagatcacttgaggccaggagtttgacaccagcctggccaacatggcaaaaccccatatctactaaaagtacaaaaattagtaaggtgtggtggcgtgcacctatagtcccagctactcaggaggctgaggcaagagaatcacttgaacccaggaagcggagtttgcagtgagccaagatcatgccacttcattctagcctgggcgacataacaagacagtctcaaaaaaaaaaaaaaaaagaaaaaagaaaagaaataaattataagtagcttttctttacatagtgagtagcagccaagatgaactgttttctttccatctccatagtcctacgattcaaaagtttagccatcaatgtatcatctaattctagtaagcatgagtagcttgcaattgtgaagaacctacattctgttagtcatattcaaaactcaaagtagctaaaaaagtcaaattttaaaaaatagatagtgtattggtgtatatgatcacctcacaaagaaggcaagtaaaagaaaggaaatcagtgttttctttttgctcactggatgatgtcttactcggaataggtgctcagtaaatgtttattaacaaaaaatgcactattatgaagatggcatcatgttaaaatgcaaggcagacaatactgtagacaagaggccctcaaaagtgaactcaatgaatgttacagtggaaaaaatacaaactccagagttagataaaactgggttctggatttaaatttgaaacatgaaagagaggagaaacaggtacaggcaagtgaaaacagtggttcacaccatgtgctgttctggaaaaggctagtagagagtgcaatttggatgtgaccttcaagaaaagattattccttctgaacatagcagaaagaatcctagtctttgaatccaaagatctaactctactctttattagtgttaggtagttctcttatgtcttttttaagtgagtgtaataccacctttatgcgcctaagggttaattgatgtaacctataaaagtacctagcacatccacccacctgaggcactgagtgcattttatttccttccttcctctggctcgccctgtcttttggtaacctcttgaccatacctgtctattctatatatgcaccatccaatagagtagcctctacccatatgcagccattgagtgtttgaaacatggctctatatatgcaccatccaatagagtagcctctacctatatgcagccattgagtgtttgaaacatggctaatgtgaatgaggaattgaatgtttaatgtaatttcgtttcaacttaaataaaatagccatatatggagaatggctaccaaattagacagtgaagccagggatcagcattgtgcaatactgtagatgttaccacaacgatggaaatgtttgaaaagtagttcttgagcacttcaaatgtggctagtataaatgaggaactgaattttttgttttattctattttaattcattttcatttaaataaccacatgtggctgggggttatagtattgaataacacagccctagcctggtgcttctcaaactttcatgtgatatgaatcatctaaggctcttgttaaagtgcagcttctgattcagtaggtttggagagaggcctgagattccgcatttctttctttttttttttttttttcttttttttttgagatggagtctcgatctgttgcccaggctggagtccagtggcacgatcgcggctcaccgcaacctccacctcctgggttcaagtgattctcctgcctcagcctctccagtagctgggattacaggcgcctgccaccacacacagcttatttttgtagttttagtagagacgggtttcaccatgttggtcaggctggtctcaaactcctgacctcgtgatccgcccacctcggccccccaaagttgttgggattacagtcgtgagccaccgcgcccgacctgagattccgcattcctaagaagctctcaggagatacttatgctgctggtccacggaccagactttgagtgagcaagggtctacagcaatgcttctgattctgaggtctctcaacttttaggaatccgtggaagaagtgaatgcaatccatgggctgttcaggatctgtttttgacacttcaaaaacttaacagtacttctgactgttgctggtaaaagcgtaaaataataaatctctatttcagcgggagagtttgggggtgctgatttgacaatttctagcaattttgtctcaaggaatctaccccaaggcaactctggcaaaaatacaaaaaggtgtatttacaaagctattcattacagcactatttatactagcaaaagactaaaggaaaaaaacaaaatgtctaacaatgggagactagctgaataaacacacaggagtactactgtacagctataaaaagcaaggcacatatttatatgtactgttataaagtgactgccaggtataccttttttaaaaaggaagcaaatgtggagaaaaatgggtatggaatgcaaatatttatctataatttgttaattttttaaaaggaaagataaaactttttttttttttttgagatgcagttttgctcttgttgtccatgctggagtgcaatagctcgatctgggctcaccacaacctccgcttcccaagtagctgggattacaggcatgtgccaccacgtccaaccaattttgtatttttagtagagatagggtttctccatgttggtcaggctggtctcgaactcctgacctcaggtgatccattctccttggcctcccaaagtgctgggattacagacatcagccactgcatccagccaaaacaaaactttttaaaagttgtgtatagggaggacagcagagggagcaaagtaaaaggtgtatgtctgactataccttgttttatagatttgcctttgaggccatgtaagtatgttacataacttataattatgtaaaacaaaaattaaatttaaaaaagccacatctaaaataaaatttaaaataaacttgatgttttaaaaattggtagcaaaacctgacaggaattatttcaagggactttaaaatatactaatttgatagtacactcctaataaaatataccataggatcaaaaagaactgtacaatagcttaaactgttttgatatggtgttgatattattctgggagtatttacaaatactgtggaatacagaaaataagaaaattatattgatggaagcccctttaacctcttctggttttcagtgctatgtccccctacaatatgaatattgtatatacatattgatatatgaatatcgtatatacatacatatacaatatgaatattgatgtattcattgggatatatagaaaaaagatgaagatgtaagattgaagaggttgagttaaaaaccttatagttttgaactttactgaaaggtacaattgactcatgagtacttcgtagtatgtcatgagtatttcataacatatacatatatatatcctatctctttcccctaaaaagctctgaaacaatgactaatccattaattatgaacacccctagtgcctagataatggcaactaaatactacctcccactaaaaagaactaggagctgggcgtggtggctcacacctgtaataccagcactttgcgaggccaaggtgggtggatcacttgaggtcaggtgttcaagactagcctggccaaaagggtgaaaccccatctctactaaaaatacaaaaatggctggatgtggtggctcacgcctgtaatcccagcacttcaggaggccggggcgggaggatcacctgagctcaggagttcgagaccagcctggccaccatggcgaaaccccatctctactaaaaatacaaaaatcagccgggcatggtggcatgcacctgtaatcccagctactcggaaggctgaggcaagagaatcactagaacccaggaggcagtggttgcagtgagccgagatcgcaacactgcactccagcctgggcgacagagcaagactctgtctcaaaaaaaaaaaaaaattagctgggcgtggtggagcacccataatcccaactatccaggaagctgagggaggagaatcacttgaacccaggaagcacaggttgcagtgagccgagattgcatcattgcactccagcctgggcgatagagtaatactctgtctcaaaataaataaattaattaattaagtaaacaaaaataaaaagaactagagctttttggagaacggctgatttcagacctggggcaggaaatttacaaaataagcctgaaacatcttgtcacaccaaatagcaagaaaactaaggattgaatctatgacaaaaataaattcttagcactgggaagaataactgcaatggactgaaacacctcaaatgtttaaatccatgagttaatagcaatactggctgggcacagtggctcaggcctgtaatcccagcactctgggaggctgaggcaggtggatcacgaggtcagaagttcaagaccagcctggccaacatggtgaaaccacgtctctattaaaaatacaaaaattagctgtgccagtggcgggagcctgtaatcccagctactcaggaggctgaggcaggagaatcgcttgaaaccggaaggcggaggttgcagtgaactgagatcgcaccactgcactccagcctaccttaaagaccgaaactccatctcaaaaaaaaaaaaaaaaaatagcaatactaaaaattttttttaacttgctggtcttctttggagggtgctagggaatgaacttactattttgaagactagtgaataaaagaaatgaattaatgtttatcctgcccttcttatacaaattatacctcagggtaatcaaagagttgatgaaaaggagtttgtccttgtggaaatagtctgtataatgaattaagatgggatgacaaataaaatatcactttaggagccctaataaaataatggatctagacaaaacatcaatagctcctaacaacaaaaaagaaagagacaagaaaaaattatatgtctcctgctatgatttgaatatctgccctttctaaaactcatgctgaaacttaatcccggccgggcgcagtgactcatgcctgtaatcccagcactttgggaggccgaggtgggcagatcacttgaggccagaagttcgagaccagcctggccaacatggtgaaaccctgtctctactaaaaatacaaaaaattagccaggagtggtggtgcacgcctgtagtcccagccactcaggaggctgaggcaggagaattgcttgaacctggcaggaggaggctgcagtgagccaagatcacgccactgcactccagcctgggcgacagagtgagactgtcttggagcaggaggtcagtaggaaaaaaaaaaaagaaaaaaaaaaaaagctcacacctgtaatctcagcactttggaaggctgaggtgggccaatcacctgaggtcaggagttcgagaccagcctggtcaacatggtgaaaccccatctctactaaaagtacaaaaattagccaggcatggtggcaggtgcctgtgatcccagctacttgggaggctgaagcaggagaatcatttgaacacaggaggcagaggctgcagtgaacagagatcgtgccaccgcactacagtctgggtgacagagtgagactacatctcaaaaaaaaaaaaaacttgtttgactcccagtgcacccttctcgccctgtgatgccttccaccatgctatgacacagtatgaggccctcaccagaagccaaacagatgcagctgctcaatctttggacttcccagcctttagagctatatgaaataaacttcttttctgtataaattaccagtcttgcatatttttatagcaacaaaaaacaaattaagacacctcttgatggtagtacataatacctatgaaatctcacaaaaaaaaaaaaaaaaagactacagagtttttaacctggggcacatggaccaggtccatgaaaatattctagggtctatgaacttcagtagaaaaaaatatatatatcctcattttcagtaacattgaactaaaatttaacaatcccttcaattataaacataggcaacaaactatagtggtgctagcaagacctaagactttgctgccaaaagaattcacagatattttcacttcgtatggctactatagctaaaatttcaaataaaatttatattcatcactactccaaaatcatggtaaaccaggcatgctggctcacacttgtaatcctagcacgttgggaaggccaaggcgggaggatcacctaaggccacaagttggagaccagcctgggcaaaatagcaagacctcatctctataaaagttaaaaaaaaaaaattgtaattaaaaactcattgtgatattttgttacttagtaaattttaaagaaaagaagcctctatattaacatatatcccaatttgctttttaataatttgacaactaaatctttgcaattggtttccattataatttttaatatttatgcatttaaaaacattatcctaagaagaaaatactgttggctgggcacagtggctcacgcctgtaatctcagcactgtgggaggccgaggcgggcagatcacgaggtcaagagatcgagaacatcctggccaacatggtgaaaccccatctctactaaaaacacaaaaattagctgggcatggtggtggatgcctgtagtcccagctactcaggaggctgaggcaggagaatggcgtgaacctgggaggcggagcttgcagtgagccgagatcacgccactgcactccaacctgggagacagagcaagactcagtctcaaaaaaaaaaaaaaaagaaaagaaaaaaaaagagaacagcctctacttttatttgaatgttcccataaaattttttttaagccaacagaaaccctacatgtacccatgccaaggctgttcagacaagccaaaacatcacatgtatttgccttcagctctaattatatcaaccaagtgtggtaacaatcattttctcttgctaatcagaagttcaggtgtctgattagttaaaagagagagagaaaaaaataaactcattattacttaacaaatgagtattggggaaagggtgtcaaaatctttcaaaacataagattcctggcaaaaaataataataaaaggggttcataatggaagaaaaacctgaagattgctgatctaatataaaatgtctcacactgtattctacttactatgtatatggctacccaggtaggtcacaagctcctaaaagacagaaacagtgtcatattcctctttgtttatccaggatatgaatcaatacgggctggcacaattgctgcaaaggtaaaaaatgccaccggagaaagctgacctttctgaaacctctgttagttcaactggaacaagtaggaacaaatggattacaagaagaaatcaatctacagtttaacttggaaatgtgtcaacccaaatgtgattatcaggaagcattcaacttaaaaataaaagtgtaaaataagttgcaaaactcattggaatgggacagggtgatagtatttgctcccatctcagcctaccacatagctgggactacaggcacatgccactacacccagctaatttttaaaattttggtagagacaaggcctcactcactatgttgcccaggctggtctcaaactcccggcctcaggcgatcctcatgcctagacctcccaaagcactgggattatagacgtgcaccaccacacccaaccaacaagacaatcttatctggttgcaaggcagatacaaaattatcttcgtgaagtggggggacatgtaatttctttgcccttgttctagatacaccaagcaacattaatcctatatttcccaggtaggtttttcttttgagatggttgtcttgtgaccatctgtcaaagttagcagtgacaattctcattaaaaactaccacctttcttttcaagtgtaagtgtaagtttgaacagcaagagctactttctccagagactggtcactaccaaatgaactgatcatgatgttccagacaaagagaactggaaaattctggcaaagaacaggaatcaagaggttcaggtgtcagccttcttatctactactctagaaatatgttcataaggttttgccaaaaccacagtctcactatttaatgaagcaataaagcaagcttttccaaaaattaccctatacattataacaccagttatagtttcttatggagcgggacatttctgaaattggcaaaatattttttttttctgctgatcttcaccaaatgttatactgcatttcttagactaaaggatggggtgggtgagctaattttgcagtattctataacaatacaacagaagtttggagcagagcaagtttagtatgggtctagatccagcaagtaacccactaggttatatccagtcactttagttgtaactcaggatatttccaatcaagacagcttctacctctgagcattcccaatgttgttagttcccggaactggtttattctattctgaatctacgagaacaagaaaaggcctggagccaaaagatagtagtgggagggtttagaagtcaatgacttgatgaattgattgatggatcaaattgcctgattgactaaaccttaaaagaaccagataatttgggtgggattgtggaaattttttgttattttctttttattctgtacatactagttttcaaacaatgagaaatctatttacagccaagtgtggtggctcatgcctgtaatcccagcactttgagaggccaaggtgggcagactgctgaagcccaagagtgcaagacaagcctgggcaacatgatcaaatgccttctctacagaaaaaaatgcaaaaattagccgggtatgatggcatgcacctatagtcccagctatttaggaggctgagatgaaaggatcacctgaccccagggagttcaaggctgcagtgagccatgatcatgccactgcactccagcctgggtgacagagtgagaccctgtctcaaaaacaaacaaacaaaatctacattctgtcaggaaagtacagggactagaagaaaatataacattggaaggcttcccctcaactcctcatgtttaatccttgtggctaatttggatttgcagctcacattccatcttttgtttctctcccaacctcttctggtctgtgatcctctgttgacaatttgagatttccaaactgctgacttaaagctccctggacttgccagtggggcatccatcatcatcaagtattatttatttacttattacattcatgctaatggacgccatcagaataccttgtctatgttttttatagtgtctcacagtttacaaaaactcttctataccctatcttattttatttttgatccatttgccaatgctgtgtggttgcagatgaagaaactgaagctaagagagttgaaatggctggatgcggtgtctcacgactgtaatcccagcactttgggaggctgaggtgggcagatcacgagctcaagagatcaagaccatcctggccaacatggtgaagccctgtctctactaaaaatacaaaattagccaggcgtggtcgcacatgcctgtaatcccagctacttgggaggctgaggcaggagaatagcttgaacctgggaggcagaggttgccgtgaaccaagatcacaccactgcattccagcctgggcatcagagtgagactctgtctcaaaaaaaaaaaaaaaaaaaggagagaggtgaaatgggttgcctaactgatgctgttcaaaagtatcagaatcaggagcaaaatacaaacctactggcactaagtagagtgcttttgctaaccatgttccctcctacatgactcttgttaaaattgttacacccaggcgagttagagaaaacgccacactctgagacgaattaagagtcttttatttaagccagcagccaaagagatggctaacgctcaaaattctctcggccccaaggaaggggcttgattaacttttataccttggtttaggaaggggaggggaagttaaatgcaataattctacagaagtaaaaacatgcaagaatcaaagaaacaaatggttacagagagataaacaatttaaaaagacaaatggttacaaaaaagcaacggaaccaggtgtggggctctaaatctttcattagagttagatatagatgctatgccggacacggactcaaggctttatgttgttatctctgtgtaaaatcctgggaacttcatacattgtttgtttcagtaccttatcagttaattgggctcctttgaaatgctgaggatctacttacacaggttaactccttgcggaaggggattgggtaaggagcccttagtgtcttgtaaattaaggggtcagttggagtttgtccggctttcccagctagagagtcttatttacaggagaagcaaggctaggtgattaaagagacaaacagggaaaatttaaagtagcgagttagagtaaaaacaaggttaggcattacaaaataaattccaaatagaggatgcatccaaacgttgacgaaaatgaatgaagcggctgggcgcggtggctcacccctgtaatcccagcactttgggaggctaaggtgggtggatcacttgaggtcaggagttcgagaacagcctggccaacatggtgaaaccccatctctactaaaaatacaaaattagccgggtgtggtggcgcatgtctgtaaacccagctacttgggaggctgaggcaggagaatcacttgaacccaggaggcggaggttgcagtgagccgagatcgcgctattgcactccaccctaggtgacaagagtgaaactccatctcaaagaaaaataaaatgaatgaagctacaaaaacacaggctagatttccacagccgtaaaaatacaggctaatgcgatttctctctataaatgcccaaactttatctgatcatatatactcatatcatatatactcatatctaagtatatttttccatacattttataatacataacatattgcatgactacagattcagttattatggaattataattattatacatttaagttggaattctgtatgcaaaaatatcctaacacacttcaatcatattgtccacactactgaaatatacaaaatatacaactcctgtaatacctgacaactgtaaaccatcataatatcatcccatagccaataagataaaagctaccaatatcaagtcctgtagaaaatgagagagagttacgcagaaaatcaaacgggtgctagttaaagaggccaacaatcaatgccttaaatcattaacacgcacactcacatgcaaaaacagaaaagcgtggagcaagagcaaacagccacttaaggtatttgaaggtaactacacctacaggctgaacacagtacacctggtaaactgcagccttgtctgcgggaggtcatctatctcaaaacaatcaaatcagaggttatacctgtgtcttttttcaagagaggactttgcagtagcacaccacttcaagatttttacctagagactggaatgtgtgcgaatttcccttccctgcttagtggaaatagtccgaacctggaaggcagcttcaatagcccacagtgactttttttttttcctttttttgagacagggtcaggtttctgtcgcccaaactggagcgcagtggcataatcagggttcattgcagcctcctgggctcaagtgattttcccacctcagcccccaagtaactgggactacaggtgtacaccaccatgcccagctaatttttttatttttagtagagacagggtttcaccatgttccccacactggtctggaactcctggactcaagcgatctgcctgcctcagcctcccaaacacaatgactcttattaccatctccttaatggtacccaattcaattcagcatgttttttttagatcctaacactgtgtcaagctatgggagcagagaaacggagcccctgtcctcatggaattcacaatacagcagtgaagaagaatagtaaagcaacaattccaaatgtggtgagggtgaacaaagagatgtacaaggtaggatgagatctaaccaaatctgggattcatggaaagccttattcataaggtcttgacttgaagaataaagacaagttgtctgggtcaagagaagggctataggaattgtcatcccagcaaagcggacagcattgtaaattctccagcatgaatggagcctgaacatgcagctcatccaaaggaatcagtatttttctaatctgtggtataacctaaacagtcagtagcaattattggtttattatttcaaacactgagtatgtgtaaaagattgtgggtgaaagttgagtaaaggtttccttgacattttatgaattatcacttacattttttctttttcttttttgtttccctgctgttcatgagctctagaaagctgtagaactattgcttacattttcaccaacatctaggtgttcttatttctttgtgctctaaagctttttttttgtctggtggggggcatcatttctgggttctaccactaaatgtaggtggaagaatactggtcctccaaaagtgtccacactctctccctcacccctgaacctgtgaataggttaccttacaaggcaaaagggacttctgtagatgtggattaaccaggtagccccaatctaatcacatgagactttaaaagcaaaaacgtttcccagctgtagtcagaaggagctataactacagaaggctcagagagatgcaacgttgctagctttgaagtcacaagccaaggaaggcaggcagcttccagaaggtggaaaaggccaggaattgattctcccctaaaacctccagaaaagaatgcaacacctgcaacactttgatttttagcccgggaagatgaatgttggctttctgacctacagaacagtaagatattaaattggtgttgttttaaaccactaaattggtggtaatttgttatgacagcaatagaaaacgaatatacaaagtcaacaatgcatgtgatactttaaaacaacacttgaatcataatgttataactatttacattcatctcagcgaatttccttagtaacaaaataatcacatcaaataaagagtctattaaaaaactgcaggcaaagctgattgggagctaccttggattgaaacactttcatcgtttgccagggagaaaataaaaccaggccatcaagccagaaactgctgaactagttccatggaaaccaacaaaaattgaaagtataaatccagtgatttattcttatgcattatgtcccatgtgacttagtgaagaacacaggggacacattagtactgtcccatcccctacataataaaagacagggaagtgctagccactgatgagctcttacgtatattaacatactgcatgttcatacaacactatatatgtatcattctggcagcatttaagtcttttaaccaagtttatgtgccaaataaatagcagcactagattaaaatccaaatatgattccaaagcctgtgttctttacattctgccatgctaaaaaactgaaataaggccaggagcagcagctcatgcctgtaatcccagcactttgggaggccgaggcaggtggatcacttgaggtcaggagttcgaaaccagcctggccaacatggagaagccctgtctctactaaaaaaaaaaaaaaaaaaattagctgggcatggttgcacagacctgtaatcccagctactcgggaggctgacgcaggagaatcagttgaacctgggaggcagaggtagcagtgagctgggatggcaccactgcactccagcctgggcgacagagtgagagtttgtctcaaaataaaaataaaaaagtaaattaattgtgggaataaagatagtaagaaaggcacccactaccagaatgatgacctctaaattcctatgacattttggttgcaatcctctttttccattttctatattctgcctgtagtgttttatatgttccacttgctttactagattctaaatgcagacatcgtgttatggattttttgccacccacccacccccaccttatacacacatagtctcacaatatctagtaatagtaatggtaataataattatgacatctaacacttattgagtgtatactatataccaagcgctaattgatttaatcctcccaacaatcctgagatgggtaccattattactgctatttacagataacagaaatggaggcacagagatgttaagtaacttgcccaatatcacacaactagcaaatggcagaacctggagaccaacccaagcagtgtggctccagaggctgagctcataaccactgttacactgcaagtacactacttgcatttattagggattcataaaacctttcttacctcaacaaaagtgaagtggcttaataaaaataaatgtgtgtgggtgccatactaagtacttatatatgatgtttcttttcgtttcttttcttttgagatggagttttgcttttgtcacccaggctggagtacaacggcgtactctcggctcactgcaacctccacctcctgggttcaagcgattctcctgactcagcctcccgagtagctgggattacaggcgcccgccaccacgcccagctaatttttgtatttttcgtagagatggggtttcaccatgttggccaggctggtcttgaactcctgacctcaggtgatctgcccatctcggcctcccaaagtgctgggattacaggcgtgagccactttgcccggccctctttttttttttttttttttttgagacagtcttgctctgtcccccaggctggagtgcagtggcgctatctcatctcactgcaacctctgcctcctgggttcaagcgattctcctgcctcagcctcccaagtagctgggactacaggcgtgcacctccatgcctggcttattttcatatttttagtagagatgaggtttcgccatattgcccaagctggtctcgaactcctgacctcaggtgatctgcccatctcggcctcccaaagtgctgggattacaggcatgagccaccacacctggccgataagtttctcttaaatatcacaaaaactcttgtgagatagagattattagtaccattatactgttgaaaaatagttgtaacagtttcagctgttcagaagtaacttttccaagatcagaaaattagtaagtctacatttttcccgttccatacactacttccctgacaacaataaaatataccatatgtaatactgacaattatgataccatacagggagatcaattggtacaaattaccctggctctggctggacgcagtgactcactcctgtattcccagcactttgggaggccaagatgtggggatcacttgaggtcaggagttcaagaccagcctggccaacatggtgaaaccccgtctctactaaaaacatgaaaattagctgggcgtcatggcacatgcttgtaatcccagctactcaagaggctgaggtgggaggatcacttgaacccaggaggcagaggttacagtgagcagagatcacaccactgcactccagcctgaacaatggggcaagacaccgtttcaaaaaaagaaaaagaaaacatattaccctgcctctctaacaaagggtactgattagccaaacccatatggttatatgttctacaattattttaataaggggtgttctgataaaaataagggaaaatataaaatccatgtatgatatccttctctttgtcatctggctttcattggctgaaaggagaaagcgtgaaacacattttctttttgagacggagtttcgctcttgtagcccaggatggattgcaatggtgcgatctcggctcatcgcaacctctgcctcctgggttcaagcgattctcttgcctcagcctcctaagtagctgggattacaggcatgcgccaccacgcctggctaattttgtatttttagtagatatggggtttctgcatgttagtcaggctggtctcaaactccccacctcaggtgatccccctgccttggcctcctaaagtgctgggattacaggtgtaagccaccgtgcccaacctgaaacacattttcatatcagctattctctttggatatgggtcagaggaacttaagtctattgcctagattagggggaagggggcaaaataaagagggcagcattcaactgtgggcaatatatggagtatgtggcctctgcctccaggatcctccctccccacaactcttctgtgagaaaaattctaagaggtgcacaaacatggacacactccaaaagacacagaggagctccaggagggctgaaaaggtgggtgctggggtgggaggcaggtaggatcaggaagcataggattagggttggtaataaacgtgctgccatttcacaagtctggattgcaagagagtacatccctgagacaggcatacaaccctccctctgcccatcccagtctggcacagggactgagcacaaacaaaccctgttctcaacaggcagccaagaagccacataaaatgttcaattcttaacactgcctgcccattgaggcagaacagaaggttctgaaggacgattctctttaactattgtaaaaactagatttccctcattgcggattatcaaaacaaaaatcgctttcaacacttgaggggtttgttcattttgtgttttgtgtgatctaaattgtccaatgcaatcctcagatgaagataatcaactggcatgcagctggaagaatgaagccaacagcaaacgcaatgcacaaaggcttacacagaatcctgctgtggtttggactcctggctcctgctgcttctctggtctctctgtggtttggcagcgtaaccctccatgattctgtaaagtaataaatcctcttttttttctttcctatgccagtggtgagctggacaccaccagtacctctaacaactgacctactacactcgtcacacaccaatcaggcacctgaagaaaacaggagtctgtgactaatctagaaagctcgtggagacctggcccagtgagggaagcggaggcggcgaggagatttcctatgagtcatgtcatcccttctagtctttcaacaccctacaggccccaaaccagaaaaactgtcatacgcctcccttaaactagcttcaacttctcctaatttaatccagacaactctgaataggctcaaaaacttttcaacttccactaccacacaagaacgaggattatcggggaacctgatgcaagcccaaaattttgtcagtctcaggtgggatctttaaatccgttaagttgcaatgtgtatagagcaatctgtttaacaggaaaataatatggaaaaggtgggtatttcacagaacagcagcacttcacagaagtacactaaggccggccgggtgtggcagctcatgcctgtaatcccagcactttgggaggccaaggcaggtggatcacctgaggtcaggggttcaagaccagcctgaccaacatggtgaaaccctgtctctactaaaaatacaaaaattagccaagtgtggtggtgcagacctgtaatcccaactcctcaggaggctgaggcaggataattgcttgaatccaggaggcggaggccacagtgagcggagactgtgccactgcactccagcctagacgaaagagactccaactcaaaaaaaaaaaaaaaaaaaagtacactaaagccaataaacatagacagagacccaacttcattagggatcaggcatatgtaaattaagatgttattttacattcatttgaccatcaaaaattttaaagcctggccgggcgcagtggctcacacttgtaatcccagcattttggaaggatgaggcaggtggatcagttgaggccagaagttcaaaaccagcctagccaacatggcaaaaccctgtctctactaaaaatacaaaaattaaggccgaggcgagcggatcatgaggtcaggagttcgaaaccagtctggccaacatagtgaaaccccgtttctactaaaaatacacaaaagattagccgggcgtggtggtgtgcacctgtaatcccagctactcgggaggctgaggcaggagaattgcgtgaacccaggaggtggaggttgcagtgagctgagatcgtgccactgcactccagcctaggtgaaagaacaagacttcgtctcaaaaaaaaagaaaaataaagaaaaataaaaaataaaaataaaaatacaaaaattagctgggcgtggtggtgtgcctataaccccagctactcaggaggctgaggcacaagaatcacttgaaactgggaggcagtgaggcaagattgcgccactacactccagcctgggcgacagagtgagactccgtctcacaaaaaaaaaaaaaaaaaaaaaaaaaaaattaaagcttgactggaagttgttttacaggatttctcatatacagctggtggaagtggaaaaaaaatttttaatttttttattttttgagccagagtctcactctgttgccaggctgaagtgcagtagcatgatgtcaactcactgcaacctccgcctcctgggttcaagcagttctcatgcctcagcctcccaagtagctgggattacaggaaatgtgccaccatacccctctaattaaaaataaaattttttaataccgcctcactctgtcacccaggctggaatgcagtggcgcaatctcagctcactgcaacctccacctcttgggctcaagcgatcctcccacctcagcctgcccagtagctgggactacaggtgtgtaccgccatacctggctaatttaggagtggaaattggtacgactgctttggaaaacagtttggcattattttatgaagtctaacaatcacctgccctataaaccagcaattctgcttctagatatatgtatatgtgcatgtctgtgaatgaaagaagccctttacacatgatcaacaggagatctgcataagactgtttctagaagtctgtatacaatagcaaaaaacccggaaaaaacccaaatgcccatcaacagcatgaatgaataaagtgtggtatattcacaggaaagaatattacaaagagtcaaagtgagtgtttgtatacagcatcagcacctgcaacaatatgaattaattttatcaacgtgatataaggggatataagtctcaccagattatagagcatgatatcctttttataaagtcaaacatgataataaaagcatactttttagaaatacagaggtacaaagcaatattaaaatgagagcaaaggaagagtgaaaggaaaattccagattgtgactatctttggtctaggtacatgtaaattctagctttaggactggtgatgcgtttacgggaacttactatattaaaaaagcaattgaggctggccaggcacagtggctgatgcctgtaatcccagcactttgggaggccgaagtgggcagatcacctgaggtcgggagttcaagaccagactgaccaacatggagaaaccccatctctactaaaactacaaaattagctgggctaatcccagctactcgggaggcggaggcaggagaatcgcttgaacccaagaggtggagattacagtgagccaagatcgcaccattgcactccagcctgggcaacaaaagcgaaactttgtctcaaaaaaaaaaaaaaattaattgaggctgagcagagtggctcacgcctataatcccagcactttgggaggccaaggtgggaggatcatttgagccaggtgttcaagatcagcctgggcaaaatagcaagaccccatttctacaaaaatttttttaaaattaggtctagagatgcacccctgtagtcctagctactctggaggccaaggcaggaggatcacttgagttcaaggctgcagtgaactatgatcacaccatggcactctagcctgggtgacaaagtgagactctgtatcttaaaaaaaaaaaaaaaaaaaaaaatatatatatatatatatatatatatatatatatatatatgtatattaattaagccattcatgagcccacaatgagagtgtgtcataggccagtgattatgattaatccatttccatgcaactagggtctaaaaaataaataatgctcccagaagatgcattctatttatctgactttatatactctttgccatccctagagatacaaataatccagaacaggcctagggatagactgcccaaggtctgttttttgtttgttgccctatcgcaaaagacagaaaggtacagtgagtaagagcacaggctctgggggccagactgcctgagggggaagcctggttgcattccttactactgtgtgactaacactgttaggcaaaattacctcacctctccgtgctccaactttcacatctgtgaaatggcactagccattatagtattataatacctgccgcagaaagttattataagggccagccacggtggctcccgcctataatcccagcactttgggaggccgaggcagacggatcacctaaggtcaggagtttgagatcagcctggccaacatggtgaaatctctctactaaaaatacaaaaattagccgggcctggtggcatgcacctgtaatcccagctactcaggaggcggaagcagaatcgcttgaacccgggaggcggaagttgcagtgaactgagatcgccccactgcactccagcctgggtgacagagtcagactccttctccaataaataaataaataaataaataaataaataaataaataaataaataaagttattgtaagaattacacaggccgggcgcggtggctcacgcctgtaatcccagcactttgggaggccaaagcgggcggatcacaaggtcaggagatcgagaccatcctggctaacatggtgaaaccccatctctactaaaaatacaaaaaaaattagccaggcgtggtggcgggcacctgtagtcccagctactcgggaggctaaggcaggagaatggcgtgaacccgggaggcagagcttgcagtgagccgagatcacgtcacggcactccagcctgggcaacagagcgagactccatctcaagaaaaaaaaaaaaaaaaagaattacatgagttaattcaccctgagatcccagaatagtgtggttgctcagtgcacaaagtaagccttactcaacaaatgttattattatttttatttcttgcttcatatcacagtgaaaagcttaggaaatgctcttcccccaagtatatcctaaacacttctggagtaggaatatccccacaattctctgggaagatctactgcacccatgcagcacaacaccatcctccttagtaaggctgtgttagactgaataaacagaatctgttttttccttaagtacccttacatttttaagaaatgactagaaggttcacacttgtaatcccagcactttgggaggccaaggcgggcagatcatctgagcccaggagttcaagaccagcccgggcaacatggcaaaacccagctactcgggaggctgaggctggaggattgcttgagcctaggaagtcgaagctgcagggagccatgtttgtgccactgcactccagcctgggtgacaaagtgagaccccatctccaaaaaacaagaaaggaaaaagaaatgactagaaagaagttttggatttacctgtggtttttcatggaatctctctgtgtatcattaacataaataaccaagtttttgtgacacatcacttgttggatggctttcaataacataggctctggctgggcacggtggctcatgcctgtaatcccagcactttgggaggctaagacaggcggatcacttcaggtcaggagttcaagaccagcctggccaacatggtaaaaccccatctctactaaaaatacaaaaattagctgggcgtggtggtgtgcacctgtaatccacgctactcaggaggctgagccaggagaattgcttgaacccaggaggcagaggttgcagtgtgccaagatcgcgccgttgcactccagcctgggcgacagactgagattctgtcataaataaataaataaataaataaataaataaataaataacataggctcctgtcattatccaaaataaacagctcaaaatctctggattcaaagcttttataatttataaaaatgaaaaccattcaaatctttatttggggtctatttatactttgactacaagcaattctaagaaactgagttatctggtttctacggtgttaatacagtagaaatcataatttagaaagaacacagggttccagagatatgattggtaacagaaaaaaaaaaatcacatgtgacaacctgggagaaaaaaggctgaaaaaaatcagacaaataatccatatcaacgcccatgaacgtattgttgcctctcagcagaaaaaagtgaatgatgatgatcctgaatcatgaagaaaacatgataccacgataaaggtactgtttatcaaaagagtagtctcatatatttgtcttaaatatgccatgaaaatttttaagtaattttttttttcttggcaaaatctccaggattagttgcaaatggacccaataagtaactaaatggcttggcctaccctaagacagttgttcagtacaaaccaattaatcctcaaagaattgctgccaaaattataaataaatgaattagcagaagttaacaatccattacataaatagtgtcattcaactagatttaaaagtgaattttaggctgggagcagtggctcaagcatgtaatcccagcactttgggaggccaaggtgggtggatcacttgaggtcaggagttcaaggccagcctggccaacacggtcaaaccctctctctacaaaaatacaaaacttagctggcatggtggcgggcgcctgtaatcccagctactcaggaggctgaggcaggagaatcgcttgaacccgggaggcggaggctgcagtgagccaagatcatgccactgcactccagcctgagtgtcagagcgagactctgtctcaaaaaaaaaaaaaaagtgaattttaatgcttaaaagaatgagttttaaattatctggaaaattaacctgtgtgaaatgatttgttctctctgatgatcttcagtaaataatggcataggttttcatagcttttcttttacagatagggacttaccctgtcgcccaggctagagtgcagtggagtgcctttgaaatactggactcacaatctcaagtgatcctcctgcttcagccttccaagtagctaggattataggcctacaccactgcacatggctaatattctattttttatttttttgtagagacaggagtctcgctttgttgcccaggctggtcttgaactcctgagctccagaaagtttcctgtcttggtgttccaaagtgctgggatcacacccatgagcaacctcacgcagtctactacagctttttcataaaggtaccaaaacttgcctacacaagcaatttcctggggaggcaattcacttcttccacaaatgtggctaccttcagaaataatctctgaaagctattcagaaatagcctaatttttatttcagtcttaactcatacatatcatgggaggaattgctaccatttcagatctgtgccaggcataaagtactgcaggaacttcaaagatgaattatcatctctgtccttaaaaaggcactctcccaggcaagtgataattatacttaacattacaatatgagaagtgcaatgatgaggtaggaacaggtacacagaggggcacccaactgaaaatgtgtgtcaggagggacagaggaaacagggaagaagatttcctaagttggtgctaacagtgaaagcaatcccaggagggaactacaggtgcaaaggcgcaggtatggtgtgcacaagggaatcaccagcagatcagtgtctctgaaccaagtgccaagtgagagagggacattctgggaggtgagcctggagagggaagtgggccagtgatggaaagcctcctacctcatgtcgagaagactgaactctcacaaaatgacaagtgccaaatgattccatttatatgaagtatctagagaagtcaaattcatagagacagaaagtagaactgtagtggccaggggctggggagggggagtgcagagttattatttgaaatgtgcagagtttgggataataaacaagttctggaaacagatatggtgatgattgcacagtattacaaatgtacttaatccccctgaatgatacacataaaaatggctaaaatggtacattttatgttatgcatattttaccacaataaaaaagaaaacttaaaaaaagtattatgttcaggtaaagaggaagaagaaaaaggagagaagggtgaggagaggaggaggggcagcagtttgagctctaaccaataaacagtggctttcagatttgttttagctgcagagccctttcttcacacagcattggtatagacttaatatttgtctcctcaaaattcatatgttgaaatttaatccctaatgtgatactatttggaggtggggcctctgggagatgataaggtcatgaaggtggagtctacataaatgggattagtgtccttacaaaagggactccagggagctcccaaatcctttttaccatgtgaggacacagaaagaaaacagctgactatgaaccaaaggacaccaaacctgcaggcaccttggtctcagacctcccagcctccagactgtgagaaataagtgtctttggcttggaagttatccagtgtacagtattattgttattaatctggcataaaagcccaactataaaacgatcaatagcagcacaccctggtgggtgccagaggccagcccagaagcccaccagctcctatcccctacttgtttcccatggtgaaccctaaggaacctccagggaaccccaagagctcctccggtttgcaaaccactagggtaggtgatgggaagaatcccaaaaggttttcagcctgagcataatgcagtgagatttctttctttttttcttttaatttttttgagtaaactagtcatatcacatgagatttttgaaagagtaaagcagctctggattttagaaacaaatgaaactatctcagctctgcctctcaccagccaagtgtcctgggtaagttacttacctgctctgtctgtcaaaacagaataaaaaacctatttttgtaggattgtcatgaggattgatgaaatataagtagggtgcctgatacacagcgaattctcatttgatgacagccattaatactctttcgttttattaggcatcactctgacttctgtgtagcgagatgattggggtcggggatagatggaggcatggatggaagctattacaacagtctaagtgagagatgataaaggcttgaactgaattagtcacaatagggattgaggccaggtgcggtggctcacgtctgtaatcccagcactttgggaggccgaggtgggcagatcacctgaagtcaggagtttgagaccagcctggccaacatggtgaaaccccgtctctactaaaaatgcaaaaactagccaggcttggtggcaggcacctgtaattccagctactcaggaggctgaggcaggagaatcgcttgaacctgggaggcgaaagttgcagtgagctgagattgcgccactgcactccagcctgggcgacagagcaagactccgttttgggaaaaaaaaaaaaaaaaaaagacaatagggattgaagggggaggtggactctaggactattctggaagcgctgtcaagacagggaataagcactgacttccttcaagtcaaccagaagaaagaagcaaacaaaagaaggaataacccaaaggttgtctagaactggtctaggggaagaaggagactacagcctggggcagaaagaggaaccagaggcccagtggagggcatgctggagaaaagcttttcaattccagtcttacctctccctacagtacatgtctgcccctttaacaactccctccagtgttgagaaattaataaaacaggttcaggctgtccagccagcaatcattcctcacctaccctctccaagctccttgggctaatgggctgtaacctagagagactgcctcctccttctttcagagcagctgataggaatagcttaatggacagtcactgaacaacagaaatcaagggtgattctgtagtgcccaagattgctccatcctggggtgcatcccctcccctctacctagagggactcagacccaagcctggctatcatctcgttcttcagcacataggggacatgtatgagagtggtcatcacagtgatgtttgtggaggctgggagttggaagctgtctggttgtctaacactggtggatggaccacggaaccacagaatactctgtagcaggtaaaaacaatagactaaatcagtggttctcaattagggatgatttttgtccccgagaagacatttggcaatgtctggagacacttttgaatatcacaactgggagtgggggtgagggtgctatactggcatttattgggtggggccaggtatctacatcttacagaacagccccaacaaatagtcaactcaaggccgggcacggtggctcacttctataagcccagcacattgggaggccgaggcaggtggatcacttgaggccaggagttcgagaccagcctggccaacatggtgaaatcccatctctactaaagatacaaaaattagccgaacgtggtggcaggtgcctgtaatcccagctactcgggaggctgaggcaagagattcgtttgaaccaagagggggaggctgcagtgacccaaaatcatgccactgcactccagcctggaatgagactccgtctccaaaaaaaaaaaaaagaattagtcaactcaaaatgtcaagaaggctgaggttgattgggcacagtgtctcacacctgtaatcccagcactttgggaggttgagatgggtggatcacctgaggttgggaattcgcgactagcctggccaacatggtgaaaccctgtctttagctgggcgcggtggctcacgcctgtaatcccagcactttgggaggctaaggtgggcggatcacaaggtcaggagttcgagaccagcctggccaatatggtgaaaccccatctctactataaatacaaaaattagccgggagtggtggcacgtgcctgtagtcccagctactcaggaggctgaagcaggagaatctcttgaacccgggaggcggaggttgcagtgagctgagatcgcaccactgtactctagccggggcaacagagtgagatgctgtctcaaaaaaaaaaaaagaaagaaagaaaccctgtctttactaaaaatacaaaaattagccaggcatggtggcaggcgcctataatcccagctacttgggaggctgaggctagagaatggcttgaaccccggagacggaggttgcagtgactggagattgcgccattccactccagcctgggtgacaagagagaaactccgtctcaaaaaaaataaaaataaaaataaattaaaaaaaaaaaaggctgaggttgagaaacacactagatgaaaaaaacaacatgactgggtcacaaacatataatgcagagtggaaattttttctaaaaaaaagggatgtaatcctttatacaatgcctattggaattaaggattcattctcagccatgcatcccatattttttgtgaatctattgcaaggtcagtaatgtaacaatcagaatatacaatggccataactagatatgattcctgactcctggagtctagtagaatgggcagatagtaaataatttcatagtaaaaagggggaagggagaagaatttatggagactcgtagaatccagagttccccaattccccagggaactgcacaagccacaaaagatccctaactttacatctttgtttaaataacactataaacaatacccttcagcagggatacataccagcttgggatttatgctgcatacacagtgagagctcaatagatgtctgttgattggataaagtctgcacagttaagcacaactaaatgactccttcaaaaatgtctaggactttaccctgtggaaggcggaaaccaaaatgaaaggagaaagcacaggtgtatcccagacctgttgctagacaataacaaggagtgtgggtgttggccaggcgtggtggctcaggcctgtaatcccagcactttgggaggccaagggaggtggatcacttgaggccaggagttcaagaccagctcagccaacatggtgaaacctcatctctgctaaaaacacaatattggctgggcacagtggctcacgcctgtaatcccaacactttgggaggccgaggcaggcgaatcacgaggtgaggagtttgagatcagcctggccaacatggtgaaaccccgtctctactaaaaatacaaaaaattagctgggtgtggtgacaggcacctgtagtcccagctactcgggaggctgaggcaggagaatcacttgaacctgggaggcagaggttgcagtcagctgagattgtgctactgcattccagctggagcaacagtgcgagactccacctcaaaaaaaaaaaaaaaatacaaaatacaaaattaaactggctgggcgcagtggctcatgcctgtaatcccagcactttggagggggccgagatgagcaggtcacctgaggtcaggagttcaagaccagcctagccaacatggcaaaaccctgtctctacaaaaaatacaaaaattagccaggcatggtggcatgcgcctgtaatcccagctactactagggaggctgaggcaggagaatcacttgaacccaggaggcggaggctacagtgagctgagattgcaccactgcactccagcctgggcaacagaacaagactccatctcaaaaaaaaaaaaaaaaaaatttagccaggcgtggtggcccatgctgataatcccagctactcaggaggctgagacaggagactcgcttgaactcaggagatcatgacactgcactccagcctagggctccatctcaaaaaaacaaagtaatgtgggtgtagactgaccacctattatccttccctcctccagcccatgcccccttcacaccaagctacttgaagttccttaagcaaaacactttctggcactttcaagcctagactacccttcctcacctaggccacctggaaaactcattcaggcttcataatcacgatcaccttccctctcaagctccctaaccctatctcaccctggtagacttggtctctgcccttttttgtgccattgctgaaccttgcacttatctttatagcacttatcataactttttatcataatttgatgatgagctttcactagagcaggaacttagtcctattcgttatggccaaagagacaagtctgaagcctagaacattacagatgtccaaggcttggtgaatgaaagaatcaatgaggccgggcgcggtggctcacgcctgtaatcccagcactttgggaggcagaggcgggaggatcatgaggtcaggagatcgagaccatcctggctaacacagtgaaaccccgcctctactaaaaatacaaaaaaaattagccgggcgtggtggtgggcgcctgtagtcccagctactcgggaggctgaggcaggagaatggcgtgaacccgggaggcggagcttgcagtgagccgagatcgcgccactgcactccagcctgggcgacagagcgagactccgtctcaaaaaaaaaaaaaaaaaaaaaagaaagaatcaatgaataaaccatgtccagcactctgctacaaaaggaacatgataaaactcatgcccttgaaaagcttatttatctatttgatgggaaaaagataaatatataaaataataattaaaggtttttgctagagatataaagttgatggttgttacaaggaatacgcgtttttaaaatatatgaataggcctggtgcagtgactcatgcctgtgatcccaaattttaggaggccaagatgggaggattgcttgagcccaggagttcaagatcagcctgagtgacaaagcaagattttgtccctacaaaaactaaaattaaaaattaaaaacatacatatgaataaattaggatctatgtgtcagaatgtaaactgtctgacagtatacaattaaataataataccaggtgcagtgggccactcttgtaatcccaacattttggaaagccaaggcaggtggatcacttgagccaaagagtttgagaccagcctgggcaacatggtgaaaccctgtctctacggaaaaaaaaaaaaaactagtagtgcgtggcagtgcatgccatagtcccagccactcaggaggctgaggtgggaggatcacttgagccacggaggtcgaggctgcagtaagccatgatcagccactgcactccagcctggccaacagagtgagagcctgtctcaaaaaatgatgataataataataataaacaattaaataagaagtattctcagatactcctggaagtctatggtcttctatcacaatatttttcacttgagttgacagtaataaatcacaaaagccaaaattacacactccactaaggaatatatggttctcattatcatgaatgtctggcacatggtaagtgttcaataaacttttattgaatgagtgatctgatattcctaatcatagagaaaagttgtctgtaccctatgggggcaggtatattaagagctggggtcacttagaacatatcctcctcataatgaaaacataacaagctctatgccccaatcttctccctgtatttagtacccagttgcccaaaaagcctcttcttgcccctttttggtaaaaggaatagaaatgagctatgtggttataaatctctctctgtatcttgcccatatggtgataacacatcatatccattcaccaacctctttctacactctcccacccttggttccctggccacaggtggggattcacaaagctactcaaacttgggacatgagttttgacaacaaagcttaaaatattgagtattaggagtactggatatctggtaaaccactcttttctgattgctgggtctgataaagagaaactgcaatccaaaatccaagtgcttggatggctgccagaggtaggaatggaaactttaattaacaaaagagcccagccaaccaaacaagaagctcagcccaagacccttggaataaagaccaataaagggaagagttcagggagggaggcagaatggaaaggaagacttgtgaacctttgtcatccctcagtcattcactcattcattcattcatgtgctaagggttgtggtagatataaaaaagaaaaagacaccatttttgctgttaaagaacttcgtccatggccaggcgtgtggctcacacctgtaatcccagcactttgggaggccgaggcgggcggatcacctgaggttgggagttcgagaacagcctgaccaacatggagaagccccatctctacaaaaaatacaaaattagccaggtgtggtggtgcatgcctgtaatcccagctacttggcaggctgaggtagaagaagagcttgaacccgggaggcggaggttgcggtgagccgagatcgcgccattgaactccagcctgggcaacaacagtgaaactctgtctaaaaaaaaaaaatgcccataactgctattccacaagaaaggaaaaagccctcaaagagatacataaaaaggacattcatagacaaaagaaatctcatatttaggaggctactagactgattataaaacatacccggattccaaaagtatcagaacattaggagagaaaaaaaaaaatcaggccaggcacggtggcttacgcttataatcccagcacttttggaggctgaggtagatggatcacctgaggtcaggagctcaagaccagcctggccaacatggtgaaatcctgtctgtattaaaaattagccgggcatggtggcaggcgcctgtaatcctagctactcaggaggctgaggcaggagaatcacttgaacccgggaggcagaggttgcagtgagccatgatcgtgccgctgcactccagcctgggcaacaagagcaaaactctgtctcaaaaaaaaaaaaaaaaaagaagaagaagaaaagaaaagaaaatcattgttaattcttatcacatcttgttaaacatacatcttgccatatcatctgccccagcctcaaggccactggcatctcctgaagcaatcaccaaatgttcccatcacccaagaatagagagctaatggtgacaactaacccatatagagcactgaaaggagccaggctctgtctgccctttcctgcatagtaaccttgtaacagcactacaaggtaggtactgttattatctccattttacaaataagaaaactggagcacaggctgggcgcggtggctcacgcctgtaatcccactactttgggaggcggaggtgggtgcatcacttgaggtcaggagttcaagaccagcctggtcaacatggggaaaccccatctctactaaaagcatgaaaaaattagcctggcgtggtggtatacatctgtaatcccagctacttcggaggctgaggcaggataatcgcttgaacccgaaaggttgaggttgcagttagctgagatagagcctctgcactcaggcctgggtgacagaatgagactctgtcaggaaggaaggtgacagaatgagactccgtcaggagggagggagggagggagagaaaagagggagggagactggagcacagagaagttaagtgacttgtccaagaagggagggagggagggagagagggagaccggagcacagagaagtgacttgtccaggaaggaaggaaggaaggcaggaaggaaggaagggagggagggaaggaaggaagggagggagggagggagggaaaagagggaaggagactggagcacagagaagttaagtgacttgtccaagaaggaagggagggagggagactgaagcacagagaagtgacttgtccaggaaggaaggaaggcaggaaggaagggaggggcggagggagggaactggagcacagagaactgatttgtccaaggtcacccagcagaaggaagggaggaaggaagggaggaaggaagggagggagggagactggagcacagagaagttaagtgacttgtccaagacggacggacacggacggaaggaaggaacaaagaaggagggagggagggagggagggaactggagtacagataactgacttgtggaaggaaggacggaaggaaggagagagggaacgaaggaaggagagagggaaggaaggaaggaaggagagagagggaaggaaggaaggagagagggagagagggagggaagggagggaactggagcacagagaactgacttgtccaaggtcacccagccaggatttgagtccagaatgtgagtgcccttagccattacactgaattgcctcccagctgagaacttttaacaaatgtatcaggacatacacaactggatgctacaaggtggttttcggccaactttcccctttaaacacatgcatcaatttcaaactatttatatgataaaaaatgcttacacctttatcgatctcgtttttaaaatggtatggcttttcaggactatctttcacaatcgttaaagggaaattcgctttgttaatatgaaaaaaaaatcaaatatctgtttcatgagttgtcagtggccaacgctgtttagactacggcttgaacgcatcaccccttaaagatcatcttgtggccttgggcaaattgcttagccttctttgtttctccagcggcaaagtggatataacaatagtaccatctcctaaagtggtgaggattagctgatattatccatataaattgttatgcacagtacctgacacagagcgagtgcccaataaatgtctttcactatttaggtcctgggttctctcatttccagagtgcaagtcctccagcaaccacagaaacgctttctagagtcgctgcccactccttaaaaacatttgtccctacttcgcacagagcatagtgataccacaaacaggcttccctggaccccagccctgggggtggctatatcacctcgctcaggcccaggaagagagagccggctctggtctcccacccggcagcagcacaaaacttaaccaggatttctcacttcggtcaactcttgaatcaccgcgcccagtctggctggctcggcagcagatggaatgagggcgccggcgccaggaagtggcgctcacccacctgcccagcccgaggtgggcactcctccttcacagcatccccggggacctcgtccctccaccgcggaacgccccagaggaccgacctaatagtgccacagggtgggtttccccccaaatcctccaaaatacatcgccacgatttcgaaacgggagccgagggagacgcaccaagtgcttcccgacgccaggtgaagcgcaccatacctggtgtgcgtgttgagccccgaaccgaagtccgtgcggccgccacctctgcctccctgctgggggcctcagagagtgtgctccttgtccacgtgcgcgcagggcccgcagccgcccccacgccccagcggagctgcagcacgccccttccactcaccaggtgaagagtttgccttttatcctgcgcagcaggctggagaactcggccgccgctccctccgcgaggggctctggggcgccggggcccgctggcgagtctgcctccatcggcgcccttgcgcgtctccggcgcccaaaacccccgaagtgccgggtcccggaagacgggaggcggtgcctgtgcggccggctggggctccgctctggccctgcgctccctccctcgctcgcttgctcgcgtccctctcgctcctccgctcggctccttcagcgaccaatcattaactgtcaagccctaagggccagacaatacatttgcagattacaacctggcacctccagggtggcaggaggagaaagggcaatttttttttcgtcttggcagccgagccttattgttgagcggcacccagtgtgccttcaggtttttagggttccttgtttgaaatcacaagatacagtgacacgaggttattgtaggtgattcctaagctaagaagcggtgagtgagcagtgagttagaagcagt
